United States Patent 7,745,391 (HUMAN THROMBOSPONDIN POLYPEPTIDE) - sequence listing, part 66

SEQ ID NO: 230586 - DNA, 1924 bp, Homo sapiens
agcggggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctgaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcaggatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttcc

SEQ ID NO: 230587 - DNA, 860 bp, Homo sapiens
agcggggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttgcctatccaagagtgagatgactatacttgacttgattggcaaaccgtttaagtgaaccatacatcaattacggtgaattatggtatgacggtacttcacttaaacggagatgggttttttatgataaaccttatccggc

SEQ ID NO: 230588 - DNA, 1746 bp, Homo sapiens
caggctcgtgagtcgtcctgtgactgtgggtatgctaaatgatgcgccgaatttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctgaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcaggatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttcc

SEQ ID NO: 230589 - DNA, 573 bp, Homo sapiens
tggaaatgactaattttaagaattttgatccctttaaattttgtacaaatctgcataaagttacataaccaatatattttttcatataccttttcaggatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggttta

SEQ ID NO: 230590 - DNA, 411 bp, Homo sapiens
cggcacgagggtgcttaatgatacctgtgcctgctccatctctctctttcttctcctgccttgatgtcttgaaggtcatttgttctagaagatgatatgcctataacaaggaggaaggtcacccagcctgcaccagatatttgcactgccagagcacctctcaagaatgcagatttaaagatgtcactggggccgggctcacacctgtcatccctggactttgtgcagccaagacggctggaccactcaagcccacccagcaagggcccggtcaacagctctcagatgaatagaggtgaacaccaaaatcagaggaaaaggtggctggtgttcttcctggaacatttcatttttgaaccagagaaggctcatcttgaagcgttaataaagaagcttttatttgttaaaatg

SEQ ID NO: 230591 - DNA, 312 bp, Homo sapiens
atcttattcttctgtctcatcagtatccttctctaaccgcacttcagtatccctgtcctctgaaaatatcaagtccacagggtaaaagaaagactgtgtggttagtacactttgtgagcaggacccggaaggccctggcagaagctggcactgttccacagcctccactgcactttcatgcctggctgctgaaggatttttttaaacttcttcggcattttgtttaatttatgactttatacctcagaagtagtgaactgacagggtttgaattttttaattacattgattaaacaattacttgaaattcca

SEQ ID NO: 230592 - DNA, 549 bp, Homo sapiens
ggaaattggggaaacatggatctctctgtattgcttcttacaatttgaggtgaaactaagtatctcaaaatttaaaagctttttagaaaagaaaaaattccacaatttccaatgtacttgaaagttggaagctgaaccaaagggcacttcagccccacagattccactccttgtctcaacccttcccccaccacaatgtgaccaaattgtttacagtccattctcccagaggctcctggcatctcttgtaaaccacaatctgttagactgtagcttcagcaaagatttctggaagacatcactgaaattctgagtgtccaatgtgggcatgaagccagttttctagcttccagcctgtccaaatctgaggctattacagtattcaaatggcagcctgtgaactcacatttcaaggagactgttcctcttgcatcctggacttccaccatggaaggttcacgtccttgagtctaatgacttggtcctcaccaggcttccttgctggaacataagcaccacgaggacagaaatactgggtgggttcccctg

SEQ ID NO: 230593 - DNA, 297 bp, Homo sapiens
gtcagagcccttcatatgtgttgtcctacttcagtcttgagtcctcaagagctgttttccaaaatggctttggcattttggaaaagtgctggattcaccttatgttaaattatgagaatgcaaaagatgagaatgacttgtagcttcaaagcttcaatgagctactaacaagtcttgagcactttcagatttattacctctgtggtctcatcaccaatcatgaattaactgttctaagacaaggtatgaaatagttctcggttttgtaattagagctaaaagtagatcagtatcttt

SEQ ID NO: 230594 - DNA, 381 bp, Homo sapiens
gcagcccagggcaaggagagcagcacatgcagccaggacacttcagaggaggcagtgtgtgtgctgcagaagaatctagggataaatgggagaggggcagccaggcaaagggaccagcctgtgcaaaggctcagaggctccaaagtgcatgtgcgatatcccctggccaagaaactcaccttccagaaaggcgtcctgaggcagtaactgcaggctgtttatagcagcccagaagtgaaagcaacctaaatgcccagccagaggggatccgttttttaaatcctgctatgtctggggagtttcaaatagccaagtcctgttgctgaaatgccacatgggaaaatgggctccatgctcaccacccatcccgcgaacgagcga

SEQ ID NO: 230595 - DNA, 192 bp, Homo sapiens
caccagaatgagagctgtaccgttttatgacatcagataattctgactcagaaatgtctgccttccctgtctgccagcagtcttacccttggtttctggtagatccatttccattcttttaactatttacttgatcctgtggagtctttcttaaaaatacagtctttagatattgtcagttctaagcattca

SEQ ID NO: 230596 - DNA, 1432 bp, Homo sapiens
cagcaatattttactgccactggatgtctgcacaaggaacctatgccagccagggaggttgagagtgaggctcagtggggactggcatactggctgagtggatgcagtcattgagcaacgcatgtcatgcatggcgtgggccatcactctgctgggtgaaagtttcaggagcgaatgagacccagccctagctctcaaggaacccatagtctcataggtagtggtcctgcaaagtggccagggaaaggatcggggtgcagggtgctgaagtcacatggaaagttgtgaacgttgccggtaccaaaatggagtcacttatgtcaaactaaaacagttggaggtgatgaagcagccctcacgcacacattcctgcaacaggacttaccacaagacatttctacaaacagaccaataacaggactcactgcaagaccatcctcaacggttgcagtattccagataagctgctattcccaaatccatttattttagagagtctatctctggatttcttcataggttgactgtgtcatgtaggattcagtatagtgaacaaagattggggaaaggcagaccccaggcagaagatcagaggcaagggggacagtcatgcatttgtaaggtctaaaaagttcagtctgcttttgtgatacctgacgaattttcatatgttgtgttttcattcagttcaaaatacttgctaatttccctttgatttattctttggctaatgagttatttaaaggtatgtcatttagtttccaaatatttgggaatttaccagagatctttctgttactgatttctagttgaatttcattgtggtcagagaacatactttgtataacttgagtccttggctggggcgtggtggctcacacctgtaatcccgatactgggaggctgaggcaggaggatcatttgagcccaggagattgaggtcagcctgggcaatgcagcgagaccctgtctctacaaaaaaatttaaaaaatcaccctggggcggttgcccacgcctatgcctatagtcccagctactcagaaagctgaggtgggaggatcacttgagcccaggaggttgaggctgcagtgagccatgttcctgccactgcactccagcctgggcaacagagtgagaccgtgtatcaaaaaacaacaaaaaaccacttgaatctttttgaagttaacagggtttgtttcatagcccagactgtggtctctcctggtaaatgttctgtgtgtgctcgagaagaatgttttctgctcttgttgagtcaagtgttttaatgtcaggtccagtggagttcaagttctgtatccttgccaattttcttttcttttttctttctttctttcttttttttttcttgagacagagttttgctcttgttgcccaggctggagtgcaatggcgcggtcttggctcactgca

SEQ ID NO: 230597 - DNA, 403 bp, Homo sapiens
gctgcagagaatgtgtcgcgtggctgtagtcttaggcaacttaggtggggctgagaacccagggccacttctgtctgcgaagtggctcaaattcagcatggaaagaacggagccttcatggaatgcaggcgaatacagtgaatgtttgtgcctaaatgactgcgtggggctctgcaggtgtaggatgagggaggagtccagtcttttctagtgtcatgaaattcccaccgcagctgcctgctgctccccggacgggatttcctctcgctgccagtgggaggggtggggagggctggatgtggcgagggagtctgtagacagaagacattgccagctcccagccccaccgccttccccgcacactcgtcgcgctgtgactcccggccccgccgccttccccgca

SEQ ID NO: 230598 - DNA, 2355 bp, Homo sapiens
  misc_feature (1401)..(1401): n is a, c, g, or t
  misc_feature (1407)..(1407): n is a, c, g, or t
  misc_feature (1417)..(1417): n is a, c, g, or t
  misc_feature (1422)..(1422): n is a, c, g, or t
  misc_feature (1425)..(1425): n is a, c, g, or t
  misc_feature (1427)..(1427): n is a, c, g, or t
  misc_feature (1434)..(1434): n is a, c, g, or t
  misc_feature (1438)..(1438): n is a, c, g, or t
  misc_feature (1444)..(1444): n is a, c, g, or t
  misc_feature (1449)..(1449): n is a, c, g, or t
  misc_feature (1457)..(1457): n is a, c, g, or t
  misc_feature (1459)..(1459): n is a, c, g, or t
  misc_feature (1469)..(1469): n is a, c, g, or t
  misc_feature (1473)..(1473): n is a, c, g, or t
  misc_feature (1479)..(1480): n is a, c, g, or t
  misc_feature (1487)..(1487): n is a, c, g, or t
  misc_feature (1496)..(1497): n is a, c, g, or t
  misc_feature (1513)..(1513): n is a, c, g, or t
  misc_feature (1521)..(1521): n is a, c, g, or t
  misc_feature (1528)..(1528): n is a, c, g, or t
  misc_feature (1536)..(1536): n is a, c, g, or t
  misc_feature (1538)..(1538): n is a, c, g, or t
  misc_feature (1541)..(1541): n is a, c, g, or t
  misc_feature (1544)..(1544): n is a, c, g, or t
  misc_feature (1550)..(1550): n is a, c, g, or t
  misc_feature (1552)..(1552): n is a, c, g, or t
  misc_feature (1556)..(1557): n is a, c, g, or t
  misc_feature (1559)..(1559): n is a, c, g, or t
  misc_feature (1563)..(1563): n is a, c, g, or t
  misc_feature (1664)..(1664): n is a, c, g, or t
  misc_feature (1711)..(1711): n is a, c, g, or t
  misc_feature (1725)..(1725): n is a, c, g, or t
  misc_feature (1745)..(1746): n is a, c, g, or t
  misc_feature (1797)..(1797): n is a, c, g, or t
  misc_feature (1806)..(1806): n is a, c, g, or t
  misc_feature (1831)..(1831): n is a, c, g, or t
gttcctattcggccatcttggctccacctccctgtatttttctttttaaaattgcatagttgcttaaacttatttttttctctttggatttttaaaggttcactgtatgtatagtcttatatctcagtcgatcttgttagtggcttattgttaaaacatgcagtttttggctgggcatggtggctgtattcctagcactttgggaggccaaggcaggtggatcacctaagcccaggagtttgagatcagcctgggcaacctggtgaaaccctgtctctactgaatatacaaaattagctgggcatggtggcacacgcctgtagtcccagctacccaggaggctgaggcaggagaatcacttgaacccaggaggcagatgttgcagtgagctgggatagagccactccagacttagtctccaaaaaaaaaaaaaaaatttaaagaaaaaaaatgtctacaacatgcactccccaaaaatcttatctaaaactgaacttattatgttctctcctaaatcagttactcgaagttcaccgctctcctggaacctcagaatacaaatcatagtatcttaattgactcatccttttatcttatcaaacccatcatcaaatccagatcattttcctttctctgtctctaattaattcattttgttcagagttgccatgatagtctccctaatatactgtttatgtctttgccctctgtcatccaggccgatgcctctcgacaaagaatgcacatcacaatcacctggggacctctttcaaatacttgtacctgggccccattccactcccattctcactattgagtcagcagatttggaaatgggccccttttgtacttggaagagtcttaggttattgaggtgaacctttagttaagatccactaatccagatccaccctgatcatctacttgtcactcactattcaacatacttcatccagctcaattagagctatcttccagtgattctccaaatactcatccccactctcctctaataagaatgtccttccagtttctctctgcttatataaatccataccatctttcaaagtgtaagtcaagtcccatcttctctattaagtttcatgaactggtcaggggcggtggctcatgccagcactttggaaggccaaggcaggcaggtcacttgagctcaggagttcgagaccagcctaggcaacatagtgaaaccctgtctctacaaaaaatacaaaaattagccaggtgtggtggagcatgcctataatctaactacttcggaggctgaagtacgagaatcgcttgggccaggaggtggtggttgcagtgagcccagatcgcgccactacgctccagcctaggcaacagaatgagaccctgtctcagaaaaaaaaaaaaaaaacnttgcanggaccacacnatacnagnancctcatnctcntccaantttcnataaaacngntatatgtaanaggngtcatnnggcctcngcactgtgnnactaccatttaatgtntaaagctngtattcncaataaancnatnctntttttncncttnntntctntttggaacaggctctggctctgtcacccacgctggtgtgcagtggcgccaatctgggctcactgcaacctcagcactcaagccatcttcccacctcagctncccgagtaaccgggactacaggtgcctgccaccacatccagctaatntttgggtttttgtngttgttgttttgctagaganngtgttttgccatgttgccaggctggtctcacatcccggctcaagcaatccncccacctcngcctcccaaagtgctgggattacangcatgagccaccacacctggccaccttctcaataaggattgtgtgttttcatgatctcttaacaatacccagcaatgttgtgcacatgggaagaatgcttatcttacaaataaaatattatgaaaaacattcttgaggtgacaggtatgctaagtaccctaatttgatcattacacattgtatacacgtatcaaaatatcacattgcatcccacacatgcataattattaaataaaattgaaggccgggcacagtggctcacgcctgtaatcccagcacttttggaggccgaggcgggcggatcacgaggtcaggagatcgagaccatcctggctaacacggtgaaaccccatctctactaaaaatacaaaaaaaaaattagccgggcgcggtggcgggcgcctgtagtcccagctactcgggaggctgaggcaggagaatggcgtgaacccaggaggcggcttgcactgagccgagatcatgccactgcactgcagcctggtgacagggcaagactccgtctc

SEQ ID NO: 230599 - DNA, 461 bp, Homo sapiens
gaaatcagggaaaaaatactaggaatacatattctcttaatggactgtaataattgagattgcctctatctgtaatattttatgcagttctacttatcagctcacaagtaccgaatcatataagaagaattcaagtgggaaattgcatttatcaaggagttggaacttttttcttatgaaaatattttgaaaaaattaaattttcaggtagtaaaggatgaagatgtaatctacaacagatgcaggaaaatagaaatttataaaaggtgtgaatggaggtaaatatgtacttactcaccctaacctaaaatattaagactaaaagtatttggaaaaagtaggctgggcatggtggctcatgcctgtagtcctagcactttgggaggctgaggtgggaggattgcttgaggccaggagttcgataccagcctgggcaacaaagtgaaacccccccatctgta

SEQ ID NO: 230600 - DNA, 809 bp, Homo sapiens
aggcgtgagccaccgcacccggttttattagcatatttcttgtttcatatttgactacccaattaggcactaaactttctgggaaccattcttttgggtgtttatttaaaaaccctgggcagctctatagcatttcctaaacacagggcaaagtaaaaatatttccaaatcatagattttatagataatcatcttcagaacacaaatgttggtatttggccataggaaagttgttgttgttaacgttttaattttgtgtattacaccataaggttttctccagtttttccccctttaaaccattataatatgtacatgttgaaataaatttattaagaagtagcaagttgaactctctgtaaactcaatcattattacacagtagtaagctagacatcagaagaatagttggcttttctgtataatcttgaacagcttttgggggaaatgagttttcttttcaagttaattggtactttgaaaatgccacaaagaggttcagtagatgatagtttatactcatggaatttttgctgctgggagtttttgtaaaaccatcaacatttttttgtactagatctttggggaactttcagttgctaataaattttgtaatttgcattgacattactttaaaaaaattctctaacaaagtctttttttcccagaagtctcagaatcgtaataaattctgaattctattttgtttgatttttcttggatgcctggaccatggattaattacagtaagagtaacttcaaggtcgggcatggtggctcacgcctgtaatctcaacacttggggaggg

SEQ ID NO: 230601 - DNA, 334 bp, Homo sapiens
catttttcagttgaatgtacatgggttttacattccaaattgtaattatgccttatagagtattgatcctgttttttatttgatattatgttctatcttattctttgaaagcatttgtattagattatattagttatgagattaatagttccgcatttgaatgtatactaatgtatttgattatattgttgggcatttaggctattttctgtgatttgttaatttagatgttataatccataatgcttcctttcaggctttttactagggtgtttatttacaaagcagtgaaattgatagagcattcacagcaaggaaaataggaaattaagca

SEQ ID NO: 230602 - DNA, 956 bp, Homo sapiens
tcataaagggtaacatcttgcaacttgattctttcacttcatggtatcacttatatgatattctttcacttcataatttctttccttcctaggacttagagggtcaccccattcatttaaactcctgcataatccatagtatggatgcatcatagtttatttaataatttccccattgatgaatgttgagcttatgcttagtgggcaagtattcctgtagcatagatatctagaaatggaagagttggggtgaagactatgtagatataaaattttaattgtcctcaaaaatgttgtgccaactgactatattgtcagcagaatatgacagcattcatttccccacaccttttcactgttgggaatttgccagctttttgttgaagttatggatgaataaaagggattccatccaaatttgaatttttctgatcactcatgaatttaattaaatatctttatatgtttattgaacatttgtgtttcttctctgagttctctgtcctttgttcattttcctgttgaattgttttatcgttttcttcctgatttatagaaggaattagttgagacacataaatgattttggaaaaaatgcttacattcaaagtaacatttttcacaacagtttgtgtcacatcattagtttgacttatatagacaagacatacatgagttctaaattaaaaatcaaacacatgcccagctaatttttctattttgagtagagacagagtttcaccatgttggacgggctggtctcgaactcatgatctcaggtgattcatgtgccttggctttccagaatgctgggattacaggcatgagccaccaggccaggccaggactacattttaaaagcaagaaaatcattacaaaagtcagggtagtggttacctattagggttagagagaggaatatgattggaaaggggcacactggggcttctgggatg

SEQ ID NO: 230603 - DNA, 361 bp, Homo sapiens
aatgagttatggctcatttatgattctaccccgcatgtctaacacagagcctgaaacagtatagggactcagttggtttgcttgaatggaattaattgaatcgataggatcaatgcgttaataccaagtagtgattttagtttaattctatgaaggaccaagattcttttcagttcacagaaagagtgtaaaagtattttgaataaatttcaaatgctaaattaaggtttattattaagtgtaaatctatcaaaattttaaaagaatttcatattgaccataaatataaaccttatagattttaagaaattaaagcaatgtaatcaatatttttgacaaaattcattaaaatagcagagat

SEQ ID NO: 230604 - DNA, 433 bp, Homo sapiens
taggagaaagattttcacttcaacaattttttttttttttttttactttcctctttcaaggtgctccatgtctgggcctgaagccaaattctgcagagtgagaggctacagtgtacagtctggggcattctgcattcctttgtagtgatcagctccagtggaacataaggcagaactgtggaaggctttggttagaatggagcttcttcagagtgctttcagagactcactccgaagcatgctttatagaacagtcattccttggtctatcaataggtgttatgttaaaaaaaaaaaaaaaaagcaaaaagttattgactaaaatttgtgaaaaccttggtcaacaaggttaaataggctacctaattactagatttcaccacatctttaatttacctgggtgaattgggaacatacgaggagagaagcagct

SEQ ID NO: 230605 - DNA, 612 bp, Homo sapiens
acggggtggggacttcagacacatgtgcaagcttctgaggatgcccgggtgctggccatgtggcaaggtggaaggcagtgcctatgactggacagctgggagggagcccactgtggtgatggggagggtagactagcaggtctgtttgggtatgctgacttgggggcactcaaggggagctgtcagggaggccattgggtggaagcaattccagagacaaaccgctgctccctaaaggaaaaggagagtgcctttgcctttcaacctgagctccatgtggtcctctggcccagcctgctaggcagcctcgccctgctccccacgtgatgtcacacaggtgtcacaaaatgaacatctgaaaccagagcttcattttcctaaatttcctagcctttctccttacagtgaacgtcaccaacacccacccagtatgctgaaacctggcagtcatcctagccacctcgctttccctcaccgtcacacccagtcccctcaaacatttgtgcctgctgtccctgcgttcgcttcccacccgggtgcttgcctttccacgtctccctgctgtccagcagctggcaagtcattcctgccctgtgcttgcaggctccacgg

SEQ ID NO: 230606 - DNA, 458 bp, Homo sapiens
tacgtcagaagcagggaaacctccattccccattcccctaccctagcccaaagacgagaggtttgctttccagaatagatgaaccagagggcctctgggggagcaccccagggataactggcaaggcgactggggtctggtcctcataccgaatcccccagcaccggggactatatcttggcctcatctgtgtttgggaagcctaaggctagagtccctatatgattaaatgaaacaaacttctcccatgaaacgcaaagaacaaaacaaacaggaaaaacagaaagaggaacctggaagaaaccaaaacagttcagggagaataaaactttaaaatactcagcatttccttctactcagaaagctaagagacctcgtgcatgtgatgagagggtgctttacaaaggaacttgccaaccacaaagaaagctctgggaaatttaagatacaatagcaaa

SEQ ID NO: 230607 - DNA, 431 bp, Homo sapiens
ctggcaggagatgaaaggctgctgccgcccggtcggaaggacatcggcgccccccaggcccggtccccgccccagttcctcgggcctttcctgctgcccctgcctgcgagggccgacgacacggagaacaggatcctgcgcccaacccaggagcagttgggtgaggagcaccagaaattcaatgctccctggcgctgcatccccagagccctcccagcctaagaagccccatctttctgtctccacgcatggagaactgcagctgtgaggcccaggacccttagcaggacatgcagagctgggcagggacccaggctcatgctcccagcgtggggtgagttgtctccagcctgtggagactgccatgaagttgatctgcctcccagagggcctggcccacttgaaataattgctccggctactgatgtggt

SEQ ID NO: 230608 - DNA, 616 bp, Homo sapiens
ctggcaggagatgaaaggctgctgccgcccggtcggaaggacatcggcgccccccaggcccggtccccgccccagttcctcgggcctttcctgctgcccctgcctgcgagggccgacgacacggagaacaggatcctgcgcccaacccaggagcagttgggtgaggagcaccagaaattcaatgctccctggcgctgcatccccagagccctcccagcctaagaagccccatctttctgtctccacgcatggagaactgcagctgtgaggcccaggacccttagcaggacatgcagagctgggcagggacccaggctcatgctcccagcgtgggtggggaacacagagccctgcccagaggcttgaacctggcaccacaggggtctggaattacacagaagacgggtgacagccaaggtggatcatgaacggtgagaagtccagcaggtgacaaggggaagggtctaaagggtggagggcacagcgcaagcaaagtcttggcaacaaaagagctaatgcatcccagaaatggggcaggtggagtactggaagctacaccaagcttcagagtggtcctgtggcctcggtgtggtagctcaggcctataattccaaca

SEQ ID NO: 230609 - DNA, 623 bp, Homo sapiens
ggccggggtcggcgccgcggaggcggggagggagggagggttggagggttgagccagagacccgggaccccgtccccgcacacctgccagtgccccgtagcttcggccgccggcactggcaggagatgaaaggctgctgccgcccggtcggaaggacatcggcgccccccaggcccggtccccgccccagttcctcgggcctttcctgctgcccctgcctgcgagggccgacgacacggagaacaggatcctgcgcccaacccaggtccccgccttctttcagaggcccaggcctggaccccgctgagccgcagatgtgcgagcaggagcgccagagccccgatgcccgcccagcaggaagcgggcgggagatggttccttccttctgtcctgagggggaaccctgcacagagggaccattgagggcctggcattgtctgcctaactcacccagtgcctccctccctgggtgggccatgcggggccttgacaggattgccctggtgccgtcttggcagtgggtctgggtgggatcctgggggcagggcttccctgagtgcagacagctaggcctccacctgccccggcctcccacccaggctcagatttccagggcataaggc

SEQ ID NO: 230610 - DNA, 522 bp, Homo sapiens
ctcatcccactgccttctgctttctgaccttactgaggtcagggtcatcaaggcctgggggactgggacagggttaaggggtgtcctttctccatccgtcttccaaccccgtggagactcagcatgcctaggaaggtggaagggcttcctgcgggcacaccatctcccgcctccctgtgcctgtcctctgctgggtcctgggttctccagtgattatagcccttgctgcttcccccacagtggggaacacagagccctgcccagaggcttgaacctggcaccacaggggtctggaattacacagaagacgggtgacagccaaggtggatcatgaacggtgagaagtccagcaggtgacaaggggaagggtctaaagggtggagggcacagcgcaagcaaagtcttggcaacaaaagagctaatgcatcccagaaatggggcaggtggagtactggaagctacaccaagcttcagagtggtcctgtggcctcggtgtggtagctcaggcctataattccaaca

SEQ ID NO: 230611 - DNA, 1185 bp, Homo sapiens
gaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacacc

SEQ ID NO: 230612 - DNA, 422 bp, Homo sapiens
tctatttttctataaatataatggtaaatatatccttacactcattatggtatctttatttgttctcataaggatgttgtagtgggtataatgtatgtctctctgtatgttggtaataaaaatggtaatagtgagctgggtacggtggctcatgcctgtaatcccagcactttgggaggccgaggcgggtggatcacgaggtcaagagatagagaccatcctggttaacttggtgaaaccctgtctctactaaaaatacaaaaaattagccgggtgtggtggcatgtgcctgtagtcccagctacttgtgaggctgaggtaggaaaatcacttgaacctggatggcggaggttgcagtgagccgagattgcaccactgcactccagcctgggtgacagaacgagactccatcccgaaaaaag

SEQ ID NO: 230613 - DNA, 149 bp, Homo sapiens
actatatactgggacagtgaaaggccttccattgaccagaattacaaagagtgctttcatgctcagggtttagccatacccagtgtacagggcttttgttagggcttgcactagtcctttctctcttacctccttctgtcgtcttctca

SEQ ID NO: 230614 - DNA, 471 bp, Homo sapiens
tcagggagcttacaaactccgcttttgcataatttctctattactctgaatttggatatcatcctctgttatattggtcttttgtatcctgtctgtttatgagttttcccttttcaactaacttttttctaattgtgaaaatagagcatggtcaagagtaggaaatagagaaggatgcataagaactcaggctccgaggttgtgcgtggtggctcacacctgtaatcccagcactttgggatgctgaagcaggtggatcacttgagctcagaagtccaagaccagcctgggcaatgtagggagaccttgtctctacaaaaataaaaaaattagtcaggcatgatggaccactctggaggctgaggtgggaggatcacttgagcctgggaggttcaggttgcagtgagccatgattgtgccactgcactcctctagccttctagcctggaggacagagcaagaccttatctc

SEQ ID NO: 230615 - DNA, 326 bp, Homo sapiens
agcggtgttgaacttcctgcttgtgtattctctctgggcagagatgccacttgcctcccccaccctgccctgcgcccactgcagtgctccccttgcttcagctttgggctcacctcccgctaccctgtccacgttcccttctcaccagcagccaggcctctgccccactcgcttggtcctcaaaggtggactccttactggcattgtttccagacagcctcctatcacccgtgcccaagtggtctttctaagaaatccaaatttttatgtgtttttgagaccgcctctctctctgtcacccaagctggagtgcggtggtgcgatca

SEQ ID NO: 230616 - DNA, 468 bp, Homo sapiens
agcactttgggaggctgaggtgggtgaatcacttgagctcaggagttcgagaccagcttggccaacatggtgacaccccatctctactaaaaatacgaaaattagctgggtgtggtggtgcactcctgtagtcccagctacagctactcaggtggttgaggcaggagaattgcttgaacctgggaggcggaggttgcagtgagaccagatcatgccactgccctccagcctgggcaacagagtgaaaaaagaagaacagaatgtgaaaaggcagatttttttaagtcaaaaagaaattaagacaggaattttgttatctgacaggaatatctgtcaagagaaagtgacagatattcaagatagaagatgatccaagatagagataacaggaatccctgaagacaaaaagcaaaggaagaaaacaatgcattctaaaattataaattaaaaattatttttccctgaagt

SEQ ID NO: 230617 - DNA, 735 bp, Homo sapiens
ggctgaggcaggagaatcacttgaacccgggaggcggaggttgcagtgagctgagatggtgccgctgcactccagcctgggcaacagagcaagactccgtctaaaaaagaaaatctttagataattagaacatttgagtgtggattagatattagatgatataaatggtattttttaggtatgagaatggcacggtaatcatatttaaaagaagggttatcagaggtatatatagaagtatctactgataaaattattagtgtctagatcttgctttcaatgctgcagcaaaaataaacaaaaatgggaagactgataaagtaggtaaaattttgataattgttaaagcaggtgatggatgcatggggttcaatatattatatggagttcattatactcttctatctacttttgtatatatttaaaatgcccataataaaaagacagtggccgggcatggtggctcatgcttgtaatcgcagcactttaagaggccaaggtgggaggatcacttgagcccaggagttcaagaccagcccaggcaacaaagagagaccctgtctctacaaacaaacacaacaaaaattagctgagtgtggtggcacatgcctgtggtcccacctactcaggaggctggggtgaaaggatcgctggagcccaggaggcggaggttacagtgagccgaggccatgccactgcactctagcctgggcaacagaacaagaccctatctca

SEQ ID NO: 230618 - DNA, 416 bp, Homo sapiens
tgatggaaactggcttcgcgcccagaggaaaacccacaactaaggggccaagaaaaagcctccatggtcccgccctttcagtgaggatcctaatttataccccgagtgtggcccccatcaaagtctgcagtgacagccgagcgcggtggctcacgcctgtaatcccggcactttgggagaccatggcgggcggatcacttgaggtcaggagttcgagaccagcttggccaacatggtgaagccttctctactagaaatacaaaaattagccgggtgtggtggtaggcgcctgtagtcccagctactcggaggctgaggcagaaaaatggcttgaacgcgggaggcggagcttgcagggagccgagatcgcgccactgcactccagcctgggcgacagagactccatctcacacaca

SEQ ID NO: 230619 - DNA, 332 bp, Homo sapiens
atttgtgtttattgccactaatgatgttgtgatgaagcgtctcatttatctgtagaaaacctaggctggaatttaggtttttaaactattttctatagaaaccttgaagcacttgaagtttcaatattcttactgtatctcttcatagaaacatatttattaaagaacaatattttaaaccttttcctgttttagattttgttatactttcattttgtctatgtgatttggcaaacaaagtaacttttatacaatttgaaaatgatatccaatttgtggagatttggagaaaatacaacctaaagcaatttaataaagatcatatatgactt

SEQ ID NO: 230620 - DNA, 440 bp, Homo sapiens
tatcagtgaggacgaccagaggtcactcttgtcgccattttggttttggtgggttttagccgacttctttactgcgacctgttttatcagcaaggtctttatgacctgtatcttgtgcccacatcctatctcatcctgtaagttagaatgccttaaccttctgggaatgcagcccagtaggtctcactcagccttgttttacctggccccattcaagatggagttgctctggttcacatgcctcggacaaaatcactgtacttgggatatccatcacgttaaagatttgtcttttctctatgctagaccactggaattctagatattttgaaatatacaagaggttattgtaaaatatagttagtttaccaatctaacactaggtcttcttatatcaaatggtatatttgtaaccattaatcaacttctcttccccccta

SEQ ID NO: 230621 - DNA, 469 bp, Homo sapiens
aagtggagacaacttatctccgagggctacgcggggcaagataaataggtacaaaaatacataaatatgtacctggcccacagttaaaacgcttaaaacactccagctctgtcgtcttctcttagattctagaaatgccacaactttctcttatttctagatgctctgtaggttcagggccgtagaggctgtccacgggcctcacaggaacgcaccaaaaccaggacatcgcaagcacaggcgcacagacccagaccccggccccggcccggcccggctgcagggccgggctccccacatcgacaaggacaccggagctgccccgagacgccaagagggctgcgaagagctgcctttgtactcagagccagacgcggcctacgggacgggaccgccacgtctggggcttgcgggctgcagggcggcgcggcacgcgtgggtacaccctgcgggggcgggctgcggccgc

SEQ ID NO: 230622 - DNA, 461 bp, Homo sapiens
tatacaagaagcattcaatgtggaagtcggacctatatattttaatgtaacagcatgtgaaatagttattgatagtttcatgttccacattacaaataacctttaagaagctaacacttctatcattttagtgtagtatcaaggatgaacatccagttttctaaaaatgttattaaaaacattcctggcctagcgaggtgacttatacctgtaatcccagcattttgggaggccaaggcaggagaatcatttgagcctaggagttccacccaggagttcgaatgagacccccatctctacaaaaaataaacaaaattagctgcggtggtgtttcgtgcctgtggtcacagctgctcatgaggctgaattgggaggatcacttgagcccaggaattcgaggctgccgtgtgctatgatcacaccactacactcaagcctgggtgatagcatgagaccaaaag

SEQ ID NO: 230623 - DNA, 349 bp, Homo sapiens
cactgcactccagcctgagtgacagaaagagactctgtctcaaataaataaataaataaatacataaataaataaaaggaagtaaaaaccttatcaccatatagattccccttttctataatagttatcttatatattactcctctatacattgaaaagaaaccactaacagatgatgctgtaatttttgcttacaaccctgagatatattgcaaagaattcaagaagtggccgggcgtggtggctcatgcctgtaatcccaacactttgggaggacgaggtgggtggatcacttgaggccaggagtttgagaccagcgtggccaaaatggtgaaaccccatctctacc

SEQ ID NO: 230624 - DNA, 313 bp, Homo sapiens
gaggaaatataatctatactatagactatagatctaatctactataataatttataatttaatatatataatttaatcttatctaagattaaattagaaacccagaggactgttctaggaaaaaaatatttcagctactacttaccactaaagacctttgctttctttctacatcttgagcagatggtttcccagtccttgaactagatatatttttaagccaatagttgtcattaaaatgcagaaaatgtatatgtttccaagaaaatgacccattgcaattaataaccatatgtctgttatttatttcagg

SEQ ID NO: 230625 - DNA, 574 bp, Homo sapiens
cccataggcatcagtaacaagtgtggactgagctgactgcagcctcggtggacagagaagacttgtcctccagcagtgttacaggctgaccacctgctggcaccctgatgttgacattagtgatgctggaattcagataagggagagagctgctagcaggattccacagagaggcaggacttaaaggataagaaggattagatggtgccgggaaggggaggagcagggaagccagggtcaggtgtgaggaaaggggaaggtgctagaaagaggagtttggacttaatactgtagcctaggaaggtggcccatgccttggctgttccacacgtctcttagattctatgggagcaaaggagaagccactgtgtttaccccagacttgccttcttcccaccctccccgctcatcttggtgtactcatcaccatgtgctcaatctgcgaaactggaaatggcattgtcatcctcaggcccccactttttgtcacctgctgtgatccagcagtcactgagttgggaggcctcctcgtttgtttaatcgtattctactattaaattttctgccccttgta

SEQ ID NO: 230626 - DNA, 355 bp, Homo sapiens
cagattgattggggacaaacgggaactcagccctctcaaccaatcatccaaggcagtcagctgtaactaggtgtacacttaaacagccggcatgtgaaatagcacacttgtgctctgctgattaaaaaaaaaatccaaatcattattccccaccttcacaggcttggaggcctaggagcaggtggggtggggtgggtggcagatgaggctgcctcagtagccctaaccatttcatcattaatatccacccacccactatgcattgtccacagtaaaatgtgctttgtcttccacactgtattggtgaacaaataaatcactcagttccttggttttagtaaaacaataagagcaa

SEQ ID NO: 230627 - DNA, 179 bp, Homo sapiens
  misc_feature (107)..(107): n is a, c, g, or t
  misc_feature (115)..(115): n is a, c, g, or t
tacccagtgttaacatatccagctgtctcacaattgccccctttttttttttaagaacttgtttgtttgaataaggattaaaataaagtccacacagtagagttganttgatttngtctcctcaaggcttgggctaaagtttcccctgcatctctctttttatttgttgaagaaactgt

SEQ ID NO: 230628 - DNA, 491 bp, Homo sapiens
acttacattaccactcctttgtttgcctataacaacaatatgactatttttcccttttttacaatgtctactaggaagcttagatccaaatatgaggcttaattgtagtaatgttgatgaattgcatgtttaatctttcttagtcttggtatcttactcacttatttgtattttgcccaggcttgatttttaattctatccttgaattttcattttatcatttgttttaatgcctccttcaagtcacacagtcagatcctttgtggaagacgatgaatgggtgaataagtatttaaagcatgtgttcatagcgtcatcaattttacaacagggtggattaaacatacgataattatgaattaaaagtgacctatgcttctggttgtttccacaagtcatcaagtccccaaaaatcaagtgataaatatatattttttgagagtcaatattgtgaattattatctggaataaacatctttaagagtgaaaaa

SEQ ID NO: 230629 - DNA, 509 bp, Homo sapiens
gaggccccagggaccctcacagggtaccaagaggccagctccaaatctcctggctcgttctttccaccctcacactcaagggaacaagaagactttcccagagaggaaggaagtgcttaggtgtcccagggccaaagaagatgcctaggagggcagcagtagcccagctgaccccatggagagcctgctcccccacccctgccccctgcgctgcatatattttctccccctaaaatagcatctctggagggaggagtgggggagttctcagttcactgttctctccttcccacagtgcgttcacagctctctcactgtctctcacgacctggtttccctgccaggcccttctgctctgcctccacctcgccctgccaggtgccaggacctcttggccagagagggggcctgctctccatggcccatcatttcccacttccaagccgtgactgtcacaccattccctcccctctttgggacagaagtaaattcaatccacacagtttgag

SEQ ID NO: 230630 - DNA, 452 bp, Homo sapiens
gctagtttataaaattagattttgtatttatggacttactcatctactatgttacagtagtctttgttttgtgaaactccaaggaaatattttctacacatttcaggttaagaaagaaaaacatgcgtttattttgtcttaaacatgaaataatgttttaagcattctaaaaagtacttacaaatggattaaacacattggcgttctttatagttttactctggttcttttttttgtgacttgttattcatagtctttgcaatgccgccctctagtgatcgatttccaaaaatgcattaattaacttgtaagcctgttacagtctttctcttttgactctactgatcctttgccacagcctttgtttggtgttctcttttattgctcttccattagttattcttattctcctttaatggcattagggaaagatcagaagtttcaggagcaaa

SEQ ID NO: 230631 - DNA, 418 bp, Homo sapiens
gttaaccaggatggccttgatctcctgatctcatgatccgcccagctcggcctcccaaagtgctgggattacaggtgtgagccgccacgcctggccattccttgtgttaattttaccatactaaaaataattaagattatatctataactataggttgcatcctgttaatttttccaaaaaatgactgaacctgaaattgttttggggacacttccaaactagtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcag

SEQ ID NO: 230632 - DNA, 326 bp, Homo sapiens
aacttcttccattagaaaggactcctcaggacacctgggagcatgggctcttacacagggggtcctggtcataccactgagggagctctgggctagacttggatggtgaacactgtgtaaccctggcattgtcactgtatctctttgcccctcagttttctcttctcggaaatgagaaaacatatccaacaaaattttgaggattaaaaaccagaggatgtgtagggacacagtgacaaatatgaagtctaaggtcttactgttattatatcacttatggttaacagtaaagatttctgagtcagaccgttcaagttcaaatcttg

SEQ ID NO: 230633 - DNA, 183 bp, Homo sapiens
tggtcgttagtgagggacaacattcaaaagcaggccctgggtaggtaagaactccgcatggacagacgaggtgtgtctgtatggggctgtgtgggcaggactgcttatgcagtctgcagaagggcagtcctagcaggtggaaagcaagagcaaggccagcggctcatcccggtttgtctggag

SEQ ID NO: 230634 - DNA, 455 bp, Homo sapiens
cagtgcatagctttgcttcaaagcaaaaggaaaatcacgtttgaagaagcagcctgaaaaaaatgtcacataaactagtaagaatttatccagaaattccattgagcaagaccttcaatgtaggatgccaggtcttcaggccaagtctgtgtcagtacataaataaattatcacaccagttctgttccatgcgtgagagacggaagatcatacaggcagagatttttagaaagcgtggcgccctttgatatactttgaaattcaaatataaaatattgatagaatggaaaggttggacttgcatgcagaaatgactaatttgaaaaaaaaactgcaggttgaaaatgcatacttaggactgagtttgtgataattaacagaaaaaaaaaagccttcccagtgacagctctaattaatagtatctgtaattaaaatcatgcccttccagcaggaaa

SEQ ID NO: 230635 - DNA, 426 bp, Homo sapiens
cggaagaccggcaggaatgacagaagcagcagcgagagcccttcagaggaccgcgaaacgcgaactcccgccccctcaaacccaggacattcagtgtaaatgactgtgagcctcaggctggaaagatcgtttcccttcccagctagaaagactcatccatcaggctgtgtcagacgcacctgagccctccagggtggtcaaagaatctgcatcacagaagatatccagttgggcaagaccccgcctccctgacaggtggcacaggagggtggttggagcaggagggtgggaagtgatacgtggatcttggaagaacagcctggctctaccactcgccgtgtgtctgtgggtatgtgagtccccactctgtgctgtggcctcctcatgcagagaaaggagctgataaaagtcaccgagttaaactta

SEQ ID NO: 230636 - DNA, 406 bp, Homo sapiens
gtaacgaagcttgtgtcccaagtgcagcatttagggcttcccaaggcaaagtgcccaatcaggctctctactctccaagttcgtggtgcatggtagccacagctcacctctcccaatacacaggatctccaagggccaccctgccatccctcaagttcctcagcccatgttttccctccttccttcagtttgacaataggggtggagcaaccactttgcaggatgtctctgcttaggggctatggagaagcatgggacctgaactctgcactctttgggaagaaggatcagataggattcaaatctgtttcaccaaccactaggctccaggcttgagcctaacaagcagttgctcaaaataacttggtagatgtgtgtaacccagatagataccctaaccccacgt

SEQ ID NO: 230637 - DNA, 372 bp, Homo sapiens
ctgaagactctacttgcaagacttttactttacttgacttggagcttgctcaattcaaaaagccttttctctaagggtgtttgttgaaagtaatgagaggcatttgactagctttgcagctgtctgaggtggcggataacagttggggcaaatgatacgccaaccaaaaagcaacaacaacaagctacaagatatatttacattgaacagaatgaaaatagaaaatggtcctggtgttacttcacattttggggtctcagtttctttacacataaattgcctgtcttttgggctctgccagagttaacacttctcagccttgtcagagtggtcacctttctggctgtaatcatttataagaaataaaggctc

SEQ ID NO: 230638 - DNA, 527 bp, Homo sapiens
gaacactgatgtacagattatgtttgcatttctgctttcagttcttttgggtgtatcttagaagtggaattgctgggtcataaaataattctgtgtttaatattttgaggaactgcctgactgtcttcaacagtagctatactatttttgtttccaccatcaatgtgtaagggttccattttcttcatgtccttgccaacactgtcttttttaataatagtcatcctaatgggtataaagtggtatcttcttatgcatctcactaatgaaaacatttttttcatattttgcattagtttacatttgaaagtattgctttaaatttgtgaactatatatgagcaatgtagagaaatatttcgctttaagcaatggttgactggccaggtacaatgactcacacctgtaattccagcactttgggatgccgagttgagaggatcacttgaagccgggaatttgaggctgcagtgagctatgatcatgccggtgtacttcagtctgggcaacagagagagaccctgtctc

SEQ ID NO: 230639 - DNA, 175 bp, Homo sapiens
agatgctcagaatgaataaattagcaggactttgaaaaacacacagatgcatggcaaaccaggtagtgcataaaattaataatcatagaaagcaatgtgctatcattcactgaaggtgctaggcactttgaaacactcattttctcaatacctaacttggaaaaaaagtccccat

SEQ ID NO: 230640 - DNA, 542 bp, Homo sapiens
taaaagtcatggtcttaccctcactttaagactgtttattacagtccctgtaatgtactctggttattttccaattcatgcaatacctgactttatattctaggcatctgtaagtgcaccaatagtggcagttagggactgaaaacagtgtctaatggtgatgttcagacaaaatatttatttgtgaaggtggctattttagtgggaatgttgtgacaattctccccggatctctatatgtctgaaatcgagtttttctgagcaaagataattacagacaaattaggaaagtttgtatattgagacattcgctgagagtaaagtttagaaatatctcactgttttgagctgttctagagcaataaagataaacgtatctctatccaattcctggagaaaatatgcttacattccagagtaaagatatagtctccctgtcttttttctccctagaaagaggtgtgtgactgggccaccagcagccctacataagggcgaagcttcttaattgcattgcgcccctctgcatatttggatactac

SEQ ID NO: 230641 - DNA, 440 bp, Homo sapiens
ttccagtagccttagttgataaatatggttttgaataagattgcagtcatttaccttaatgaacatagtaatagttattattttgttgaatgttatgaaaagctcttaaatacctgagttaaaaccaatttgccattatttttatttttaaagaaaaattgttggccgtgtgggtggctcattcctgtaatcccagtgctttaggaggccgaggcaagaggatcacttgaacccatgagttagagaccagtgtgagtaacatagtaagacctggtctctacaaaaaaaaaataaaaataaaaattagtcaggggtagtggcacacatctgtagtcctagttgcctgggaggtttaggtgggaggattgcttgagcccagcagtttgaggctgcagtgagttatgatcgtgctgctgtgacagaatgagtccctgtctctg

SEQ ID NO: 230642 - DNA, 414 bp, Homo sapiens
aacaaatttctcgtttcctcctgtagttttctggttcctatgaacagaagcagaattttttcacaacagaaagtgaagcaacgaagttttgagggttgctcctcatttaatgatgtgggatcttgttatgttacccaggctggagagcagtggctattcacaggtgtgatcggcacactatgacctggaactcctggcctcaagtgaccctcctgcctcagcctctcaagcagctgggactacaggctcctgacaccatatccagctgaacctgattttatattccagtggctgacaaactatttaactcctctgaactacagattctacccacctaatttttgccagtttgtatgcaaaagaacaacttatcactttttattttcaagccacttccctccagccatgtacatt

SEQ ID NO: 230643 - DNA, 461 bp, Homo sapiens
ccaggaactatttacagtaaaaagctttgattcactttgggaagcgggaagaggagttggagccacccagcgggagcagtagtaagagatgtgccattggagaaccagcttctgtcagaaccaccagactctgaagtacagaggagtggagggggtcagaccctggacttacctcctctagctcggatcttctactggtgcctcctgttagaggaactcaacaagaagccagagggcagggaatggaccatactgttcccgggcacagagaggggagagaaaggtggagaactgatctagaggctaggtctagggaggagatgaagtgacaataaccagaatttgttttaaagtagaatgcagaagagatagcctggctagttaactgtgcctggattaaaacttgtgctctgtttattaatttatagctactatgttattaggggcccattgcttacttt

SEQ ID NO: 230644 - DNA, 688 bp, Homo sapiens
aatttccatttgtaacaattttaatgggcaaatatctgagaacagtttttatatgggattatccataaaatgactttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaaa

SEQ ID NO: 230645 - DNA, 476 bp, Homo sapiens
tccccagatatcagccatctctccctctgcgaccagccaacatggagaggagagaggacgagaagctgtttctctggaccacctgcctcagggcacgtcggggacacctgggcaccagtagatctcagtgaactgctcggagaggatttgaacggggagaatgaaacacaggcttcagccccaaactcatacacacgaggagcagaagcaatgcctctcgcctagatgagctctcatattcctaaaagctgtgtgtgaggaagagctgctcctccccaaaaccccctgcacgcctgcttcctatcctcaggcctggccgcccctgggtgagaaaagctcttcttagaggacagaaggtgttccagggcggaaggtgtgtgcgaagttctccccagtctcaagacggctggtccgggcagctttaagctacttcacggcacgactgtacaagcttggaaactgaaattcatgctcag

SEQ ID NO: 230646 - DNA, 475 bp, Homo sapiens
agataaacttacaatttttttctatacacttaaaatatttatgatgcaaaatacacacttcaaaagattcatagttgtgaaataattcacattggaatgtaactttgatattatcaatacaaatttatgggaagtaattggaataataatttaaaaattagatgattatctatctaaatgtaatgttttggctgggcatggtgactcatggctgtaatcccagcacttttggaggccaagttgggtggatcacctgaggtcgggagttccagaccagcctggccaacatggtgaaaccccatccctattaaaaatacaaaaatcagccaggcaaggtggcagacgcctataatcccagctactcggaaggctgaggcacaagaatcacttgaacccaggaagcagaggaagctgtgagctaagatcataccactttactctagccggaagacagagtgagactctgtctcaaaga

SEQ ID NO: 230647 - DNA, 438 bp, Homo sapiens
tgatctcaaactcctgggctcaagcaatctacaagcctcggccttccaaaatgctgggattacaggggtcagccacagagcccagcctccccagggcctttgcactggctcctccctctgcaaggagccacttcccccgatattgtagataccatcccccaggtgtcggctggaatgtgtgtctcattcatgcctctgactgtcccttctaaagctgcagccccatctctcttccctgtcttcactcttctttgccttgtagtcaccattcgtcatactctgtatgaaatggatttatctacgtgttaaaatagatcagtgttactgtccttccgcctatgagaatgtcctccacgggtaagaaggaactgggggtgggggcattgggaggggctgtctctcttctcactgctctagccccgcctccagacagcgccg

SEQ ID NO: 230648 - DNA, 256 bp, Homo sapiens
tgatctcaaactcctgggctcaagcaatctacaagcctcggccttccaaaatgctgggattacaggggtcagccacagagcccagcctccccagggcctttgcactggctcctccctctgcaaggagccacttcccccgatattgtagataccatcccccaggtgtcggctggaatgtgtgtctcattcatgcctctgactgtccggtgtgtcgtcttctttactgccgtacaagtagtagtaggcggccgctgta

SEQ ID NO: 230649 - DNA, 467 bp, Homo sapiens
tcttgtgaattaggttaatgttttgcttgtttatcagcactggcatgcagagttggagacatgagtagatgtttgggaggaatcagaggtcaagggaggcagaaggaagggaaacaccatgacagtccctcttggccccttttcctgttgacaggtctggcctgaaagccatccagtgtaacgagagccttcttactgagctctggtaatttatccatgcacccagccttgaagaggaatatggctcactttgtaatcttcttaattgctctcctctcattatgccacattgaattggcactaaatgactttttctgccattttccgatttggatccaaagaacatagaaatactgtggattgtatcttaaagtccctgtccaaagtggccttgcctagatgaaatctaaaatggacagtcaagtgacattggcagagctgggggcttccctccatggccacttctc

SEQ ID NO: 230650 - DNA, 226 bp, Homo sapiens
ccctttgccactctttctgaactgccagcttccttctcacagctggatctttttggctcttttactttcaccattgttcttttctttcactagaaactccctctgctaccactgttcacccctgtgcaaagaatttccaaacctagttcctatcttctgtctatagccttcttgtgtatcttatctctgtatctctcaggtcaataaaacatctgagaaataaatg

SEQ ID NO: 230651 - DNA, 439 bp, Homo sapiens
aacttgcctctcataatcctcaatacctctcataatccacagtacctctgtgagtaaccaacctgccagtacacagcccatctcctgttttaccctccccctgcacacatggttgtcactcagatgaggtcttcctctctccctccacctcagccaggcctaggctgagcaaggccttctcccaaccctctggattttcattttaatacatttcttttctagtggtaagagtgaaacaaatgaccagcatggagaagccccgtctctactaaaaatacagaattagccgggcatgatggcgcatgtctgtagtcccagctgcttgggaggctgaggcaggagaatggtgtgaacctggcaggcagagcttgcagtaagctgagatcgggccacagcactccagcctgggcgacagagcgaggctctatctcaagaaaaa

SEQ ID NO: 230652 - DNA, 331 bp, Homo sapiens
tttttttttttccagtatggcccagggaagccaaaagattggacatccccgatttatgtgatggataaatgtattcactgtaaaattcttttcactttgctttatgcttgaaagcttttataacaagatgtttggggaggaggagagaactgggacagagagtatagacaactgttccagaaagttttgatttaaaggggaacagagagatgaggcagtagagtcaaaagaagtctgctttcaccccactcccagagatgagagaaatgacagcatttttatttgttgattagaaaaatccagtagagattttaattaaaattgatgatgc

SEQ ID NO: 230653 - DNA, 595 bp, Homo sapiens
attctgaaggaggggcttcagggcgcatgcccgggcagctgcgcgagtgaggggtggaaagaggtggctttttactccggggaacggtggcgagtgggggcttttgcctctcaaaatacgagcccctcacaactacccatgcacctgccaaacccggcaattaagcttcttacacatccagccccgacaggggtctacactacagataatgcccgggttcaaattccgactccggattccccactcactggatgcgtgaccttggaaaaatgatcaacctcttcaagctacacaaagttaaatggggatcgtcttgcctacctcttgacaggatactttaagtaggatcgtatctataagaacacaataccacactcaagcaatgctggacagttggacttaattgtggttaaaggcgggagtgaggtgggagtgcgataccaacggaatcacatcccgggctccattccctaagcagctgtgtgacctgcggcaagtgttttaatcccttctggtctgtttctcctttaaaatgagagaaaatagcgcctagtttacaggattgtttttaaggattaaataaattcaaaaaatc

SEQ ID NO: 230654 - DNA, 246 bp, Homo sapiens
taatcagacgtctaccaaatacccaacactgaataactagcttccccagcgctcttgcaagtgaaaagggcgttctgtgaaaacagcggctatttcagctcgcagcaccgagcgctccccgtgtgctttccctgagccagctgtcattctgcagcagagacccagagaatgtcaagaacacaagcactcaagaatggaaataactcaaacgtccttcagctcgagagcggttaaactggcacatct

SEQ ID NO: 230655 - DNA, 394 bp, Homo sapiens
aaggaccaggaagtgggggttggcctgggccaagggtggggcacccgggagagatgccactgttagagatctgagctgacctgagctgcgccaggccctacttgccccttagtggctggggctggtccttcccttaccaccaggcttcaggactggcagcagctatggcctctcccgtgtcctgagggtagcgaggaatcgggcctgggctagtcctggctctgctgtggagtcaccaagtgccagcctgtgcccctctggggcctgattttctcatccagacagtaggggtttgaacttccctctcagagctcccatggggttgtgaagggtccacggaggggtgagatctagagggttggcagtaggggtctgatgttgctgatctccgtgg

SEQ ID NO: 230656 - DNA, 437 bp, Homo sapiens
aacagatgaatggataaagaaaatatagcatatatacataatgaaatactattcagtttttaaaaagaaataccgtcatttgtgacaacatggatgaacctaggtgatattatgcaaagtgaagtgaaacaaggcacaaaaggacagataccatataatctcacttatatgtagaatctaaaaaagttgaactcatggaagcagagagtagaatggtagataccagaggctggaggagatgtgattggggagatgttggtcacagaatgcaaaggttagttagacaggagaaataagttcaagagatctattgtgcaacatgatgactatagataattaacaacctacagttggccctttgtatctatggattcaaccaaccacaaatagaaaatatttgaaaaaaaaaaccacaataaaaaataacaattcagcaa

SEQ ID NO: 230657 - DNA, 263 bp, Homo sapiens
agggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccg

SEQ ID NO: 230658 - DNA, 321 bp, Homo sapiens
tagccgttctaataggtgtgtagaagtatcttgttttaattttcagtgctttaatggcatataatattgagcatgttttcataggcttattttcctattttagatcttatttgctatttgcatatcttctttggtgaatttgccatctatacagctattttgtccattttaaagttgggttggttgtttacttattgtgagtttgaagagttttttgtatattttggatacatgtcatttatcagatatgtattctgcaaatagttccatccagtctgtggctgtgttcgttttaaacaaataaagcttaataacatgtgt

SEQ ID NO: 230659 - DNA, 348 bp, Homo sapiens
atagggttggcaaaaacaaaaagatcgttgatttgtatagaaaacaggaaatcactcaccatgatataagccaggtaaaaaaggaaccaggatgtgtgaaagataaaatctagagaacattgagctaaagaataaaatgtcatcagtcaaaaccaaccctaacgcgatattattttaaagccacgaggctcctactccccatatttgtacttctgatattcaagattaaattgccgtgttattagagggtagggatggtttactgcctctagagcccctagtgagatggaggagaaacagaatagaccagacgagatcacatgagcagggtaacgaaggatgtgggga

SEQ ID NO: 230660 - DNA, 410 bp, Homo sapiens
ctcacataaaaggtgtgttttaaaacactagtttgtgatttagttgtcattgccctcaatttcatttctaatgatacctacactggcccataagatcatgaatataaaaatattttaatactagtagtgtcggctgggcatggtggctcatgcctgtaatcccagcactttgggaggccaaggtgggcgaatcacgaggtcaggagttcgagaccagcctggccaacatggtgaaacccgtctctactaaaaatacaaaaattagcctgacttggtggcaggcgcctgtaatcccagctacttgggaggctgaggcaggagaatcgcttgaaactagaaggcagaggttgtagcaagctgagattgtgccactgcactccagcatgggcaaaagagcaaactccatctca

SEQ ID NO: 230661 - DNA, 475 bp, Homo sapiens
tcttaactctactgtgacttttgcttcctgcaatgaggtccctccctctcatgctgaagttacctagtctgctttctatcactgcagctgatttagagggaagtctgaaagtcttttctcttggccaggctggaagcaaagttaaaatggagaggacttcatttctttctgctgaaggtaccaatggtgagcgaatgaggctggtgaaaatatcccatgtcttcctgggggactgtgggaggtcatctgtagagggggtaccctaacaatgccaaccatcttgatcccaagctggagtccagagaagaggaaggcaaggcaggaatcataacccaagggtgtttagtggtgccagttaaagttaaatgtcccaggtcagagacaatataaatccaggccacactcatggaagtggtatcaaccttttgaagggaaggtcaaacatttggtcttctaaaaggattttgaaattaga

SEQ ID NO: 230662 - DNA, 464 bp, Homo sapiens
ccatttcttacttaccagactggcaaaagttcaaaagcttgaacctatactggcaaagctgtaggaaacaggctgtctctctaatacatgactggtagaaatacaaactgcttcaaatctatggagggaaatttgacaatatttaataaaagttatctctgcatttacccttaaccaagtaattatgcttttagaacttatcctgaagatacatcaccaatgatacaaaaatacatatgtacaaggttatttgttgcctcattattgggaattacaaaatattggcagctacttaaatgtacaagcataggaaattagttgaatatgatataatacatacaatgaatactatatgctgtaaaaaagaacggcgaagatctctgtaaactgatatgaagtaaattccaaaagatattaagtgaaaaaagcaaagtgcaaatgagagtatgtgacattttgtgtaa

SEQ ID NO: 230663 - DNA, 487 bp, Homo sapiens
caagcgaataactgtgactatttagacagcattttattttgtatttctttgtattgtttatataaatttttcactacttcaatgcattgataatataataaaattttattagtaaaaaccattgatatcctagatgatttggttggcaagatatcttacttaatttaatttactctgaactcccaatattcaggtaagaagctacgtgggtacaggaattctctgtgccttgctcacttctctaatctctgcctccaggccaggttaacccctatacccattataaaatctctgcaaatagttctgtagtgagttaatgaatgtcagaaatcaccttaatataataggtggtatatagtagttgtgctaaaatatgttaaagctttgttttgttaaatagtctatgtgaaccagtaagaattaatagcattgaataataacatttgaaaactgttcagagatagcaatgtgagcgatggctgataaa

SEQ ID NO: 230664 - DNA, 492 bp, Homo sapiens
taagtcaatcacacctgaggataaatctacccttcaatgtcccagcttgctgagcctctatatcctatttacctaagcaggtttaagtagggttttgtcatatgcaactagaaaatttcttccaggcataagccaccacacccggcctactggaagaattttttaggaagggataaagctaagtaactcaactggttaatttacatagactgttatattaaaatagcagatatgagttgtaataattaaaacacttggtagaggcaaatcaatagaccaatgaaacagaccagaaagcccagaggttaaatagaatgtagaggagtttagcctataataaaataggatttcaaattggtaggaaaaatgatagattttcaaaaactggtgctaggataactaggttgatgtttgtgaaaagaaaaattagcatagatccctcttccacaccttactttaaaataagttccagatggataaaggatataaaca

SEQ ID NO: 230665 - DNA, 227 bp, Homo sapiens
aattcgcggccgcgtcgacggctgcacagcaggaggttggggagccctgccacagcagacactaaaaatagaaacttttcttcatatatatgtatatatctctattattggctctggctcatattcttatgtatttatttattttagacacagggtctcactgttgtccgggctggagtgcagtggtgtgatcatggctcactgcaatcttgagctcctgggctcaa

SEQ ID NO: 230666 - DNA, 376 bp, Homo sapiens
tgagcttctgtctgttgtgacaggtaaaattacctatgaaatttgaaaatgatagctctaaaccaggaaaattggctacctcattcccctggcagtttctggccatgctgactaaagtgaagagagaaaaaacagagtctggatgatgtctctgtttttgtttttttttttcttgcctccaggtgggaagaggcccaaaagttcccaaaggtgagttttgggtggaccaaaaatgttaaaagtttgtatgctctctcctctaaataggaaaaaataatagcaagatcagagcccagggctggagcaaagctttagataaactaggggagaaacaggagtggggagagtgaaccactccagctgtttcttcagacta

SEQ ID NO: 230667 - DNA, 799 bp, Homo sapiens
ctcttcaaaggggatgtaaatacgttgatgctgagcaatctctaccactagcagcagagaataaacgctaatcatgttttaagttatagaataaaagctgccacggtgacacctgcttttatatcttaaactttaatatcaacttttcagtaacctccaaaatctgcacttttataagataatataaaataatagaaaaatgtgttcatggccagggaaagtggctcacgcctataatcccagcactttgggaggccaaggctggaggattgcttgaagccaagagttcaaaaccaacctgggtaacatagatcccacatctctattaaaaaagaaaagaaaatgtattcaccccaaccccatagatatactttgcaatcctgtgatttcaagtacccacagcatgcccatgagtaagtggatgtgctttccccaatttgagacttacaaaatagagaaggaaatatctaaagctcatctgtagcatcggcctgggatcagcagctttagaggtgggaactgcccttccagctcttactgtttcttggtgcttcattcctagccccactcacctttccctgtaggaacttggaaaagctgggcaagtcccgtggcaccagcctgcacaggagaggaagattgaaagaactggtttgctggtaatttttttaccataaaataccaaatgcacctgggaaaggtcatttatcatcacttttcctattttcttatgctctttggctctccaaacatgactgaaaacctaaaagggaactgaacatttttatttccctgaaga

SEQ ID NO: 230668 - DNA, 441 bp, Homo sapiens
agtggagaggcatctggttaggaccctgtgtaacaccctccagaggcctcctgttgaataccttccttggcctgtagagctctctccgagtttctccagcccctttagtgtgatgctgccaacctcagggcctttgcacgtgctgttccctctgccgaatcactctcacccctgctcttcacaaggctggctcccctacctccagccttcagccaaatgtcacctcccgtgagagtccttccctgaccatcctaggtaaagaatctccctcaaccttacttttctaccatcttgtttatttcctgcataatgtttttcacaattgtttcttgggttcccctgttttgctaaaacacatgctggtcttatttaattacacttgaatctccagagccgggtgcacagtaggagctcaacgaatgcttattgaatgaataaatg

SEQ ID NO: 230669 - DNA, 506 bp, Homo sapiens
accctacccagctcccatacaggatttaatttcttagtttagtcctctagtgtctatagcaatttgtatacctgtttgtatcacttatgtacacacatatctccccagttacactgtgatttccttcagggttagaagctttattttattcatcctgattcctcagtcccaacatagtacctgatacataaaaggtgcttaataaatgcaagtatgaagtatgtaacaggccgggcacagtggttcacacctgtaatctttgcactttgggaggccgaggtgggtggatcctgaggtcaagagtttgagaccaacctggacaacatgatgaaacccatctctactaaaaatacaaaaaattagccacgcgtgatggcgggcaactgtaatcccagctacttaggaggctgaggcagagaattgcttgaacccaagaggcagaggttgcaatgagctgagatcgcaccactgcacccagcttgggcaacgagtgaaactctgtctca

SEQ ID NO: 230670 - DNA, 334 bp, Homo sapiens
tgtggagttctttgcggtaatatggggcaaatgggcaagggagatagggcatattcttactttacatgatcaattatggagtctaaacagggtagggaggaaagtaagacaagaggtatactgaggagagggaaggaccaagggatttgcgatttgtggtcaaaaatcaaagtatcctgagtgaagcactgaaacactgaaaccagatgagcttgtggttagagtttaggaatttttttttttttgagacggagtttcactcttgttgcagtgagctgagattgtgccactgcactccaacctgggcaacagagtgagattccacctcaaaaaa

SEQ ID NO: 230671 - DNA, 362 bp, Homo sapiens
gagagaaggctttactagcatgctgttctggtctctgccctatttttctggatatttctgtgtgcaagccactgtcccatttggccctttatgttgtggtcctttggcagatgaaaaagaaagtgaacaagcaggtaaattccagctcaagaagtctactgcacaatccagaagttgagctgaatgattaagaggtaaactgatgtcagctgactccaactcagattcggctaagacccaaaggaaatctgtctgccttgactctgtattttcactaacagagtccacgtgtttttccttccacccggagcgtgttgcatttaaagctaacattaaaatcacacatcttgaagagaatagga

SEQ ID NO: 230672 - DNA, 628 bp, Homo sapiens
  misc_feature (628)..(628): n is a, c, g, or t
ccctcccttccttccttccttcctcccttcctccttccttccctccctccattctttcctttcttcctttcttcttttctttttctttgtctctcatgctctctctttttctttcctttttgttctacttttttaaatagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttctgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaagtaatagatgttattttttaggttctaggtttacagaacagtttccccttagtatgttgctn

SEQ ID NO: 230673 - DNA, 574 bp, Homo sapiens
  misc_feature (574)..(574): n is a, c, g, or t
ccctcccttccttccttccttcctcccttcctccttccttccctccctccattctttcctttcttcctttcttcttttctttttctttgtctctcatgctctctctttttctttcctttttgttctacttttttaaatagaccacactgcactgaaatctacattacttacctaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttctgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaagtaatagatgttattttttaggttctaggtttacagaacagtttccccttagtatgttgctn

SEQ ID NO: 230674 - DNA, 611 bp, Homo sapiens
gagggacagggtgaggatgagctgaggaagccaggtacaggcaggagtgaaatggagagattaagaacgagacaggttcatgtctcacctggagctgagttctgcagaaatggccttggaggaggagacaggagctttcacccctgctgggtgctcagctggaggcaggaaagccgattccatagctcagtgggaggtctcctctgattacactgtttgactttctgtcttgctttcttcttgtctttctttttcctaacaatcagtagtagaattatagcgttctcagctcccacacagtggcacacccctgagaaggttgagtcacgacctgtcatccgctgatcctagttaatgcatggtccccgcacagccaggctcaccttctgagcagcctccatcctgagccagtctgcagacccctcacctcccagtccctccagcatcagaggccagaaagtactctttctattaaaatgaaaacaatgtacaaatgtcaaggtctgtcatttacacaaagtgcttaatttctttttaatgcatcaaattttattatttctgacatcttactgtgttcatgcagctgtaagaaaagcacagagcaggctggg

SEQ ID NO: 230675 - DNA, 158 bp, Homo sapiens
tctctgcctctttttttctctgcattgattatgatggtttcaagcctttcctttagccattctatttttggacttgtatgttgtttctaactagtttattagctgtgtaattgcatctagttcccaattgttttcctaaccctgcaatctcttcatct

SEQ ID NO: 230676 - DNA, 495 bp, Homo sapiens
cagaggtactgagtggcagattactctgaatacaaagacatcatttgaagagggtgggtaaacctgttgatttttggaagcttagtgccattttctatctaagagccaagtatctttttgaactaaaatatgtttagactttagagcattatcagatataatttggggaataggagctgctggaatagagtcccagcctcaacctgattgagtaacctctaactctggccatgtttttctaatttgctgtctcaaaaacaacttaacaagaagtctagttctgtatggtaaataacctttattttcttagcctttgaaataagaacggttctttctttttttcttttattttttttaagattttcaagtcagcttgatatgctccttctgtaaacatagaagcacaaaatcctaattttgttcagttttacaaggtttgccgaattcccaggaaaatactgtaaggattaagaaataaagagaagcacatttttg

SEQ ID NO: 230677 - DNA, 397 bp, Homo sapiens
taataccttttttaaaaacttcctgtaatctttagtgtccactcaaatatatttatacactgtcctgtggtttcttttatattgtaatttaatgtttacagtgcttttatttttgggcagtgctcttgttcctctaactacattgtaagccactcaaaggccaaaatactgtgttacatatttttaacattctcccagtgtttgcagtttgtagggactcagtaaatatttgtagaataaaggaatggatagcagtagatattgaagaaaaaaataacgtggcatgatccttaatgtccagcagtttacaaccaatctgtggtagaaaatacatgtggaaaaaaactttgatttatgtgactttttttttttaatttaaaggccctctgtggatctg

SEQ ID NO: 230678 - DNA, 511 bp, Homo sapiens
caggagctgtgagaaatgcagaatctcaggccccagcccagacctactggatttgagtctgcattttggcacagtccccaggtgatccacgtgcacattagtgcttgagaagcactgtttccagaaattgactgataacacaggacttctttacttccaccaaagttctcacagctttcagctcttgggcgaccaactcatcctggtttgcccaggactatcccagagatagtgctgacagtcccatgtcctgggagactccccagtcctgggcagaccaccctatcactcttatctgtgggggtcctaccctcctcctcccaccaaactaaggcagagcctataaccaagaggcagaaagcctagaaaacttcctttgaggagtcaggaaagatagatagtggtctttcctttggggtatggaattgaacaaggcctgagccaggactcacaagaataagaacatggcaaggccctgccctcccagtgggaggtgtggagagctggcaat

SEQ ID NO: 230679 - DNA, 197 bp, Homo sapiens
accatcaactatgagaaacgttaagattctttcaattttttgctgtgtagtacagttatacattaaaattggaaagctatagctataaacagtttaaaaagatgtgtcagtttacatttctatggacaatatataatgcctatttttttctgtccctgcctgtaatggaacttactcattttaacttctgcctctac

SEQ ID NO: 230680 - DNA, 453 bp, Homo sapiens
aggcatcctggactagtttttctgtcccgactcctattccagctcatttcctccatcctgggaagattctctgcatacttaactcatgtcagtctttaatcttgtgtccatgtgtgttagtgcagacaagggcttgaatatttgtacagacatttctaatagagggtatccagcattaagaagtacatttgcatagtaaaatgaactaatgtggatcaaaaattaatccatgttgaagatggatctttctagaatttctaaaaacagatattgaaaaatggacttatctttccagaaagtcagttaagtagactaagtcttttaagtgcgaagaaatcttgtgcttccaccgaaatgttaataaactcagactccagagtttgcctgactagcttcatcagcctctgaggggctagacttattaaagaccttaaaaatcatataaaagtttaa

SEQ ID NO: 230681 - DNA, 366 bp, Homo sapiens
gtacatacacagttagggatcttacccccagaatttctaagaagtattcctaagggtcagaggttttccttgataattcagatctatttttgacttggtaaagcaagttcttatttactaactagacggtaactttaaaaggatagcttctcctctcagaatcttcatattttccttcatactataacagggttgatagtttccaaaggccctgccagttctatgattctatgtgtatattcatttgcttggaattagtcacctttgaaagctctttagtggcatctggagccactctaatttgtagtgagccaaagtgaatatatagattaatggtcacttctgcttctctctttgaaagcaatt

SEQ ID NO: 230682 - DNA, 380 bp, Homo sapiens
gaatcttgaaatgaattcgaaagaggagaaacatatactgtgcccagagcataataaacctggagagttgtgctccttagtcctgggaactttctcagtactgtcgccagttgtaaaccgaaactctgcttctttgtttctgctccttttggagcagtgattgctctgtagttttcctgaggctagattgaaccttatcacctcagctgtgttttttttaaatgtctgtgacttgcaatgtggctctttttctaaaaaatatattaaatttgatgttaaattagggagaaaggtagttacttattgatatggttaggctttgtgtccccgcccaaatctcatcttaaattgtaatccccataatccccacgtgtcaaggg

SEQ ID NO: 230683 - DNA, 394 bp, Homo sapiens
ttttcgctacctgacattgcaactgcctccctttccaacttgaatgcagggacttcagtagttttcttcattgttatattctcagagcttagagcaattcctggcatacagcaggcactcaacaaatacttgttgactaaatgaataaactagctcaactatcaaacggatctatgcagccaaagagaccctaaacattcaaaggtaaagtccttacagttaaagaaacatttggacacagcctattgggagctctaaaatattggtgccattgattcttctttattatctatatgtaattatctcaaaggatgttcatacatttctccattctgtcccacttacaggcaagcagaggaacaagaggtcatgaggaaatcatgatgaattcata

SEQ ID NO: 230684 - DNA, 384 bp, Homo sapiens
cattattgaattattataatgtaattacaactagatttctcttgcgggtgactaacatttgtattgttgaattattatgatataatttgaattttttagttaaaatgttaaataacataagtgaagtttttttaaaaaattatacattttacagaagacaaaataatgtaatttcctttacattctacatttactattagaaaaatgtttccaggctggttgactgatattcttcagcacacagctctgacttaaatgagtaagcaagggatgaattacaaattagatttgcaatgaaggtgcaataaaacattttttgtgggggaaagaggctcataatgttacagaaaaaaacatcaaattttccagtaaatgtcaaaggtg

SEQ ID NO: 230685 - DNA, 375 bp, Homo sapiens
tggccctcactgtgtgactgctatagcaccaacacacctttgttgagtttatgttttggggaaggttgatctcaagtgtatttgtttaaagactccacccaacgttcactcttggtggtgaaggcaggggacacaactctctggatgttggatttacagcattagtaagtctgttcaatataatttaaagcctgattataaatgattttaggatgtcttaatgtttctgttcctaaagcctttaagaaaagtccatagatttcatctgcattttccatacagggtgcaggtgataggtgatttgaatacttgctattttgtagcctttcccattctgaaattcactttcagttcactcagagatgtaggtgaaag

SEQ ID NO: 230686 - DNA, 469 bp, Homo sapiens
gtagaaaagatagactttagaagataaattgttagtgaattttcaatgtagttctagggcactgatatatcctgactgattcctaggaggcaaggttctatgtatgttagaaccagtgttctctttaagctgagcaatgcagtaaaaaaaaatatttttgttccaagaatatcactggccatcctggtgtctccagctaccaccagaacatacaatgaaaagatgaagtggaaaatgacgtggtgggtgatgtataatgtctcagttgtgaccagcctggccaacgtggtgaaaccccatctctactaaaaacacaaaaattagcagggcgtggtggtgggtgcttataatcctagctactcaggaggctgaggcaggagaattccttgaacccaggaggcagaggttgcaatgagccaagatcacaccactgcacaccagcctgggcaacaaagcaagactccatctc

SEQ ID NO: 230687 - DNA, 811 bp, Homo sapiens
ctgctcaggtaaactgggccccttctgattagctgctgtgcatctcctatttttctgaaaagctgccctttttaaagttccgttggacagcctggcacctagcaggagtgactccattctggtttggtctggtccgttgggcctagtgtaagagttcagtcctcccataaattttatttaagattattcttgaactactattctccttgctattcatgggctttcccaattaccaatataacagagcctgttctgaatcatccataatccaatccttcgcatagcatatattctgcactctgaaaatatgtggtgagtgggtgggtgagagagtgagttcaccgacccgaccgataaatcccaagcatggagggtagaaagggccctctgacatcagacggaaccaagtttacatgcaggctcctttatgcccagtttgtgtgaatttaaggaagttatctgagtctcttcaacctgtagttccatcctctgtcaaagatggatactgaaaggctgttgcattattttgggggagggttacacacaatgctgtgtgtgcgtgtgtgtgtgtgtgtgtatgtgtgtgtgtgtgtgtgtgtgaatagcaagtccagaacatcccagtttgcatgggactgtccaggttttagccctgattgtatgggactgtccaggttttagccctgattgtcccgcattctgggaaacttcagtcgcaggtgaactgcaattgttgttaccttgtccccttccctaagcccataaaactgttttgggttgttactatccattaaaaaggaagtgctgactt

SEQ ID NO: 230688 - DNA, 425 bp, Homo sapiens
ggcttcactgttggttgggattgaataatgagtattgtgatttagtaagtgtaacccatcttgaacttcagtttagatgtaaatatctttgtgaggtatctttctcaaatgtgacatgtaataacaccaagtacttaaatcagctgaatttagaaatcaccatgactcgtaaataaaccaaaaatttaaaaaataataaaatctatccaaccatgtttttctcaccaaatatattgcaagggctaataagttttatactattaataaatgttaatgtatttaaatatttactttctctacatcagcatgtcctcatatttgtttttgtgtataatttataatgcttgctgttataacttacaatatgtcaccttattttagcaaatataagttgtaatcaattgaaataggtaatataattgtat

SEQ ID NO: 230689 - DNA, 552 bp, Homo sapiens
tgggggaaactgctcccatgatttaattacctacacctggtgccacccttgacacgtgtggattatagagattataattcaaggtaagattagatggggacacagagccaaaccatatcagttgggtactgagaaggacatactgtattaatcatgccttcttattgtctgtattttctaatgttttgacatccatattttctgatgttttgacatctggggacttgctgatcttggagggactgaccctctcagggttaactcattcctaggggtagcaaactgctttccctagagcatgcctttcatatcaaatcaaccaatccaaacctctactccaaaccaccttctttattgggctctcatactctgagcccctattctcctaccctaattaccacagggccaggtactaaacaacttgagataatccctacactttgtagcctgctcaaaaatttaaactagccaatgctaaacctatttagcctgtgtaccctgcctcactcatttgttcagtgaaaaccacaataaagtttcttgccaatgttt

SEQ ID NO: 230690 - DNA, 545 bp, Homo sapiens
cttcctgtcactctcctatgtctattcttgtctccaacaattcccaacctcttgtgctgtggtccatggctctccatgcctcatgcctgtgctgtcctggagcacttccttcaactgatacacaaaaaaagtcttgcttattcttccctgatctacctgggtttcaccttcacctgtatgcagagttaatgccttcccgctgtccgttcccatatcaggctgtgtactattgaaatattcatcactcccttcaggctgtggcttaatgtgcccatctccttatcagccttggcaatttaaggacagaggttttgttttgttttttgttttttaatctctctcatttttgtgtgttctcaggagcaggagagaagggatgttaatatgttgaattaatgttaatcattaaaaccatcacaaccccaaatttctttaatccctacttaatccaaattgattgaatttgtacaattttcatgaatgttgaataatcttgaggtgaaataatcttatttcacaaaataaaaatttgttgaaatatcatt

SEQ ID NO: 230691 - DNA, 750 bp, Homo sapiens
  misc_feature (702)..(702): n is a, c, g, or t
  misc_feature (708)..(708): n is a, c, g, or t
  misc_feature (747)..(747): n is a, c, g, or t
acctgggaggcggaggttgcagtgagccgaaatggcgccactgcactccagcctgggcaacaagagcgagactctgtctcaaaaaaacaaacaacaacaacaacaaaaacaggaaactgaagcatagtagaggtgaaatgcttttccaaaggttaataaacataacgtctacagtagagtcttcagttaacctcttacattcgttttatgagcaagcaggctttctccattaataccacattttcatggtattgaataactcaggttgaacagtctttcctgaagcctttctattcttcccactcctaatacgatggcctacttttttggggtttttgtggggaagggactggtgtatcattgtcagagaaaagagaaaccatatttaaccagggccttagcagggcatgagcacagtcacagccacttgctcttgaccttgtgctttgatttcagtttaacacttctaaatttttgtactgcttcctcattctcctcttttgccaggctctggggaagatatagttcatcgacctttttaagagtatctcgttttctttgtagcatcatttccctttctaatgtgcaggagaaaagaagtacctgctttcagacttgccctctagccaggaaaagcactaagcctttggtgcaaaggagaggaaactatttggtatagtacagagaatcgctggagcctgngaggcngaggttgcagtgagcagtcttgccactgacaccagcctngcg

SEQ ID NO: 230692 - DNA, 391 bp, Homo sapiens
cctcaaatggtttgttgactaatccatatttttccccattgatttgaaatgctgaaatgtcgtttttcttgtttagtaaattttcttatgtacttaggtctatttccagactttctgttggtttgtaccttcccccatatcatacccttgcatgcatatctgtgagggaggaaaatagggtagtgttccagaagagaaaaaacttagagacaggcagctatcttaaaaatagctcctgatcacatcactgcactccaacccgggcgacagagcagaccctgtctctcacacgcacaaaaaaaatacctcatgttggaagttctctgaacctttattggttcagggcgcatctccataaaaaaatttaaaacaaaaacaccttgtgttatca

SEQ ID NO: 230693 - DNA, 455 bp, Homo sapiens
agctatgaggtcgtggggtaggtgcacacgtttccagccctgctttggtgctggtagccactggcccaggagcattttcctggcatccaggtgagtgcgcagccacacgtgcatgaagccaagcctgagtgtctcctgagggaggtgggctgaggaaggaggatgacctcacaggctgggtagagggatgaggttccttactggtccacagcgatggagactgcctcagggctccaccagctccacaacaccccctcactgaaatgacattcattcagcactgactgttggtccactgggcgcacacccttggcctgcctttgggacagagatcccttcccttttatcttgtgcaggcccagaattgaggaggtgccccacaattgtgtgctgatgaatatatgaatgataaatacatgaatgatgaataaatacatgaatgacaagtaaacgaa

SEQ ID NO: 230694 - DNA, 572 bp, Homo sapiens
cgctgatgggaaggaggggacacccggagttagggacaaagtcacgaggccactcgcagagccctcgcgcgcgtgttcatcgactgccccctgggcggtgaccttattcagcaagacctgagctcaggggcggggtgacatctaactggagtcatcatgatggagccacgtggtccaacagtgcccggtccttgtaaccaggagggcccgcagtgtcaccacttcctcgaagtgaggccactgccctcagcttcttggagacagcagatatgagcagaaacccccaaaagtcaggagcaaatttgtttcagaatctctccaaatctgtggcttaaaacaagttcagagggattttggtgcacagctacagactgagctggtttactgcacatttataaatggaaatctttatttcttttcctctctatgtttttaagaaatcctgttgcaaggtcattaatcacgttatccattataccacaaacaaatggatttgtcacttgtgcgcagaagccgaggttgattctgaaagcaaattgtaccaaaataaatgaaattattatgataatata

SEQ ID NO: 230695 - DNA, 606 bp, Homo sapiens
ttcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaattggagtcctctaaggaagttagtgtgtttttaccagaaggaggaggaattgatgcactgaaagcaggcagatgatggagtttgtttcc

SEQ ID NO: 230696 - DNA, 753 bp, Homo sapiens
ggctcatggggtagtcaagagtgaatatggggtatgacttttccccattaatggccacaaacaaaaattagtccagttggggtgcaaatagaggctccacaacatctgatatctatccattgctgccaaattgggtctgtagagatattcttgccctgttccaatggagatacccaaccaatctttgtttcacagagtgggtcagtactcctaccttcccagattaggcagttgttttgtttgtttgttttatttttttcctgtatgttgttatctgagagaagtcaccatatatggtttgtttccttgctcacaagtagaatcctgtatacactgttacagccttggggactcggcagcttagagttggatcaaagcattgaagggaaacctccacttttgtgtcattaatacacagtgggtgcaaaatatagaatcattaatgcactacagatatagatactcagatttccaggttcagttaatagcagttgagggtgaggggttcaggtagaatctattaagtgctggagagataaagtagcatggcaccagtggtgggcatatcttacggaaatgtacttccactctgtccctgttctaggtagtctttgatttgatctggtgtccgagccctgcctcctcagtcaaatcctgcctcctccttaagttatgtctaggtgttcaccttatttggtcatggtctgatcagttggcagcctgtgattggctgaagctcagctgctgttacaa

SEQ ID NO: 230697 - DNA, 728 bp, Homo sapiens
aagacagacgtttaaaacattagccttctctccccatctggagtatggtttggaagtcattgctttgtagtaaggcattattttcctggtacattgccaaggaccaacaactgttaaatcaacaaactaagattttcttctagatttgtatcggattgtgactttgctttctccctttcatcacccattaatgcttagtaaagccactatggacctcacgtatctaaacccttccctgaaatgcatctctcttttcataccactccaatgggaactcctgttgatttgtttctgggccctgacagattagcaggaaaagaaagcgctttagaaaagtgagaggggagttcagaggttagaggggaatcagaaaattaatgtcatgattatcaagaatgtttccagaaggcagggctcatcagtccttgacaaaaaggctgatgaaaaaaatggagttgagtgcagccgatcacctcaataatcctagcagtttggcaagctgaggcaggaggatcacttaagtcccggattttgaggttgtagtgcgctgtgatcacaacactgcactcggcctgggtgacagagctaggctgtctcttaaaaaaaaaaaaaaaaaagagagagaatgagaaatgccatttaattttgagcctggcaggtctttggtgacttttgagactagtttactgtggaatgttgaggtaaagtaggactgaatcacatgtaga

SEQ ID NO: 230698 - DNA, 497 bp, Homo sapiens
aagacagacgtttaaaacattagccttctctccccatctggagtatggtttggaagtcattgctttgtagtaaggcattattttcctggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtccccattcccttgatgtctacaatatcacctttcttatagattcgcatatatgtggccaaaggaacaactccatgttttctaaaaggcctagagaacatatatcgggtgcctctcctctttccctttgtgttcgtcattttggcgaattactggaagatggcggttccccccgcgt

SEQ ID NO: 230699 - DNA, 228 bp, Homo sapiens
gccggtcgactcatgaggagatcccccgagattgagggtgtgctgccccgggatccccaccccgccctcggcctgggtgacagagctaggctgtctcttaaaaaaaaaaaaaaaaaagagagagaatgagaaatgccatttaattttgagcctggcaggtctttggtgacttttgagactagtttactgtggaatgttgaggtaaagtaggactgaatcacatgtaga

SEQ ID NO: 230700 - DNA, 635 bp, Homo sapiens
gtgaagtttcctttattgagaagcagtggtatagatggaaaccttattgcctcaatttgtcattttattattcatattaaaaatcagaattttattcttttgctttgaaaaggaatcttcgggtcagaggcagtttgtttgtttgtttgtttgtttagctactttatgttcacagaagagagagctaaagtcccttccagctacatgtggctgggttctggaggtctagtctagtgtttgcccagggttaactgagaggctggagggcaggcagcctatcctgcgtcacccaggtcagcagcacagtcaaggcttccagatctctgccaaggacttttcctataatttactgtatttcccacaaccatgtgacattcatctcatatgaaaaattaggttaaactttgaactctccccttttgcaagaccagatgaagtcctaaccttgaagtgacccttttcagatgtacgaaaacacagcagaggtgaatcaatctatgacagacactctgagttccctctgaaaggctggccaaggagatggggcaggagagctgagtttctcaaaccgggcaccacagatccctggacttctcattagcagctgccctagtttaagataggattgcatttct

SEQ ID NO: 230701 - DNA, 516 bp, Homo sapiens
cgaattagtatataaaacgtacaatgtattttccttataattttttacttcttccatcctgagcatgttttctgtattttttggctatgtgcatatccactttggaagtgctgttcaatattgggttgtcttttcctgattgatttgtaggcgttgctagcatcttcggctgcatatcctcttccaggtatatggattgtgaagatcctccccagctgtagcttgctgtttccaccttaatcatgttttagcaggacagaagtttatcacgatgacgttcaattttaatgaatttcgattttaatgtagttcagtttgtcagtcttttatagtcattgctttttgtgtccttttagagaaatctttgcctacttcatcacttgtatgtatttttaaaataataataaatattatttattatacataatatataaaataaataatataaataaaatataataaataataaatattttcttatttaataataaaataataaaagtaattattaatatt

SEQ ID NO: 230702 - DNA, 754 bp, Homo sapiens
tggcacgtggctggcccagctcagcctccccgcctctgcccttgcaggtgccctgtacccaggcctctgtccatgcagccagagattcaccccggtttccttcaactccttccccagcttcacagtctcggcgcttctgctcttggcttccagcccatgcctgggtcccctcctctgctacgtccctccaaggccctatgccttgcgccttgcctgttcctgtgtgctgtggggccaccactccgatagctgtgaactccaagggcagccccagggaacctggtgccagagatggaatcttgctatgttgtccgggctggtctcgaacttctgggctcaagagatccttctgtctcagtctcctaaattgttgggactacaggtgtgagcccccacaccccgccaggtttctgatttttaataaagactccctctggctgtgtgaagaaaaggtacctgtactaaacggggggaggctggggcctcctaggcaagagatggtagccgcggtggccatgctgggtgcacaggccgggacagggcggaattccagaggaaccccaggtttggggctggagtaatggcgccctcacccgtgggcgaccctggagtggggactggagggaagtggttccacgagtgagactgagtctattaggcctcccagtttcctggagtggcagctggatatgcggtcctgagagccaggaggtgcacaggtcacgactcgaaaagtgaacaggcctcctcctct

SEQ ID NO: 230703 - DNA, 451 bp, Homo sapiens
gttaaccaaactatgtcttcattgttttaattagtgacgctgcagccagaagagcaaaactttgcaaaacaacctagttctattactgaacactgttgtgtggcctcttaaggttaaggcccgagagtcacatttagagtcctaccccgtcttcatagtcccccaatacatatttaatgactaaagtaataaatgaatattgggcaggaaaggcaagaaatatgcctaacactagcaagaagagacttaaggggaaaatggtaaacactcttagcacttcatgtacatcttgcctctgaaataagattcaagagctgattcaactgatttttactagtagaagcaataagtataagtagatgagaaggaaataatagatgtaaaaggcatggaatatgcatacaaaataatattactgcttaattatgacaaataaatatatttgaatcct

SEQ ID NO: 230704 - DNA, 352 bp, Homo sapiens
acagggtttcaccagggccaggttggtctcgaactcctgacctcaagtgatctgaatgcctcggcctctcaaggctcatccatgttgcagcatgtgtcagctcattcctctggattgctaaagtgttccactgtatggaaatacctcagttaatcctttcaccagctgttgtacccttgggtcctctcccctttttggccagtgtgaataatcctgctgtgaacactgatgtacacgggagtcattccttgcttctgctctgaccttttcctttctgctggtccacttaccctcaggacttctatccctgggtctcctcctacctggtttgctccatcctgtgtctcttcat

SEQ ID NO: 230705 - DNA, 610 bp, Homo sapiens
tgcctccttgcccaactggcatttgggagaccaggaattgagaagttgggaaattggcattccgtccagtgtacaagatgtatgtgttctctggaccactctgcacgtagttctggagactgagctaggaatagacccacaagatgacttcctgtgctacaatgagcaaaataaagtttgaaataaatgtgagcattgacagatcttgtcccctgctctcatgtccaaaatctaagtagcggtggtttcttctccccaacctcgggacttatcccataccgggtcatgggagcaggaccatcagttcctctgtctcataggtgccctggccagttgccttcctgggtgaaattacagcttccaggctcagaggctgctggtccagctagtttaagtgatatcatcttttttttttttttttccttttttgagacaggatcttactctgttgcccaggctggagtgcaggggtgtgatcttggctcactgcaacctctgcctcctggctgaagtgattcttgtgcctcagcctccccagtagctgggaccacaggcacgcactaccactcctggctaattttttgtatttttggtggagatgggttttcac

SEQ ID NO: 230706 - DNA, 1954 bp, Homo sapiens
gagagtagaggggatgtaaaatcattatgtggagagctggagaacaacctgatgaaggaaatcaagtgagctgggcaaggtgtggagtccatttgagattgaagatcaataaattatcgtggtattggtctgtcctgttgtgtgaattattttttaaatgtttcccggcagctcaggtccaagtgtcaggaaagcaggtagttgtatttgtcctggatggggctttcttggatgtgacagaaagacaatgaggcaagggaatttggggaaaaaatgttcagtttttaacaaatgatggacagttaggagaactaagctggactaggaagtgaaaataggtgagtctgatagagtagaatgaactgtgcttggaagacaggtgccatgggagtaatcgggtaattaagcagcgagagtctcattagggtgagagcggaggcatctgagtgagtggatctggaggtgacggtggaggtcagcgtatggttttggcagtcgtggcactcacctctctgagggcttccctgtaggagggacataaattcaggaatcatggccaaggaaacatgctgttttactggaaacttgcagttattaataaatacattacataaaagcagtgctggagcctctatggcttagggtcagggcttaagtaagacagcctatcatctgccttctaaacttgaggtggcccagtttggaaagccgatttcctgaggtagagcagaggtgtgtgtcattgactgttacggcccccctcctgagtagggaattgggaccagtgagtattctcaggatgggtggggctgaaaagaaggggatgagtgtttgctccccagtggagacaagcagaaatctgggagggggagagtattttcatgtatgacaagatccggggtgtgacagtttgtgcacggttacccagctgcctttccctaaagacacggcctcagggcaggagccccccaagctgtggatgagctgctcagagttctgagctggggaggaaaggggcttctgggcgggcaccagcttggtctggaaggatcagaagatgaagacttgctcctctcccaccaccccacagatgccagttgccatgacaacaggtgtctttgatatgaaaaggacattttggggtcaattggcaaaacttaaatgggatctgaggaatagaaggtaaaaattggtcagtgttaatctcctgatattgattgtaggagaacataggaaatactcactgatgtcttcccaggagttagccattacactaggtatttatggtttaggaaaaaagtatgaattgcattcctttttaaggctgaatcataggtaattggatgtgtacaccatattttgtttatctgttcatccattgatgggttttgagtttacaccttgtggctattgtgaataactgctatgaacactgatgtacagattatgtttgcatttccgctttcagttcttttgggtgtatcttagaagtggaattgctgggtcataaaataattctgtgtttaatattttgaggaaccgcctgactgtcttcaacagtagctatactatttttgtttccaccatcaatgtgtaagggttccattttcttcatgtccttgccaacactgtcttttttaataatagtcatcctaatgggtataaagtggtatcttcttatgcatctcactaatgaaaacatttttttcatattttgcattagtttacatttgaaagtattgctttaaatttgtgaactatatatgagcaatgtagagaaatatttcgctttaagcaatggttgactggccaggtacaatgactcacacctgtaattccagcactttgggatgccgagttgagaggatcacttgaagccgggaatttgaggctgcagtgagctatgatcatgccggtgtacttcagtctgggcaacagagagagaccctgtctc

SEQ ID NO: 230707 - DNA, 1691 bp, Homo sapiens
gagagtagaggggatgtaaaatcattatgtggagagctggagaacaacctgatgaaggaaatcaagtgagctgggcaaggtgtggagtccatttgagattgaagatcaataaattatcgtggtattggtctgtcctgttgtgtgaattattttttaaatgtttcccggcagctcaggtccaagtgtcaggaaagcaggtagttgtatttgtcctggatggggctttcttggatgtgacagaaagacaatgaggcaagggaatttggggaaaaaatgttcagtttttaacaaatgatggacagttaggagaactaagctggactaggaagtgaaaataggtgagtctgatagagtagaatgaactgtgcttggaagacaggtgccatgggagtaatcgggtaattaagcagcgagagtctcattagggtgagagcggaggcatctgagtgagtggatctggaggtgacggtggaggtcagcgtatggttttggcagtcgtggcactcacctctctgagggcttccctgtaggagggacataaattcaggaatcatggccaaggaaacatgctgttttactggaaacttgcagttattaataaatacattacataaaagcagtgctggagcctctatggcttagggtcagggcttaagtaagacagcctatcatctgccttctaaacttgaggtggcccagtttggaaagccgatttcctgaggtagagcagaggtgtgtgtcattgactgttacggcccccctcctgagtagggaattgggaccagtgagtattctcaggatgggtggggctgaaaagaaggggatgagtgtttgctccccagtggagacaagcagaaatctgggagggggagagtattttcatgtatgacaagatccggggtgtgacagtttgtgcacggttacccagctgcctttccctaaagacacggcctcagggcaggagccccccaagctgtggatgagctgctcagagttctgagctggggaggaaaggggcttctgggcgggcaccagcttggtctggaaggatcagaagatgaagacttgctcctctcccaccaccccacagatgccagttgccatgacaacaggtgtctttgatatgaaaaggacattttggggtcaattggcaaaacttaaatgggatctgaggaatagaaggtaaaaattggtcagtgttaatctcctgatattgattgtaggagaacataggaaatactcactgatgtcttcccaggagttagccattacactaggtatttatggtttaggaaaaaagtatttgtactgtatttgtaagtttgagattttcagaaggaaaaaattaactatttctggaaggagccattttcaaaaaatggctctcagctaggaccccaattaaaaagtaagtggctgggcatggtgggtcatgcctgtagtcacagccctttgcgaggccaagacaggaggatcatttgaggccaacagcctgggcaacatagtgaaaccccatctctacaaaaaaaattttttaattagctgggtgtggtggtgcacacctgtagtcccagctactccagaggctgaggtgggaagatcgcttcagcccaggagcttgaggccgcagtgagctatgattgcacctctgaactccagcctgggcaacagagtaagaccctgtctcttaa

SEQ ID NO: 230708 - DNA, 646 bp, Homo sapiens
cttgattttatgtcttctcttgatttcttctttagctctctgttgctccaagccgagtttttctaatattttgtcacacatttaaaaaataaagccaagaattggtacatttctttaagttaggatgagttaagagaattgcagctgttgtgtggacaaagttcatatgtgttctgtgacgtggtgtgaactctgttctatgtctggtatctaatgtcaccaggttgctcagacaggatctctggtcaccattatctgaattctgcctggtgacatcagtatacttgagcatttatctgaacacctaggctagcatagtgctgtcttggtcctgaaggcagagcaagtgagaattctgactttcttttgatctagaagttaagtaactctgtagaccttttatattactttcaccccagaagaaaattccatttttcccctttttggatgctttaaggatcaactactgataaaaataaaagttgcaagacaacttcaagaacacaagaaccgcagttacttttgcatgaacctaatagataacatttgtgtaagaagggatatttcgatatacttggtaactgtgagctgagatttaatctttaggcctgcttttaaaaaccaaaccagcagctgtctactcctt

SEQ ID NO: 230709 - DNA, 2260 bp, Homo sapiens
gtgcctttaaggacctttgggtgattagagacaggcaggcagcttgccgcctggaaatgatcaagtggtcagcctgaccaaattcaggacagctgaagggtctgactgggcactgtgtgactggtgggttggaggctgtcgtgtggctgagcagagatggccagctgatgggtcacacagttggggatggtgtcaggaggtcaacctgaccagcagagacggctggcaggaaggtcacggaaggccagccaggcatggtgccactgggtgcaggcaggtggcggatctgagtggcctgacacattggatggtcgcttatttgggcagcgtgattgtcagaacagtgttgcaggggctgctgcagggagccatttggacatctgcagggcccccccggaggcctcggatggccacgtagggtctgcctatcaggagaacccccagatgatcacagtcccccagagacagccagacccccggggacccagcctctcacagtcagtcctcccacccgagtgaccccgatggcggcctcccggctggcggcgctggaaggagtggactccggtcccagggtgcccggggccagccccggcttcctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccgccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaagctagtggccgtggtcatggacgtcttcactgacccagacctgcttttggacttggtggatgctgccacgcgccgctgggtacctgtctacctgctcctggaccgccagcagctgcctgccttcctggaactggcccagcagctgggggtgaacccctggaacacggagaacgtggatgtccgtgtcgtgcggggctgcagcttccagagccgctggcgacggcaggtgagcggcaccgtgcgggagaagtttgtgctgctggacggcgagagggtcatctcaggatcctacagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcctgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgatctccgtggggcggtgccctgcccctgccccccgcccaccgcctccgctatctgtccccagcccgaaggcggttcggtggggatgctacattcaaacttcaagagcccagaggcatcaggccgtcagactgggccccccgggcaggacttggggggcaaccctgaacaggagcccaagccaaatctgctggcccacccaaggagcagtgccggacaactgtcggctcagagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttggg

SEQ ID NO: 230710 - DNA, 1014 bp, Homo sapiens
gtgcctttaaggacctttgggtgattagagacaggcaggcagcttgccgcctggaaatgatcaagtggtcagcctgaccaaattcaggacagctgaagggtctgactgggcactgtgtgactggtgggttggaggctgtcgtgtggctgagcagagatggccagctgatgggtcacacagttggggatggtgtcaggaggtcaacctgaccagcagagacggctggcaggaaggtcacggaaggccagccaggcatggtgccactgggtgcaggcaggtggcggatctgagtggcctgacacattggatggtcgcttatttgggcagcgtgattgtcagaacagtgttgcaggggctgctgcagggagccatttggacatctgcagggcccccccggaggcctcggatggccacgtagggtctgcctatcaggagaacccccagatgatcacagtcccccagagacagccagacccccggggacccagcctctcacagtcagtcctcccacccgagtgaccccgatggcggcctcccggctggcggcgctggaaggagtggactccggtcccagggtgcccggggccagccccggcttcctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccgccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaaggtgggttgtcgcgggggccctgtgt

SEQ ID NO: 230711 - DNA, 2404 bp, Homo sapiens
gtgcctttaaggacctttgggtgattagagacaggcaggcagcttgccgcctggaaatgatcaagtggtcagcctgaccaaattcaggacagctgaagggtctgactgggcactgtgtgactggtgggttggaggctgtcgtgtggctgagcagagatggccagctgatgggtcacacagttggggatggtgtcaggaggtcaacctgaccagcagagacggctggcaggaaggtcacggaaggccagccaggcatggtgccactgggtgcaggcaggtggcggatctgagtggcctgacacattggatggtcgcttatttgggcagcgtgattgtcagaacagtgttgcaggggctgctgcagggagccatttggacatctgcagggcccccccggaggcctcggatggccacgtagggtctgcctatcaggagaacccccagatgatcacagtcccccagagacagccagacccccggggacccagcctctcacagtcagtcctcccacccgagtgaccccgatggcggcctcccggctggcggcgctggaaggagtggactccggtcccagggtgcccggggccagccccggcttcctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccgccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaagctagtggccgtggtcatggacgtcttcactgacccagacctgcttttggacttggtggatgctgccacgcgccgctgggtacctgtctacctgctcctggaccgccagcagctgcctgccttcctggaactggcccagcagctgggggtgaacccctggaacacggagaacgtggatgtccgtgtcgtgcggggctgcagcttccagagccgctggcgacggcaggtgagcggcaccgtgcgggagaagtttgtgctgctggacggcgagagggtcatctcaggatcctacagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcctgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgatctccgtggggcggtgccctgcccctgccccccgcccaccgcctccgctatctgtccccagcccgaaggcggttcggtggggatgctacattcaaacttcaagagcccagaggcatcaggccgtcagactgggccccccgggcaggacttggggggcaaccctgaacaggagcccaagccaaatctgctggcccacccaaggagcagtgccggacaactgtcggctcagagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttgggtgtggtggcgcacgcctgtggtcccagctacgcaggaggctgaggtgggaggatccctcgagctcaggaggtggaggcagcagtgagccaagatcatgcccttgcactccagcctgggcaacacagtgagaggccatctcttta

SEQ ID NO: 230712 - DNA, 1328 bp, Homo sapiens
ataagtgtcttaacttgggctgtcttcactccacccctcccgagtaggtacttcagttgtgcccattctacagacagggaagctgaggctggagaggtcaggactcgcctgaggtcctacggtctcccctgggacctggctgaggatgggggccgggctgggccctcagggttggagactctgaccccctactccccgacccccagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcctgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgatctccgtggggcggtgccctgcccctgccccccgcccaccgcctccgctatctgtccccagcccgaaggcggttcggtggggatgctacattcaaacttcaagagcccagaggcatcaggccgtcagactgggccccccgggcaggacttggggggcaaccctgaacaggagcccaagccaaatctgctggcccacccaaggagcagtgccggacaactgtcggctcagagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttgggtgtggtggcgcacgcctgtggtcccagctacgcaggaggctgaggtgggaggatccctcgagctcaggaggtggaggcagcagtgagccaagatcatgcccttgcactccagcctgggcaacacagtgagaggccatctcttta

SEQ ID NO: 230713 - DNA, 2279 bp, Homo sapiens
gtgcctttaaggacctttgggtgattagagacaggcaggcagcttgccgcctggaaatgatcaagtggtcagcctgaccaaattcaggacagctgaagggtctgactgggcactgtgtgactggtgggttggaggctgtcgtgtggctgagcagagatggccagctgatgggtcacacagttggggatggtgtcaggaggtcaacctgaccagcagagacggctggcaggaaggtcacggaaggccagccaggcatggtgccactgggtgcaggcaggtggcggatctgagtggcctgacacattggatggtcgcttatttgggcagcgtgattgtcagaacagtgttgcaggggctgctgcagggagccatttggacatctgcagggcccccccggaggcctcggatggccacgtagggtctgcctatcaggagaacccccagatgatcacagtcccccagagacagccagacccccggggacccagcctctcacagtcagtcctcccacccgagtgaccccgatggcggcctcccggctggcggcgctggaaggagtggactccggtcccagggtgcccggggccagccccggcttcctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccgccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaagctagtggccgtggtcatggacgtcttcactgacccagacctgcttttggacttggtggatgctgccacgcgccgctgggtacctgtctacctgctcctggaccgccagcagctgcctgccttcctggaactggcccagcagctgggggtgaacccctggaacacggagaacgtggatgtccgtgtcgtgcggggctgcagcttccagagccgctggcgacggcaggtgagcggcaccgtgcgggagaagtttgtgctgctggacggcgagagggtcatctcaggatcctacagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcctgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgatctccgtggggcggtgccctgcccctgccccccgcccaccgcctccgctatctgtccccagcccgaaggcggttcggtggggatgctacattcaaacttcaagaagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttgggtgtggtggcgcacgcctgtggtcccagctacgcaggaggctgaggtgggaggatccctcgagctcaggaggtggaggcagcagtgagccaagatcatgcccttgcactccagcctgggcaacacagtgagaggccatctcttta

SEQ ID NO: 230714 - DNA, 427 bp, Homo sapiens
atccctcatggataccatggaccttgggttaacaatagctttgtagaggtagactttttaaaaaactacattttatccaaatttgtaactgcaatccactttcttctgagaagcctagtggatctgctttctacccagtggttctacaaacactcagaccaccagtcgtttctgagtgtagtgaatctttgagtgtattgaggggaaagaatcagaaaaatggaatagaacaattacatgaaaggcaggagcaggctagcaatgagactcaggtgctagtaggactagagaaaaaggctggcggccggtgggacggggagaggggagtttagaagagggaaatctgaaattagagacatgggttgttgaaggaacttatttggtaattagcatatattaccttgcaagaatgatacaaaaaaaaaat

SEQ ID NO: 230715 - DNA, 253 bp, Homo sapiens
gcctctgcgagcctgtcgccacaccaggctgtccttgccctcggtggggcccgagcacatggtacacaggaaagacttgcccgggtccttgccctgttgcctcttgttaccttcccaccagggctctgcaggagcctgggcttgaaatctagctcttccttttgctaactgcgtttatgggagtcaatgaattagtttttcccaagcttcaaataagaatgttaacactgggggcaggacaaggcaggattta

SEQ ID NO: 230716 - DNA, 190 bp, Homo sapiens
ccttcatgaaaaatcagtcatagatgctggaatctccaaacctccaaggggcttacaacattgtgtgcagggaaacctctaattcacagccttattgagagcatgtgtcaatggcccatagcaggggcccattctggcttttgtacaaccccaaagacacacgtgggttttccatttttaaatggttgaa

SEQ ID NO: 230717 - DNA, 496 bp, Homo sapiens
catcagaagaaaaataaaaggtagtttataaaaaaaaatttaacgggaatcaggccaggactggaatcaggcagaggcagtgagaatgaatgattggaactgaaatactcttaagatcctgatcattgagatagctcttgataccagtatggtcgataagaccattagtttattatattttctagtactaagtggccttcactgcctactcgtccagtctcttatgattcctcctcatatccaaatagatgacctttctgaacatcatcctgctccttgataactctagcactcattgatcactctcacccttaaccctttctcttctatttgcaaggaagatgttaactcttaggctgttctctctccatgtcctccagatgccgttttcttttgcttaaatctttgcctcagtgatatctgttgttcgtaaatatttagtgcctcataaagattttcttcagccttaagtcactcataattcaccctcatcttt

SEQ ID NO: 230718 - DNA, 479 bp, Homo sapiens
acatgggattctagaggatcccgctgctgactatttgtgggtgtttcttatgacttggagaatttctagtgctttccatgcactagcttatttgttctttatgacagttctattttattctgattttaaagatgaaaaaacaaacacacacaagttaactgtacagatgaactggtggcacaatcagcggggcagagccagaatcaaacctcagcagctaggttggaacactcagtgactgaataaccttgggcaagttacttgacctttctgtgcctcagttttcttacccgttaagtagggatgatattaataactacctcgtaaagtttctgtgaagactaaaagagatatgtaacatgtttgaaatagtgcctcgcatgtagtaagtcctctgtgtattatagactaaagctggccttcatcttctacagataagttgaaaaatgcaacaaatagtcagcgaggaaaggtatata

SEQ ID NO: 230719 - DNA, 443 bp, Homo sapiens
acatgggattctagaggatcccgctgctgactatttgtgggtgtttcttatgacttggagaatttctagtgctttccatgcactagcttatttgttctttatgacagttctattttattctgattttaaagatgaaaaaacaaacacacacaagttaactgtacagatgaactggtggcacaatcagcggggcagagccagaatcaaacctcagcagctaggttggaacactcagtgactgaataaccttgggcaagttacttgacctttctgtgcctcagttttcttacccgttaagtagggatgatattaataactacctcgtaaagtttctgtgaagactaaaagagatacctccacctcttacatatatgatccacagatactaattcgacgtctcggtatctcatgctgctgactactttgtgtgagctaagaaagat

SEQ ID NO: 230720 - DNA, 640 bp, Homo sapiens
ccggccttattaaatatatgttcctcaatatcaaattgtactaaaaatcaggaaactaagctcctagtagagaactggtcaaagggaagatctttgtggagtcagcagtttcctctgtcctacaatttggcaaaataatctcataagcacaagaaggttaatatgcttgcattaaaaatgttaagttacttataatccaatttaaatgtaagttcaaataccttaacatgttcacattacttttttaattcacaaaaacgttcttatctatctttattttaagatgttttccacatacatgcttagtgaattttcttttaggagatgtaagagagtctacaaatctttattctactatttcccaaaatatacccaattactggcaaaaaatgttattattaaactgatgagaaaatataaaggtttattactggattaaataagtttttccatatgcttgaattttttatacacacagtatatactctattatatgtatacacagaatacaactctatcagtattgaacttagtttgtcattccataaaatggccatagatggccagatcaagtaatcctactcattttaccctgtattactgaaaataaaaatggggggggggcaaataaagactttaa

SEQ ID NO: 230721 - DNA, 682 bp, Homo sapiens
gcaacatcccagctagaagcctgctgaactagaaatattaattttccttttctcccaagaagatgatacgtgaatgctgtgctcttccttcatgatcctaacattctgctacaagggttttgctgacatgttgtgttggagaactactgaaaggttgtgaataggaactacacaacatactggctttgcctctacactataggagtgtgttaaatttcctctgtattcccagcgtcttacactgagcctggtccttactacatcttctattaaatgtttagtgaataaactctgtgatggattaaagatggctacatattctttactacataagcaggtgatgtaattggataaacagaatatggcagaagtgatgttgtggcaatttctgggcactggaagcttctactttctgtccttcagaacactttctctggaagccctgccatgtaagtctgaataccctgagactgttttgctggagaagtcagttaacagtcccaagtcccagaagagttcagccttccatacatctgtcaaggtgcagagggatgagtggagcctgcagactcttagcagaataccacttggaacagaacaatcacctggctgggccctgccagaattccctgacccacaaaatctgtgatataataaaattattgtttttttagccacttaa

SEQ ID NO: 230722 - DNA, 659 bp, Homo sapiens
agttcgagcttcccggctgctttgtttacctaagcaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtgctgcgccgttttttaagccggtctgaaaagcgcaatattcgggtgggagtgacccgattttccaggtgggaagtgggaagataaatcagatccctgctactccttaagcagaagtgaaattcattcatggttagaagccggtgtaagagagatggctgctgaagacacatagccgcacgtgtgaacatggcctcacagcttgcctctccataagaggtttatttgtcttctcatatttgttcaatgtggacaagaaccttctggcccctgctcctcttttgcatttggaatcctttgacttctgctttcttgaggagtgaggctcctgggcaagttgtcacccaactctgggcagtcatcccaggacctgagagtcactgcaaatccttgctcagaaccccatgcccatgtgttcatccttgcgtactttcccaggccccagaccaaattaaaacttggcagttgaatcacggttttcacaaaatca

SEQ ID NO: 230723 - DNA, 535 bp, Homo sapiens
cctgcttaatatccttcagtgacttcccactgcacctctcataacagccacactctgaacagagacctcccaagccccacgtgacttgcccaggcctcccccggggctcctctcttctcagggcctccagcactccttggcctcatgcctctggatacgctgttccttctcaccaaaactctctgttccctccactggagcccagctggctcctttcccgtcttttagtgtcaggttaaatgtgatgcactcagagttttctctaaaccccctgcatctaagcagggccccaactttgttcttcattactgcccttactcattttcctcagaacattcattaaaaattgtccttagatacctgtctacctaccttcattgacagaatctcccatcagactgtaactccaagagctgggaccacagtgtcttgttcactgctgtactcccagggcctagcatggtgcctgacctagagctgatgttcagatattggttggttggatgaatcagcaaataaactctttggagtattc

SEQ ID NO: 230724 - DNA, 475 bp, Homo sapiens
ctataggcagaggacatgctggagtccctgagttaggctccaaggtactgagggctatacatacctggttgttatggagtatcagtgggcaaaccaggacctgaattgaagcatcttaaaccacagaaaacagccagcatttcttacctcttttgaataactttatttaatcagatagattttgggaaaatcccagctctgccacttacgtagtattcgtcctataataagtgactcaaatactcacatataacaaagaggtaataataatgcttgcctgcctcattggatccactaggttctggctggcatagaacttatacaaaataaatgatcaatatatgctagtattcatttttaacacagagataatatttcaccagaaaatcaaactattgtcatgcctcatttttgtttaaattttagaagggttttgtgattcatgaaaggtaataaaattataataaaggttttg

SEQ ID NO: 230725 - DNA, 443 bp, Homo sapiens
tcagtccacgagaagaaactcctgtggagagaaggctgtacggtagaagctcctgcaaggccaggctgtgtgggcagtgctgcccatctactgtgtcctcagtcactgcttatttgcgtgaaataagaaatattaccagtggttttctccttttagataaagattgagtcaagcacagagctggaaaacacagcaaattaaaattttaatgcaattataactcacagactctctcttttgcctcatctttcttcatatgctgaaattctgagtgtgatcatttaatatttgcccaatttctggaacttgtaaaagaagtcacaaggatgcttattacattagatagtgtttgcatataatgctgctgatacatggttctgttggctcatattaagtgtcatccgtaccaagtgaaagagaaaataaaattatctaacttccta

SEQ ID NO: 230726 - DNA, 388 bp, Homo sapiens
cttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatatttgcacctttttctttaaattaaatgctagcgtgttcactgtcgtgtcgcatgtgcaccagaaacacaagtttaactgag

SEQ ID NO: 230727 - DNA, 460 bp, Homo sapiens
gaatggactaatttaaataatttgttctgcttattctgtaggggttgtttaaaccagtgttatcagaattttgcatttctaagaatcacctgggaagctatgctgaaaatggtgatcctgggccccaaccacagcaaatatgatttgatagttctggggtggggcccaggagtctgcttctttcatatgaattaccctaagtgtttctgatgctgatggcgcatgttctgtgttttgaaaaaacactgatagatgtactggagcttggcttgctagtttctttttctatttttaatgacttgatcatgtaacttttaaatgtacctgtggttttgtattctgttgtaatctgtatagcttcatgatttataaaataaaagattctgttctctttaaaatattagatctgagctagctggatagtttttaaaagttctaagtcattgtttacaaaactgag

SEQ ID NO: 230728 - DNA, 493 bp, Homo sapiens
cagaagtgttggtgtcaccaggacacagcctcagagcttcattctaaaaggaaatgtctcacatggatcttatgcagagaagcctgagcgacttgcactttcaacaatggttttgtcatagatgtaaaggtctgtttccatggttacccaaattccaggcactggccccaggcccaccacaacgcatccctcaaagtctctttggcagaggaaaagcatttctccttgctgcggcaagtcagagccagaatctcgggttctcctgctccaaagcccccactacaccctcattcgcgtgtgattcatgcgtttaggtggttctgctcagcgtcgttttttgagttggggggcggtgagtaagcacaatataagtttccttcatttctcttctccttgtttgagctaaggaattactttcttgtaccaaacattacacccttggaaaacactccagatggttctcattaaaattccaattcctttttttgcaatt

SEQ ID NO: 230729 - DNA, 420 bp, Homo sapiens
ggattcacagctgaattctatcagaaatttaaaggagaattggtaccaatcttactgacactactccacaaggtagagaaagaggaaaatcctccctaaatcattctaagaagccattatcaccccaacaccaaaaacaggacaggatataaccaccacaacaacaaaaactgtagaccaatatacatgataaacatagatgcaaagtcttcaacaaaatactagctaactgaatccaacagcatatcaaaaggtaattcaccatggtcaaatgggttttataccagggatgcaggatggtttaacatatgcaagtcaataaatgtgatacaccatgtaagtagaattagaaacataaatcacatgattatctcaatagatgcagagaaagtatttgacttgcaacatcactttatgatt

SEQ ID NO: 230730 - DNA, 367 bp, Homo sapiens
ggattcacagctgaattctatcagaaatttaaaggagaattggtaccaatcttactgacactactccacaaggtagagaaagaggaaaatcctccctaaatcattctaagaagccattatcaccccaacaccaaaaacaggacaggatataaccaccacaacaacaaaaactgtagaccaatatacatgataaacatagatgcaaagtcttcaacaaaatactagctaactgaatccaacagcatatcaaaagatatgcaagtcaataaatgtgatacaccatgtaagtagaattagaaacataaatcacatgattatctcaatagatgcagagaaagtatttgacttgcaacatcactttatgatt

SEQ ID NO: 230731 - DNA, 511 bp, Homo sapiens
ccaacgcaaaagaaaacctggtcacttaaacatttcaggagtgtctatgtgatgaaaacagaccaattagctagaagagccacatctattcctgatactaagattaaataacaagttctccactgcttcctcacaaaggagacctagtgagttccctggttattatccttaacatttgaatggcttcataatcatgaaagttagataaagaacagaagctttaaaaaaaaaaaaaagcttttacaggcatgagccaccatgcccagccagaatcctcttaatgtgtgaaaatcagtggaaagagtattccagacagaagaaacaactagcccaaagaccctagaagaaaatgaaatggttattttgagaaacaatgctagtgtggctggagtatagtgaagggtaagaaaaatggtataagataaaattagagaggcaagtgaggtcagattgcaattggtcctctgtatccatggattttgcatcagtggattcaaccaatcgtggatca

SEQ ID NO: 230732 - DNA, 543 bp, Homo sapiens
ccaacgcaaaagaaaacctggtcacttaaacatttcaggagtgtctatgtgatgaaaacagaccaattagctagaagagccacatctattcctgatactaagattaaataacaagttctccactgcttcctcacaaaggagacctagtgagttccctggttattatccttaacatttgaatggcttcataatcatgaaagttagataaagaacagaagctttaaaaaaaaaaaaaagcttttgtaggctgggtgcaatggctcatgcctgtaatcccagcactttgggagaccgaggttggagggtcactttagcccaggagttcgagaccagcccgagcaatatagggagaccccatctctattaaaaataataataataaatgccaggcctggtggcatgcacctgtggccccagccactccagtggccgaggcaggaggatcacttgaacccaggaggtcaaggctgcagtgaaccgtgatcactgaaacgtgatcaccactgcactccagcctgggtgtcaaagcaagaccctgtctca

SEQ ID NO: 230733 - DNA, 562 bp, Homo sapiens
aaaaactccaactcacagccagcccacaggaagggtcccagccagctaagcccagagccaaagcagcaagaacaaacaacacagtaatccccactgaccaagcaccactgcatgcctgacactgtgcacatgaccaaacctgattccaatcctgtcacaggtcaggctacagaggcaaagtggggctgacccatctcctgaccaactctatgtcattgccttaccacgagccctgagaacagtctaaacaggccctgatggggccaagggaagaagagcaccttgacttcccctaaggacaggccctcaaatcccaggacagaaaaactcaatgctgtacagtccaggtggcagcagggctagaagtcaaagcagagatggggatcccagtgctcctcctgctagtctggttacctggaataaatgtgcctcagctttctaatgtatctcattaggcttattctaaggactaaaagaagaacaggccttgagcagggcttggcctacagtaaacaccatggaactgtttttaacgttaaaggccaactcttcccaaactaac

SEQ ID NO: 230734 - DNA, 2784 bp, Homo sapiens
gttctgtgctttgaaagcttttatctatttcagatcataattttttaatggcagccctttctaggatgctttcggcagaaaaatgtactggcaaaatcgtctcctgaaaagatttacgatgagacacataaagtacattgagtagtatagttattcttaaactagtcataagagtattaactagcaataaataataaaaaataaaccagaggtaggagaaggtatggtgatttcaatgtgagttgcttttggatttatgatttcttggtttctgtgcctaaggaggcatggatggtattattttcttttcttttttttttgagacggagtctcgctgtgtcgcccaggctggagtgcagtggcgccatcttggctcactgcaacctctgcctcccggattcaagccgatttcttctgcctcagcctcccgagtagctgggactacaggtgcctgccaccacacccggctaattttttgtatttttagtagagacggggtttcaccgtgttagccaggatggtctcaatctccttacctcgtgatccgcccgcctcggcctcccaaagtgctgggattacaggcatgagccactatgcccggcctggatggtattattctttttcttcagttgctgctgaaatctaaaaaaaccaggtttttcaagtccttatgtgttcgtgtgtgaaactttgcttgtacatacaaaatttttacattgtttaactttactgcatgcagtttagtttgccttttccttttaatataacttaaaggtattctcttacgaagtggagaactgttctgtggactgatcagcagtgggtttgagcctgtaaatcgccactgcactccagcctgggtaacataatgaggctttgttgctttaaaaaaaaaaaaagtggaggattacaggcatgagccaccgcacccggccacctggggaatcttctaatagtcttagggcagcttagctggcctggacccacctcccttgccacctgccccctgcaccgactgatcatgttcagtcacccaggagatgatggagaggctgatcaggcctcctggaaagggaggaagagggccctagttggagagatccatcagcagaagccagggaggagatacagacccttgctccctgacgctcctcagggctagcatggggcaggagtttagctgggaggaggcggaggcagctggcgagatagatgtggcggagctccaggagtggtacaagaagtttgtgatggagtgccccagcggcacactctttatgcatgagtttaagcgcttcttcaaggtcacagacgatgaggaggcctcccagtacgtagagggcatgttccgagccttcgacaagaatggggtaaggcaccctgaagggaaggaccagtggccagtccacctggcgccttcctccacaagtgtcctcagggagagctcccagttccccactcctcggctctttctctgctcttctttccactccgtctctctttaccttttctgtctcactcaccaaacccttctgtctcttctcttccttttgtccctttccatcttctctgtctctccttccctccctccatctcttagctgtcggctgatgctccctgtgtcctcttcttgagagctgaagggcgactggcagacagtccaggtcctctctttgtgtatttttgaccaagactctgcagcccaatgaccgggttttcgcatctgccagagcccctgtcactctaaacactaggagcaaaagagatgttctaaatgagacaaggtatcttagcatgggctatgagctccctcttgttggggttcttctgagactggtcagatcctccctgtcaagaatgctggaagaggctcctgcatgtattgggagactgggcgaatgactgcaaaagcccctttcagctcttcaagtcctgaaaggtttcattaaatcattcagactagagtttctctaagcccacaatgtcactagcagctaagaagataacacatcttgtaaatgcaccaggggattgaattttaaatttcaattcagttaaaaaccccttgattatttaaggttatccagttcagtgccctggcaatcctcaaatacctcaaatacctcaaatgccctggtatttgcctcaaataccaatttaatccgaagaaagtgtcagttctccattcctcagtgcgtggagaacttagctttctaagctgaatcactgggaatgccacttcaggtctcatcctgtcgctggtaccagtcagtgcacgtccccacagtgcctgtcccgggacaggagggtgaggtcagcaccttcaattcaacagaacctccttagagatgaaccccatcgaccaccccacagggcacagagccagtttcggacttctcagcgctccgcctctcttaggtctcctctgagtcagcagcaaccctgggtgggaggggcagacttttgttattccaaattaaatgatgagaaagctgggcaaaagggaatgaatcgatttgcccaaggtcttaagtgctcctgcctagaaggcaggttttttaaagagagaagatgactttttaaaataattgatgatttttttaaaatgtaagaaaagtaaacaaatatatcaggtcataaataataagactcatttaagtccatcaatcttccccagattcatctaaaaatcaatacgatcatgattcaagatccaaagggctgattaagcccctaggcatatagttgtactccagtctgggcaacacagtgagactccatctc

SEQ ID NO: 230735 - DNA, 427 bp, Homo sapiens
caatccgtgaatctcaaggatttcaaatagtgtgagctgtttgtattttaacagcaatggtaacaataaaaatatcattttaaaatccagtgcactgcttgttcagtacatactatatatattcatcatttctttgccttgtagctggctactcagaaactaaaaagttgtaggttgattttctggttttgttgtttgttgttgctgtttgtttgtttcatttaatctctctttgaaacattttccagacttaaaaagtaaaatttctggagttttaaaagttaagactgaagttattgattattctctgaaagggtaactgacaaactagttaataattatacagatagcaagttttaccgtttcatcttgtgtacacgaccagattaacaatggcagggaaagcacacacaacttggcagggaca

SEQ ID NO: 230736 - DNA, 480 bp, Homo sapiens
tatacttctgtaatactgtgaaatatatatatttggccttcctcctcctcttgacttacagcttccaatacccttggaaactctggagtggtaagtgtcttctgtatgctaatgggataaccagagacagcttcaggatggggactggtctctagtaggaccaaggcatgactaaaggatcaggactttcaaccacccactgttacgggacaggggctgaaggttgagctgatcatcaatggccactgatgtaatcaatcatgcctacacaatgaagcttccataaaaaccacaaaagacagagtttagaagagcttccagatagcgcaacactatctgaaggttcctggaggggggtagatgcaccaatgccccttcctgcatgccttgccctatgcatctctccttcttccatctggctgttcatctgtatcctttgtaataccctttataataaactggtaaaagttaagtgtttca

SEQ ID NO: 230737 - DNA, 186 bp, Homo sapiens
ccactttccaaaatgaactttattttttaacctttcacatggcagaacttatacagttaattagcttgtgagcaacacagttaaaaactgtttttccaaacttaattttgtatttcaggtgcaaagctatttgaaaatttaagacagagtagcatggtttgatattagtgtttatggcgcttttta

SEQ ID NO: 230738 - DNA, 284 bp, Homo sapiens
ccgtgcctggccgccattctgtctcttaatgggcgtgcctaggaagttgtttctccctggcacccgcattcggttaacactttagtggaacaggtggggaccattaggaaatagtctctccctggcatcagctcccaatttatcacttttaagaggcaatgtgataattgtcaaaccatcactccaagttcctagtgggtgggggagagccctctcctgccccacccatgcctgtctaactacctgtagcgagaggagttcatgactttaaacatctagtaaag

SEQ ID NO: 230739 - DNA, 349 bp, Homo sapiens
cttgactgcctagcagtatgtgacgtgagagaaatacttgactttgctgctatgtcaacatgcagaacgtgagatgtttttgcttcctaccgtccacctaccagattgaccatccctctcatcatggaaaaacatgcttaattttcccccaataagcttaggctaggatagccaacttggccccctcttaggtgcaaagactccagaactttggaaactaccctatttattagccccaaactcttactaccccttctcatctttatcctcacattaaaataacttacgttcataatttatgtgttttaatggaattgaattcaacaggcattccacaggctttttctgg

SEQ ID NO: 230740 - DNA, 472 bp, Homo sapiens
taccgcactgtgcacgtacaccctctgggtatcttccaggtgcctttcccagctgagctaagggcaattgaaccctcccaactattcagaccaaaatacttggtgccatacttgccttccctttcctttcacatcccacatcgaatcagtcggaaaattctgttgcatccactctccaaatatgtgccaatccaaatctcttctcaccccttcctgctgctgccactataatccgagccaccattctctactagattacgacaaaacctctgaacaagtctccctgtttccactcttgtccttctacaatccatcctcatccaggaccatggggatccttttaaagtataaattagatcacagcattcctccgctcaaggggtaaaagccaaactccctagagggacccacaaagcatatcacccctctggcctcgttattacttctctgtcctcatctcctgctgcttctc

SEQ ID NO: 230741 - DNA, 510 bp, Homo sapiens
attcccttagcctttcccatagtgtgtttcaaatcagaagggaaaggaattggttttctggaatgtgtaaaagatgctgaaaccatattattgtttagagcctgctttggacataaacccagtaaaatttccgtataaaatcttggcatttcctaaaagatattaagtctccattggatgtcttagatctctccagtcttgttaatttgagctcatcaatgcactagtaacccttgcctaacatctacttgcttctgtcatgccaaaagatgctgggagaagaggggtgacaatatcctacaaagtgtcctcagggccaagggtcctcaaccacacagtgcattcccagaataaacctaatagggtaatgtattatctttttgagatgtactggattctattaatgtttggtattattttatttagaaacttttaacttataagtgccattcatgtgtagtttctattatctcgtactacctgtactaaagttattctagatgcatggga

SEQ ID NO: 230742 - DNA, 385 bp, Homo sapiens
tggggaatagtgggctggttctggtcctgacagtccctttggtacattcatgtgtggactgagaggaggctccagtgttccagggagtgtggggctaggctggggcgtgtgatacacactgtagagcacctctgtggggtgctaagagccctgaagagagtctcctgtgctagagactgtgtggcttgctccattcctgcccgagggcagagtcttaaattctgcatcctggcctagaacttttgcagacacactggagactcatctgaggttttagaactgaaggtaaagagatgcaatcttacagaatcacagagcattagaatgaaatgagagggatcctacagatgatctaatcaacaccattattctaaggatttgtaaa

SEQ ID NO: 230743 - DNA, 539 bp, Homo sapiens
ccacattattgcatacaatttttaaaaagatacaatttttcttgaaaaatcctcgctttaatctttattttacccatttctttattcagttagtgtttattgagttctgtttcatgccataatgctgtaccacattctgagattagaacagagtacccaccttcatgaaatttcacagttgattaggaacacagacttgccgacatgctgtaagaaaataggggttccaatggaagtgcacattctaaagcagttggcctgcaggggaaggagattgtgtatgaaataaaatgatgctgtcactgtataatttgatagttatttaaaaactgctccctaatggcatggtttggtgaggctacttaagcgtcagtggcactatactggaactgggtaactccctgactccagactcgcatcaatttggagtcactctaacataaaaaatcatcaggttttgaaaatattggatctttgtagcctcacgactaatctctaattccatgaattaaaacataaggctcacctaaaaaaaaaaa

SEQ ID NO: 230744 - DNA, 646 bp, Homo sapiens
aggtaacaaagtagaatatatacattattcagtttccggtagcacaaatgtgtgctttcttctacatggcattttttaatgaaatatgttgagggtatagaagtaatagagaaggaaatccttgaagtagtatgctattgccttgaaaagtaaggttttttcattgtattctcaacttttacagatgttttaaaatgcccaaggtatttcatttattcgataatgaatactacacatgaagaaagtctgcatgtttgcttcttcgaggattttctcccaaacaagtactatcttgtacaccaactgcaaatatacattgcgaagctctacataaagagtattgtctgggccaggcatggtggctcacacctgtaatcccagcactttgggaggctgaggcggggcagatcacctgaggtcaggagtttgagaccagcctgaccaacatggagaaaccctgtctctactaaaaatacaaaattagccatgcatggtggcgaatgcctgtaattccaccaacttgggaggctaaggcaggagaatagcttgaacccaggaggcagaggttgcggtgagctgagattgtgccattgcactccagcctgggcaaaaagagtgaaacgctgtctcaaaaaaaaaaaaaaaa

SEQ ID NO: 230745 - DNA, 605 bp, Homo sapiens
tcccgagccttttgatttcctgttgttctgtgacttacttagaagggaagtgggcaggagagttctctgcagaggatatggagaaatacaggtatttcaagtgctccttgtcctctcctcagtcaccacacatgcacagatagcactcgggcgttctcacagagttggagcagggctcccctcaatgtggaaaagggttttggttgttaggtggaaagagagatccttagaagaaaaaggacagatgaatacctaaaaccagaaagaaggggaagttgacctctgcgtaggtttctcatgttgttgggaacagaagaatgcaggtcaattatctgagccctgtggctaaactcaagtcactttacttcatgtctgttagcagttttaaaacagcatttgtgtactatcttccaaatagaaaggccccaatataaaatgacatgtgaatatgctgtcttccttgaaactttttctggaaaatattttatgaactaagataagttctgtcataagagaccagaacttggtactcccatttttggatcgatatgtttatcaatgaggtaattttgtgtgcccctgcaagactaatgagccagaaagct

SEQ ID NO: 230746 - DNA, 412 bp, Homo sapiens
ctcatgctcacttgaggtgttctttccttaccagtttagcattcctagaagaagttcatttagcagtgaaactctgccattttgcctcctaatgcacatgcttgagtccacttgcctaactcctgagatcttatcaggaagcttatgatcaggttttttctacctattggaagcctacctttccctagtgccggctgtgaccaattattattttacagagaccgttaacaatcacctgatcatcacctgatgatcttctgagattcccggtgcggggtgcctctcctgccctgttcatgcctgactacctacctactgtaacatacctagtagtgggattgttggatcatatgttagtactattttagctttttgggtaacctctatactgttttctatatgatgtactaac

SEQ ID NO: 230747 - DNA, 282 bp, Homo sapiens
aaccaacatggtcttaacttgaacgctctaaaaggaataaaatggtttcttttattggtttatcaattcatagcctaaaagaggaagttagcttgtcgcctgggcacctgtgtaagcccttgctgctccatgtggaagattcatgctttagaacacagcctttctttctttctgtagattcggatattatagggagacagaatctagggctgtggctggtgacctacttccttcttatggtgaagaaggtcagggagagagagaaaatgaggaagggagaag

SEQ ID NO: 230748 - DNA, 460 bp, Homo sapiens
agtcctaaagtaaatcattggaacacatgtagccagtttgttgtttttaatatgccaggtatcaaaatataactgaagaaccaatgctaaactgacttaattttaaaatgttgtatggggcatgaaaatgattgctctggctgggcgtggtggtttacgcctgtaatcccagcactttgggaggccgagccgaggaaggcggatcatttgaggtgaagagttcgagaacagcctgggcaacatggtgaaaccccgtctttactaaaaatacaaaacatagccgggtgtagtggcacgcgcctgcaatcccagctattcgggaggctgaggcacgagaatatgaacctgggaggttcacattgaatgaaccagcttgaacctgggaggcggagggtgcagtgagccgagactgcactactgtactgcagcctgggtgacagagctagacctgtcttaaaaa

SEQ ID NO: 230749 - DNA, 349 bp, Homo sapiens
attctgtgtgcactcagtggtatccttgaagaggttactattcctggcatgaacattacaattgaaatgtgctcttctgtactcctcttcatttgtgtgtaaaactcacaaaagtgggtctttcatcaaatttaaagaaataaaaatattataaagacagagaaccagctgggtagcctgtctcatgttgagggtaactctggactgagtgggtccacttgttctggtttgaacacaatctctgacagacagctttggtagagagagatttatgttaggaacaggcatgaggcagatcttctgcatcatatttccatggctgatctgttgcccaagtggtgtatttggc

SEQ ID NO: 230750 - DNA, 483 bp, Homo sapiens
gtcaggcattctggctgcaggaactcgcttggcagctgtcagagggcggtaacctcaggggagcttggcgaccgaccctccctccaactcccgggggctgtttctctgcacccttggggatctgatgtgggctccctattccaccccacccagtctggtgacaaaggctgcgtatttacagaatctttcatcctaagagctcaaagagctccatcaccaggtgacaaccgcagttaaactcattttatggaagaaggctactctgaggagtgcaggcgtgggatccaggttacaaagtgggtcagctagggtgccaggaacacaacgtgggtccctgactgagggggacagtcttaggcatgcagagatttggccagactcttatgggtgactgtgccttagtcacctctgtcccccacacctattacagtacctggctcctaataaatgctcaataaacgttcatcgagcgacaaaaaaaaa

SEQ ID NO: 230751 - DNA, 620 bp, Homo sapiens
aatagtccctgtgtgggtctacctttatttaaatgatttttctgtgttctgaatattgtggagtcttctatttggaattattgttagaattctgaagtcccactttgggggaaaaaattattcattccagagccatatacaacctgtttctctttctgtgatttcttcccttcctacttcactttcatgagttcatcctatgtcatctttctgtccctcccaatgtcaaaggccctgaggaaagggcctggtgaaatggactctggagttagactgaggcccaacagcctaacaagccttaagtaaatgtgtgatctttctgcctgtttcatccaggtatcactaacttagtccatgttccagcgatgacctgttacttctacataacagaaaaataaccccaacttaagtacaaacaaaattcctagagcctcagggctagaactggccctcagaatatttttccttgtctttatttctctttgactgttggcttttcctctcctactacaggcagattcttccattgagtcaggaataatgaccaacaggatccctatgctcatatcaccttagcagtcattaaggaaagaaggattaggactgagtttctttctttc

SEQ ID NO: 230752 - DNA, 382 bp, Homo sapiens
tgcatcccaaaacattccctttgcatgcccccatccccccaccgtccatggaaaaattgtcttccatgaaaccagaaccggtcactggtgccaaaaaggttggggaccactgcttggtgggatggagctgtgtagtgtaagatttcatcatgctgctcagaatagcatgcaacttaaaaacttgtgaattgcttattttctggagttgttcatttaattttttcagattgcagttgactgtgcgtaattgaaaccatgaaaagtgaaaccttggataaggatttctgtaatcagttacatccctgccctcataacgcttaaaatttatcaaggactgtaaactcaatgtttggcacataataggtactcaatctaagcaaat

SEQ ID NO: 230753 - DNA, 557 bp, Homo sapiens
gaacatgtcttagttactgagatgtcatggatctgtgcacttgccagtctgttgatgtggttgtgctatgaggaccaggactccctcccagcagtgttacaggtacatcctaccacctctgcattcatccactggcaatgtacatagagactgaacccacgggccctgaaactttaagtgtgtgagtataggtggaagccagaagatgagaacattttagccaccctctaaacaactcaccctctacttgccatgtggcctccacacaggtggagacaacaccctggtgggtcttgattagtcataagacgtggtataagcagtgtgttactgataagaggcacactactgagttcataaatgatctctttttgcaaaattaattggatcaaattcaaggttatccctataataatgtaaatctcacttgcatttcagtgttttcctgagcagaagaggaaagggtgggaaatgagcataaacctgaagtgtaagaaatttatgttgaagcccatagtgaactctactgctgaaccattaataaatgtgatcacaca

SEQ ID NO: 230754 - DNA, 360 bp, Homo sapiens
gtttgttcttaattctatttttctctttgtggcattatcacctaccatgcctccgaaatttgagactttgaatccctgcccccatcccccattccctggcatcatccatcactatgtcctgtctgtttttcctcttggatatattcctctttcctggtcttctaaccatttccctttctccagacttgaacctccagaactgcgatgtccagtgtggtagccactaaccacgtgactgtttacattaaaattgactaaaattaaaaagtcattgagaccagtctggacaacatagtgagtcctctgtctctataaaatgggaggatcgcttacacccaggaggttgaggctgcaatgagc

SEQ ID NO: 230755 - DNA, 354 bp, Homo sapiens
atgacatggaagttccatacagcccagagtaatttatcattagagactagctttacatttttaatttaatttctgataaattttatttaatttctgataaagtggggacagatacatgagttttaaaaagctacagacagattattagggcagtaaaactattctgtctgctactgtaatggtggacacatgatattatgcatttgtccaaacctgtagaactgtacagtctgaagagtgaacccttagcttgtgaagactggtattaataaatgaataaataaatatatatattggtttatcagttgtaataaatgtgccacactaaggtaagatgttagtaatgggaaatgg

SEQ ID NO: 230756 - DNA, 532 bp, Homo sapiens
acatatccttcatggatctagacacaaaatcctctttatttttttcaaaaatccttttaaaatttagcaaaatgaatacagtagtaaatacaaacaataatgcaccatgaccaagttagtttcatcccaggaatacaaggttggcttaatattttaaaatcaatcaatataatttactatactaacaggctataagacaaaacccatatcaccatctcaatagatgcagaaaaagcatttgacaaaatttaatacctattcatgaaaggaaaataaacctctcagccaattaggaatagaagggaattcctgaaactgataaagggcatccataggccaggagcagtagctcatgcctataatcccagaccttgggaggacaagatgggcggattgcttgagcccaggagttcaagaccagtgtgggcaacatagcaagacccttctctacaaaaaataaaataatttttaaagggcatacacaaaacacctacagctaatatacttaatgatgaaatcagaaagttttgcc

SEQ ID NO: 230757 - DNA, 561 bp, Homo sapiens
ctttcagagcaggagatgaggaagacagacagtaaatcacaaacatagcaaacaagtaaattacatagtttgctaaaaggtactggggctacagatgaaagaagggcagagccgggggattcagtgttgaatgaggaaactcaggtagagaacaccaagtcagcagccgacatctccagctggctagtaacagagccccattctaacttgggcaatctggccacgttcctgctcttcacctggactctgccttctctttcagttctgacgtgcgtcaaaccgtgcagcatgttcaaattcattcaaatccatcagtggcacagaagaacacacaaaatctggcaatacttccttgaactaaactcagtgtccgcccccccaacccccgattgatgccagacatttgccaccctggggacttgatctgagtgaccttgggttcataggagatgctgggcccttggaattgattgtctaccctgtaggaatggaggccacatctctgttctgcctggagagcttgtcgacgcggccgcgaatttagtagtagtaggcggccgc

SEQ ID NO: 230758 - DNA, 604 bp, Homo sapiens
tggaacccaggaggcggaggttgcagtgagctgagaacatgccattgttactccagcctggacaacagagtgagactccatctcaaaagaaaaaaagaaagaaataaacttgctttacaaattgtgataaactttaggaactaatataatatgtgccctatagtaaagtaagccaacgtctagaggtaacattgttgtgacataacaatgcaataagtatgcattctactgctgctatttattattcctcatttcccaatcttgcttttgtcctttttttatacgaatacatcattttgcctaattacataaataaatatcttcatttgtaaaattggagatctaataaaatcccacagatctcttccaggtctaacatcctgtggtttcttagtcttttcctcagatcactcagtatctcttcttcacagcaagatacccagcttgaattcagagaatctttaagtggtacaggatactatgcaaatgcaaaaaagtcactgtttgacagaggagaaatgaaatgctaataataagtgggcataattcatgacaaccattatgattctaatgagcgaatcatgatggcaaaaccaacaactta

SEQ ID NO: 230759 - DNA, 318 bp, Homo sapiens
ttctccagggatgagccaagcagctctagttcctcttacgtttttatcatgcatttaaaagagcgtcctcaaaaatcgtaatttcagttgaagcgggagaaagctcacggaatttggaagctgaagccttcaatccaaatccctcctctgccttttagtagctgtgtgcatggctctaaaggaatacctggggctgcgtaatttataaagaaaagaggttgattttggctcacggttctaaagtctgtacaggaagtgtggtgctggcatctgcttccagtgagggcctcaggaagcttccaattatggcgaaaggtg

SEQ ID NO: 230760 - DNA, 466 bp, Homo sapiens
ggctgagtggggaggatcacttgagtccaggaggtcaagctgcagtgtgccatgaccacatcactgcactccagcctgggcaatagagagagaccctcttttaaaaaaaaaaaaaaaggcttatagagtcagttttcatgttctcattaaatgtaagccactccaccaaaatgatctctgagagttgaggcttaaggctttataaggctgccttcctaaggaatgaatatcaaggaatgctccaggcggccaggacctcaccctccctgcgcctcctgcgaccacgctagaagcacgggatggtccctcgggttccctcatcaggccggccacctcccttttccactcagataattccttaattcttccaaccccgactcgagcatcacctcctcaatggcgcctcctgggctccttgggtggttatttgggtactatctggcttttgttttttgttttttgtttt

SEQ ID NO: 230761 - DNA, 406 bp, Homo sapiens
ggcggtttgtgctgagagctatgtaagcgcagcctggacgctggagggtagggtggttgctacctttaatcagtactatggatttctaaatgcatttaactgtggttaataaaagcgtgtatgggccgggcatggtggctcacacctgtaatcccagcactttgggaagctaagacaggtaggtcacctgaggttgggagtttgagaccagcctgaccaacatggagaaaccccgtccttactaaaaatataaaattagctgggcatggtggcgcatgcctgtaatcccaactactagggaggctgaagcaggagaatcgcttgaacccgggaggcggaggttgggatgagttgagatcgtgccattgcactccagcctgggcaacaagagtgaaactccatctca

SEQ ID NO: 230762 - DNA, 614 bp, Homo sapiens
tgagctaggaagcttttaaaaattacaagtaatcattcagacttagttaatggaactattcctcagagacagccagaaactcagcagggaaggagacttggtaaagagcagacatcctgtattctgtggaatcggtgctgaaaacactatttgatcattatggggaaagatgactcctaaaagaacagttggggacatctgatttggaaagcatttaagtcccaaaaggaagaattacatgaaccctggccattcaccctgcaagacagaaggggtaactcaatcactattgtatagggagtgtcaagctgttcttgactaccatggacaatctcatagaaggaaatagaaacagttgcaagtggacacaagaaacaactaagtatcactatgatgttaactgtttaagaaaggttgaaaattactggttctgaatggtaaaattcatctgaagtacaaaggttgagatccttgtgtccttccaaagttatttttctacagatcttaagcacaagttaaagttttatttacttcaggcaactacaagcatctattaagtttttttccctgtgccatgatcaaatattaaataaatccatacagtgaaacacaaa

SEQ ID NO: 230763 - DNA, 548 bp, Homo sapiens
cttacaactaaaaactcttctaccatttccactctatttactctgctgtagcagggagacctatttgctgtcccttaaacaaagcagatgtctttctcctctggtctttgcatttgctggtcctattactgggagtgttctttttcccatcctcttgatgacttccctcatctccttcaagtcctcgatggaatgttcttacacagtgaggacttccctggcaaccatatttaaaacagaatcttcagtcccatgtccagcactctttatgcaccgtccctgttttataatagtttgagaaaatgagtaagtgttttggggacacagcacttactatcatctgacatcatgaggcataaaactgtatttcttacttattttatgtatttgtttgccttccatcataactaagcatttagtagagattgtctattttattcacaatggtattcctaattccttaaaagtgtttggtataaaacaaacatactttgagcatttgttgaataaaggaattatatgtaaaattatggtcaggcattattcga

SEQ ID NO: 230764 - DNA, 426 bp, Homo sapiens
aagactagagctcaaggtatcactctattaataactttattaataagaatctgctctccgaagaacaggctttctcataaaagttagatttgagcacatggctggaggcctaactaaagctcctgattgctctactcaacctgaatctgacctaccattggtgccagtgtgctgaggggagagagggagggccaggtaccttgcctcagcttataaatttctctggatggtgtagaagctggggctaccagagaatagctggcttaccccaaaggacagcttacctaggtgtgaggtaggaggtgcaaatgatgaggaggacaaggggtctgacttggaggcttgataacctccctccatagtaaaatgtggcccaagtagtgctttgaactctgacttacctgataactattcttcctacctgtg

SEQ ID NO: 230765 - DNA, 552 bp, Homo sapiens
tgcaagttattttaaattcattcaaattgtaaagctaagtatatgctgcttagcattcttagggggtggagttttataaagtcacacaaattgcccaaaataaatggagactcattgattttctgttatttaaaatattcccagttaatcaatgcatatgcttactattttgtatattgagtgtacttagaaaaagaatgcatacttgtatctgttgtttgcaaaggagataattgtatgcatgctcagtgcttggatttgctaaatagaagatgcatgcttgtgagccaaaactcatactctgttgtcatggtttctcttaaggtatagcagcatttagtttttgagtcttgtggcttcatttatttcttgtcattatacttaattatgaatactccaaaggggtagttgagaaaaatgtagctacacttcatcaacttttatcacaagtgtttttaaagtttttattatggacattttcaaacttgcagtcaaatagaggaaatagtatatggaacctatgtacccataaaccatctttaagattatcaa

SEQ ID NO: 230766 - DNA, 568 bp, Homo sapiens
ggctgcagggtgggaggaaactcatcatttttattaaggagttgacaagaataggatcgcggcttgtctttgatttgcgttaagcagtaaaatgaagggataggctggagggctgagagcagggtggcagcaggtgcgtgcagtcggtatgcctctgctggagggagtggccaggccacagacatgggacaccacatagcagtcctcacactcctcctctgaggtcctcagggaggcatttgtgtctcgagactgtttcagagacccatgtcttctcaggagatgccaaggctcaggtcagagacttgttgagtttttaagagactgtctgaagcacacaccctgccctaataagtcaatatttctgttcctcctggagacctcacattccaaagtgtggtacttcgggctcttgtaaatgttggaattcctaagactctctctggaggacaggtaagatgtcagtgggaacacacatacacacatgcacgtgcgtgtgtgcacgcacggctggcatgtccatggaaactgccttggcgtggaatgagcagggctgcctctcaatgag

SEQ ID NO: 230767 - DNA, 659 bp, Homo sapiens
tgatgaggtgggttgagttaaaggaattaaactagtagaattataatgatgataactaaaaagggatatacggactttaaaagttgattgttttacattaatgaacaatttgatttttaaagtggtattcacattttaacaaaagagcaatgaaatgaaactaaccagttttacaaagcattggatgccatgatgtagaagttgaaacttttactcaattttaaaatattaaaatggtttaaatgtgtgaaaacagggatgccaattttagagcataatgaaatatattttacacaacattttctcttaagacaagaataaataatattttcttattcataactttattatgcactgcaaatggtgctatgattgttttggggaaagagtagtagctatcttggtatatgatatgcagtctggcatattagacattttcaagttacttttgagtacagtatttttcagtgactaacatgtacattctcaaaatcatatggctttaatgcatactctttggccagaagttttactcctgggaatatattctaaagaatagttcaaaagaagaaaatagctctttgcataaaaaatgtgtatagcattgctgtttatgatagcaaaaaaaaaaagactagaccaattctaacttcaaaact

SEQ ID NO: 230768 - DNA, 418 bp, Homo sapiens
cagttttacccaccatggtttttgctctatctgagcaaacgctaacacagtgccacagaccggtggtgtcttagcatcgtgaaaacagtttcaacctgtggacttggtgacatggtctgagggacacgcaggattctgaggtccacaccatgagaaccgctggggaaggcgattctaacctcatctaacgcagtctggaagactcgaaacacaccataaagacagtgttcattttcttctccagcagcggagttcacttcaaggcatatgtccaattactgcatgtaacgtgagtggacagtcagtactcacagcaggcaaagccacaacacagcttacctcagtcattcctagttctgcagcctcactcagagagcctgactcctgaaggtgctttgggagacactgaactttagat

SEQ ID NO: 230769 - DNA, 448 bp, Homo sapiens
ccgtgggatagggccacgcagaagcagggcaaggtctgacccccgctcctgacagctcccactggctgctgatggagagcaaagccacggtcagcgcccactgctggacgctgcagcagggatggcagccaggggggcccccaacagcttagggctgctctgtccccctggagaggtctcactacagccctttcctttcccccgtccccactcactggctgcggaaacccagcctcatgagttctgtttgtctgaagaagcatcgttgggaggaaaaattatcaaactaagctcatgctatcagtcaggccctcctcctactccgtatgtctttatttttttactgaaaaaaataaaatacagtaagcactcggatgagaatattaatccatggagattgcccccttcagcattcactgtatgaggcctttttatatttgctttttta

SEQ ID NO: 230770 - DNA, 150 bp, Homo sapiens
gcccaagtacatatacacaggtcctgtatataaaagatgcagtaaaaacagttataattccaagctgagatttcttaaagccaccacagattaatttgctatacatactttgaactttctctaaaacccaccaaaatggttgcgtttgtg

SEQ ID NO: 230771 - DNA, 280 bp, Homo sapiens
tcccttccatttgaaggatttctagattagtggttggccttgtgaaatagagaagctttccaaagaggggaagaagaggggctagcctttgccatcttggatgagtggtggtttttatacagttgttatacagaaagcacatgtaaatgtcaggggtaatcccaacacctagggatgatgctttttgttggatatccttccagtcttttttccagcatatatatttatctactggaaggaaagcagatgaataaacacagaattttgtgcagcaggtgaa

SEQ ID NO: 230772 - DNA, 673 bp, Homo sapiens
gagaggggagaggggaggggagagggagaatttttgtatttttagtagagatagggctttaccatgttggctaggctggtcttgaactcctgacctcaggtgatccacctgcctcggcctcccaaagtgctgggattacaggcatgaaccaccacatccagccagttccatattttttaatgagattataaatagtattggattttagatttcaatttgaataatttattcttagtatatagcaatacagttgatttttgtatttttgcctaatatattataactttgctaaattaattttagtagcttttatgtagtttgcttaggattgtatatataggtgatcatgtctgtgaataaagacagtttaattccttcccttccagtcagcataccttttttttcttgctctattgttatggcgagtacttctagtacattgttgagtagacatctttgttttgttctcagtgttcggggtgaatattaagatgttatgggtctgctgatctgctttgtattagtatagtattgtttctagaatttcatataaatcccatgtaatcataaagtatgttgtgtcagcttcttttttttctttacgtatattttgttgctgttgttgtgtcatacttcttttgcttagtctaattccctgagattcattcatgtt

SEQ ID NO: 230773 - DNA, 664 bp, Homo sapiens
gggtgtgctgggtgatctagaggatccacgtatatgtagcagagtatgatcacacgcacacgaacattagatcatctaagaaatgactggtgagtgggtcacgctcggcctcccaaagtgctgggattacaggcatgaaccaccacatccagccagttccatattttttaatgagattataaatagtattggattttagatttcaatttgaataatttattcttagtatatagcaatacagttgatttttgtatttttgcctaatatattataactttgctaaattaattttagtagcttttatgtagtttgcttaggattgtatatataggtgatcatgtctgtgaataaagacagtttaattccttcccttccagtcagcataccttttttttcttgctctattgttatggcgagtacttctagtacattgttgagtagacatctttgttttgttctcagtgttcggggtgaatattaagatgttatgggtctgctgatctgctttgtattagtatagtattgtttctagaatttcatataaatcccatgtaatcataaagtatgttgtgtcagcttcttttttttctttacgtatattttgttgctgttgttgtgtcatacttcttttgcttagtctaattccctgagattcattcatgtt

SEQ ID NO: 230774 - DNA, 368 bp, Homo sapiens
atcactgtgccctgggaaatgtgcagctctcttagcccaggcctaaacccctccctcccctgaattgagtggagagagcgcaggtcagctacaccactggtctgggagcagtgggaaagggattctccagcagaatcaggacaacatggccaaaagaagtggacgttgggcggctatgctagttaagacaaggcatggctgggccgggtgcggtggctcacacctgtaatcccagcactttgggaggccaaggtgggaggatcacttgaggtcagggatttgaaaccagcctgaccaacatggtgagccaagatcgcaccactgcactccagcctggcgaaagagcaagactccatctctaaaacaaa

SEQ ID NO: 230775 - DNA, 465 bp, Homo sapiens
tatgtaaagctactagcacagagcctggcacatgtttgtttaataaatgtttgctgtttgatgttaaatgaataaatgatgcgggatttatgtttttctttcatggcaattcagtcaaaaagggtaatgggattattttcacatgaattattttgagaactcatgctgtctctgaggggtcattatatttaaaattgcttataggttaaatatttttaaaacaaagcaaatccattctagtgttttcactgagatctacatttccggaattcactttcttttttttgttttttaattgtgacatttgccatactttggtgttttagtgtggctctctttttccagagctgctccaaggttactgatagttacggagtaatcctgtacgtaagctctcttaacttatatagagtccccaagctctcgtgtgatttcctcgctgatttgaggctttgataaacttgg

SEQ ID NO: 230776 - DNA, 406 bp, Homo sapiens
cgcctcccggtttcaagcgattctcctgcctcaacctccctagtagctggcattataggcacccgccagcacgcccaactaattttttttttgtatttttagcagagacagggtttcaccgtgttagccaggctggtcttgatctcctgacctcgtgacccgcctgcctcggcctcccgcagtgctggaattacaggcgtgagccactgcgccccgccccgctaatttttaaaagaaattttgtagagacagggtctcactatatttccaggctggtctcgaactcctgtgctcaagcaatcctccgacctctacctcccaaagtgttgagattacaggcacgagccactactcccggcagtccagcattcttaatagcgcaccacaccttaaaaagcacaccctt

SEQ ID NO: 230777 - DNA, 470 bp, Homo sapiens
ggggtttgccaatctttaaatacctctctggccgcaggcaaggagtgaagccaagagacccagagatggctccctttggttatagtggctctccccagacagatctgaccatctatccctagttctcaggccaggatagtgatatctcctggtgtctgggctggccacgtgggccagtgcgcaagagacaaaaaaagtcagcagtgtggcaccaggctggtctggtgatgccgggaggctgggaagtgccggtttgaaggcaggaacaaattactctcctggagacaaggccaggccagttcctgccgtgttacattattaaatttgtaatcttcattctaatactttccagcagtgaataagaaccaaatttaaaatgccggctttatatttctggaacgaagctctttgtcaagaactcttgaagcccataatttctctccagaggtaaatgtctaagtctttaaaaa

SEQ ID NO: 230778 - DNA, 466 bp, Homo sapiens
aataggttcattcctttaataacaaaatttcatttatgagggcacagtagcacccagaacaaattttgattttgcaaaccaatgacctttttatggttctttagaaatggaagtcagctgttgcccagaagggttggtggcatggggacttagaaagccatgaagtttgagcgccgctttctaatgcctgacctgatgtttgtggctgcacttgctgtatgtcctcaggcacaacagctattagctttgttgtgaattttagagggagtcacttgttcaggcaatggatactgcatatgtggcactctttgcaggtccagctgggtgacatgctgagaacaaccaggtgtgctccccgagctcatagcacatatggtcaggtggataaaacaaccttgatttcaaacaaaacacccaaaggagtgcatgtgtaatcacacactgaaggaagagctccgaaggaaaa

SEQ ID NO: 230779 - DNA, 536 bp, Homo sapiens
cttccaaacttgtacatgtccttacccatccaagatcttgtaaccgtaataggcttgtctacagacttccttgctggaatgtgttcttgttgttgaaggctgtattctctccagtcctcactaggaatcttggataacaagggggttatcccagaaggcagcctctgcacattgcagaggaaatttaatgtgatctatggcttgagaaactgaactgaaaaacaggaaaggcaggctgggcgcagtggctcacgcctgtagtcccaagagctgggattataagcataagccaccttgcccagcctgttattgctttaatagtatagcaataataataataataataataataataacagggcaggtttctgaaatccagccctcccagtagcctgatccccttgatgtgggggacctctccaggtctccagggatgagcactagactgacatgctggggacctcaccttttctctttgtatgtacatatatgtataccattgtgtttattacaaatgtcatgcatatttactgtag

SEQ ID NO: 230780 - DNA, 1542 bp, Homo sapiens
tctattattgatttcttatttaattttggtatagccagagaacaccatttatgtggatgatctcggctcaccacaacctctgcctcctgggttcaagcagttctcctgcctcagcctcccgagtagctgggattacaggcatgtgccaccatgcacggctagttttgtatttttagtggagatggggtttcaccatgttggtcaggctggtcttgaactcccgacctgaggtgatccactgcctcagcctcctaaagtgctgggattacaagtgtgagccaccacgcccggccttgtgtggttttaatttattaaaaattgttaaagtttactttatgacccagaatatgatctatctgggtatatgttctgtgggcacttggaaagaatatgtattctgttgctcttgagtagagtgttttataaatgtccgttatattaaaccagttgataatgttatccaggttttatatatcctttttgatttccatctatttgtttatcagttattgagaacagagttattgaagtctcccagttatgactgtggatttttccatgtctcttttagttctatcaatttttgcttcatttattttggatctttgttagttgcatactatatttcagtgtttatcttcttggtgaattgacccttttatcattatgtaacttccctatatttatatctttatatttaaaatagatttccttaaaccataagacatttgagaagtaaaaataaaataaaatagctttcttgctgatagcatatagtcgggtcttgtttttttctttttccaatccgataatctttgtcttttttttttttttggaaatggaatcttgctctaccacctggactggaatgcaatgacgtgatctcagctcactgcagcctccacctcccaggttcaagcaattctcctgcctcagcctcccgagtagctgggattataggcacccgccacgatgcccagctaatttttgtattgttagtagagacggggtttcaccatgttggttaggctgggggagttttctattatttatttcttgtttaattttggtatagccagagaacatgctttatgtggttttattaaaaattgttagtttattttatgacccagaatatgatctatctgggtatatgttctgtgggcacttggaaagaatatgtattctgttgttcttgggtagagtgttttttgtaaatgtccattatattaaaccagttgataacgttatccaggtttgatatatcctttttgatttccatctatttgtttatcagtcattgagaatggacttattgagtctcccagttatgactgtggatttttccatatctcttttagttctatcaatttttgcttcatttattttggatctttgttagttgcatattatatttcagtgtttatcttcttggtgaattgacccttttatcattatgtaatttccctatatttatatctttatatttaaaataggtttccttaacatttgagaagtaaaaataaaataaaatgtaatagc

SEQ ID NO: 230781 - DNA, 449 bp, Homo sapiens
caataaatgagatttgtgtgagatctaggaaaggcaggacataccaggagaaagtgaagagaattcccaaggtacatataaggaaagtccgaggaaaacagccacatgcacgtgaaaagagtagccaacaggccccagtttgcctgggagtttccagttttagcactgaaagtcctacaccccgggaaacccctcaatcgtgggcaaaccaggatggctggccaccttacaccacaaactgtccatgcggagagcaggaaaaaagatggctccaggaacaaacattcagaaagaagaatgaaatacgttgaacacatcaagaattgtacagctgttaatagcactgggtttcatcttttgtttgtaacccattttgttttttatttcccatctttgttattttatctacatattgaattatgtgaaatataacatgattacaaatcaaa

SEQ ID NO: 230782 - DNA, 467 bp, Homo sapiens
acatggaagcaggggcaagactcccctgccagcgtggcagatgtgaaggaagaaggggaaaggcttaagtactagtgaagtttaattaattgtctcatatattgccaattctaggggtaggtagttcaaaggctggaatgggagcttggcagtgtcactagggagccacacttcctctgcctgtgagcttccatccttactgtgtgggctcctcatcttcagcctcactgctttgtatccagtcatcccccattatccgtgagggatacactccaagacccccagtgaatgcctgagaccaacaacagtatcaaaccctgtgtagactatgttttttcctgtacatacatacctatgataaagtttagtttataaattaggcatggtaagaaacgaacagcaatagctaaagataaagtagaacaattaggatggtacattgtaataaaagttatgtgaatgttgta

SEQ ID NO: 230783 - DNA, 548 bp, Homo sapiens
tcctttttttttcagcaaagcatttgtattggtccattctcatgctgctaataaagacatacccgaggctgggtaatttataaaggaaaaaggtttaattgactcacagttcagcacagctggggagtcctcaggaaatttacaatcatggcagaaggcgaaggggaagcaaggcaccttcttcacaaggtgccaggaaggagaagtgcaagcagaggaaatggccgaggcctacaaaaccatcagctctctgagactcactcattatcacaagaacagcatggggtaaacttcccccatgattcaattacctccacttggtcccactcttgacacatggtgattatggagattataattcaagttgagttttgggcgggaacacagaatgatatcatttgaaaacatttttggtataaattataccatcatattgtcatatatctaaattcagatgggaaatgcataattactcaaattaaaattgtataaatttaattcttgttatttccttattatcaatatctctaatgtatattctatatact

SEQ ID NO: 230784 - DNA, 424 bp, Homo sapiens
gtagaggtttgaagagatgcacacccagaagtcctcattccgaggagtggcaggtgcacgggtctttctaaatcattcaaaaagccagttcttcctcaggaattaatttttgcctttactgatgaaatatctttggcagcccacttccttctggccagccattacatggtgttaattcctttattcctctcttccacgctcacaccttgctctcctacctccttcctttcttcttccttcctccctctctcccttcctttcttttcagaagaattgatggttcagtgtaaaagctagtacagactgggcacagtggctcacacttgtaatcctagtgctctgggaggctaaggcaggaagaccacttgagaccaggtgttcaagaccagtctgggaaacatagacctcagctttttttaacaaa

SEQ ID NO: 230785 - DNA, 785 bp, Homo sapiens
tttttttttgtatttttagtagagacggggtttcaccatgttagccaggatggtctcgatctcctgacctggtgatccgcctgcctcggcctcccaaagtgctgggattacaggcgtgagccaccgcacccagccaaaactttattttcaaaaacagttggtggggtgtagtttgcagatctgatctagagtagtgttgcctgatggaattctaaggaacattactttcagggcatgttaatagctaatgtgaaaaaaaataaaagtgggggtaagggagtggcccatggtaaaacagattaggggaaaactgggaaaagtttactatagcactttccactaactttatttgtgagggagggtctcgctctgctgcccagattgcagtgcagtgatgcgatcctagctcactgcaggctcaaactcctgggctcaagtgatcctcctgccttagcctcctgagtagctggattataggtatgcaccaccacaccagctaattaaaaaaaaaaacaaaaaaaaaacaaaacaaaaaaacaaaacttgtagatacaggataccactatgttgttgcccaggctggtctcaaactcctgagctcatgcgaccctccagcctcagcctccaaggtattgggattacaggtgtgagccactatgcccagcctccactaactttaaaatgctaatgtgcaatatttttgcaatttttttcaaaatctcaactcaaagattactgtgtttcttaaaagcttttaaaaaatatatagggtcggccggctcaca

SEQ ID NO: 230786 - DNA, 472 bp, Homo sapiens
tcttatataaactaaaaattaaaataatagggcttgaaagttgaaattactccttgatccatgggctgcaaaatggatattgtgttagcaggcataaaaacgacactaataatctccttgtacatctctttcagagctctgggatgaccaggtgcgttgtcaatgagcagtcatatttagaaaggaatcttttttcctaagcagtaggtctcaacagtgagcttaaaatattcagtggtggctcatccctgtaatcccaacactttgggaggttgaggcaggagaatcacttgagcctacaagttggacaccagcccaggcagcataacaactttatagtttttattttttatttttatttttattttttttcgagactgagtcttgctctgtcacccaggctggagtgcggtgagctgagattgtgccactgcattccagcctgggcaatagagtgagactccatctcaaa

SEQ ID NO: 230787 - DNA, 494 bp, Homo sapiens
cgtctgagatcctaaagacatcagtggttctagtcaagatgtagctatgttgttttataaagaattaaaatttaccccccagatatgttaaacagtctaggattttttagcctgacgaagaaagggctgataattttctatgcctatattaagaacatgctggagtattttactctgttgtagtgctgcacagttccatcacagcacttacactggtggctgccctacgtatctatctccccaacttgagttccttgattgattgcaggggctgtagtttttacccgtctatccacatggctggtatattgcctgggccacagtgggcattcaataaaatgttaaatgaatgagtgaatgaatgcctgattcagtcagtcaatgaagtgaataaatgaatacacacagtggaagacacagatgatggaggatggaaggaaagccaatttgcattgtagcttgtcaacctcaaataattattttaaaaaaagaaa

SEQ ID NO: 230788 - DNA, 466 bp, Homo sapiens
ggagatacgataaaagtttttctgaacacattagcatttaaaatttacttactctaaaaataaatgacagttctttaaattgaattaattcagctttgtgaaaaactcattacattgttcttgttttgctatggaactgtgaaaaatttaacacggaccagcattttgtcgtcagtggtttactaaatcacctagaggccatttttatgctttgttttgacctatttacaagcaatggaactgtggtttgaagaaacagactcccttgaaaggagaaggtgggattataaattagtgcagtatttatcgagggccttctggaaacacatattaatataaaatgtgcatatccttagacccagcatatccacatccaggaatgtattctcatggaatgattggatgggttcacgggttcacagtgatgtatattcacagatattattccaacacagtttataatatt

SEQ ID NO: 230789 - DNA, 384 bp, Homo sapiens
tctgccagcaaatcctatggaaaaatacatgattcagtgtcagggtcaaagatgatggtctcataatgatatatagcttgctcagtaagggaatgggtgtgtatgtgttggaggggaccacagtggtaaatgctgagtatgagacatctcctgggactgtgaaacagagtaacagtaagatagaaagataaaaaatagggaggcaggctgagtggttgtggtggaagggtaagagctaggttagcaagatcatgccctccggatacaggtagcgctgccctgtttccctgggggctgaattctccaggccatggacaagaagaccgactggaactgtccttatgccagtgctaaaagtatagtgtagaagaaaggtggtgtttg

SEQ ID NO: 230790 - DNA, 441 bp, Homo sapiens
ggacagcattcttgttctttttttggaagggatgcccttgtcttaaatagcaatttttgcctgcagctaaaaagaatgattacagagatcttttgatttggccactgagtaaccccttaggagagttcgttgcagggaattaatttttgactgtttctttaaggtttgagaaactttgctagtcaactgtggacatcaggaggggatcacttaatcaacccctgggcagaggcagctttgctcacgtgtccttcagataatggcggtttgggcttaacttggttactgtctcagcactttttctatttctacatttatgtatctttcccttcacaatgttcttaagtctaaaaacacatcctgtgcagttctcacagggatttacagcaggtcttatttttgaaagatgggacaggcggagaggtagtgagcaggaaatag

SEQ ID NO: 230791 - DNA, 543 bp, Homo sapiens
cggccgcgagtccccggccctgcggccaccggcggaggcagaggaggaagaggaggacgaggaggtggtcgtcgaggtggtggacggcgacgaagacgacgaggaagacgaggacgaggagggcgggagcaggcggcggagggggctcgggcgtgtggaggagaagccccgagggggcgcggaggaggaggatgacgacgaggaagaggaggacgaggaggtggtcgtcgaggtggtggacggcgacgaagacgacgaggacggcgaggagcgtttcgtgcccctcggacccggccacgcagtccccaggggcccggcccggggcgcgttgaaggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagt

SEQ ID NO: 230792 - DNA, 419 bp, Homo sapiens
tatcaaaggtaaaacaacaaaaagacacaaaaaccctctgacttttcttatacctggctgccttcacttgcctaccttatctatgtagccctgtaggcatgttaacttccattcctgtaagtagcttttaatggccttgtgctcttttggaggggccaggaggaaatgatgagtcttagtgatctggaaacattccagactaatttattatcttctcttttttcccttcttctcccaactaccttttccccctttggttttaggtaaaaaacatcttttttttttcttgccaattccatagtttgggtagaaaaaaaaataccatttaattttgttattttttatatgcttatgcttttagaattagaatattcaatagatcatacaggcattttaataaaggaaatgtcactgtttca

SEQ ID NO: 230793 - DNA, 444 bp, Homo sapiens
ctggctgctttgggtgctggcaggagcaagtttcatgtgggccctgcgatggcacccaggttggggtgcctgcaacccctgaagccctagagggcatgttacaatgctgtcttagctccaccgtctgtggacagcggtgtgttaccagctcagtaggctccttgccttgttgcgtggggcagccgccctccactagtgagggcaaagggccagtgtgatagcctttatttatttatttattttttagatggagtttcgcccttgtcgcccaggctggagtgcagtggcacgatcttggctcactgcaacctctgcctcctgggttcaagcgattctcctgcctcagtctcttgaatagctgggattacaggtacccgccaccatgccccactaatttttgtatttttagtagagatggcgttttgccatgttggccaggctgga

SEQ ID NO: 230794 - DNA, 313 bp, Homo sapiens
catcacaaaaaaaggtcgctggatcctactgaaaatgcagcccctcagcacttcatctcaaacactttctcccacagcaggtggctgagggctggtgtgctgaaaagctcacattctgcatgcgggaacactgactccggagccatccggctctgctgcttgctggctgtataactttgaatgagtcccctagcacaaggcccagaaagggggaaccctcagggatctggctgtccccagccctgcccctctctcagactcgaccctgcctctttctgcaggttggctcagagacacaggcccccagggatca

SEQ ID NO: 230795 - DNA, 484 bp, Homo sapiens
tcatttgcaagatttcacacgttccctaattatttcaagaggacttgcagatggaggtaatgggcccccttttaagatgacttgccacacatataatgtcagggctctcgcattcatcagcgccatcctcccagcccccgtcctccacctccatcaccaaaaacccaaataatttcaaaaacatttttatcctaaaatgttcccctcaatttaaaaaaaaaattatcttcaagagaagagatttctttccatttcaatcccacaacaaggagaatgtcagcccagcttttttttgacagacaaattattgaatcaaagagaaaatgccattaagctcacaggttagcaagtgtcaggaatggtttaaagagatatccccatttatcttccaaacatgcacgaaatgtcactaatgtgtgtttatcatgtataatcagacaaagaaaatatcgaaataaagtactcccgcatacaatagaaatct

SEQ ID NO: 230796 - DNA, 345 bp, Homo sapiens
gtatgccttgtaatttttttgttgaaagctaaccacaatgtgctggttaaaaggaactgaggtaaataggcctttagtgatgtagtgctaaggtgtggtggggaggggaagcattctatagtcctaggattaggtctcagtcttttagtgagctagtgcttctgtgctgtgacctaaacaaatgcttcttagcttcccctcccccactcccaattaagtcagataagaagtatagaactggagatttcccttctcccacatggaaagctagaggtgtctaaagttgggtatttccctttccctgaattgggtaggcaggaggttaggctctggtaaaataatttc

SEQ ID NO: 230797 - DNA, 202 bp, Homo sapiens
cagtcatccattgcactggggttgggggtgaggggatgcctggaactgtcccagtgccaaaggcaccatgtcatttttttttttaaaggtgtcaaagggccactgcctcattattgacttgagacccagaaatagtgctgtgtgttcttttgatacatttatcttctgtttttctcaaataaagttcaaagcaacaaaaaaa

SEQ ID NO: 230798 - DNA, 461 bp, Homo sapiens
gaggaaagaagaaagaaagaggaaagaagaaagaagaagaagagaagaaaagaagaagaagagaagaaaagaagaagaagaagaaaagaaaaagaagaagaaataaacaaagtgtgccaagagctcaaaaggaccatacctgttggacgggattacaggcccttggacccatcctcatgaaaaagatcagtgtacaaacatttgcctcctgggctctgcatgactgtgcatttcagtagaatcacctggaggtctgttaacagtgattttttaaaaagcccttaaatgatggtcatcttctgttcaggtggctccacacgctgaggtcccacgtgcctgaaggtctggcccctccggttacatggctgtgcacctcctgggggcactcggggctgcgtttgctttcttcctgatattttctgttaaaaacaagaatcttacttcctctgttgcctaagctc

SEQ ID NO: 230799 - DNA, 494 bp, Homo sapiens
ccatgaagacgaaggtcctggtagctgaaggctactgctaaacactgaaacttaaccttcactggctactttatagataacattcatgtgtcatcatggtaatggtcatttcagtagtttttcaggaactggacccaactcctgtccggttcaaacctgttgagaccactaactcttcaaatgggcctgaacaagtgcccaagaagggggcttttgacatcagagagccaaaaactccaccctcagatcatgctaatgctgccattttctgtacatgtattttatggaatgccatgaaccctgattgtgcctgcacagaagggacctgttatttcactgttcctcactgccagtcacctttccccataccttagaccactccacttccctaacccataaatatctgtaagacttatatttggagaggtggacatgagagttgttctcccacctcctcacttggcagccttgcgaataaaacttttctcttttgt

SEQ ID NO: 230800 - DNA, 318 bp, Homo sapiens
atattagaaaatgaaagagaaatgttaccttaaaaaaacgaaatgttttctagccttctgacatttttccaattcatatccccatacaactattcttcaaagcaacacacagaattatctgcaagtataaaactactaaaaattacttctcctggggatgaatgaagagaatttctagttttctgaatattaatggcagaggaatagttaggacatgttcatttaaaactactctttttcactagagatctcaacaaagtaaataaagttctattctacctagaaatctccttattctcgctgaaaaaacatttaagg

SEQ ID NO: 230801 - DNA, 283 bp, Homo sapiens
tccccacagagaatcccaccctatacactgggggaaggaatggtgacatcatgaagcttccataaaaacccaagaggatgggttttggagagctgaacctgtggaggctgacaggaaggtgaagaagaactcgcatgtgctgggcggatggcaccgctcaactcctggggacagaagctcctacgcttgggacccttgcagacccacaccctatatatttcttcatctggctgtttatttgtattctttaaaatatccttcttaataaaccggtaagtgtgtt

SEQ ID NO: 230802 - DNA, 319 bp, Homo sapiens
cagcaagaaaaagaaactcactgaataggcttaggatggttttccttgccctgtgcaagaaatccctgtttttcagtttttctgcgtgccaatcagtttgggacttagaaatttggggcataaattctggattacactgaaggcaaaatttagactcagaagtaaagcatctttctccacacacacgtaaatatgtctctttggtgagcaggctgaccaaaggagaaaagaaaaagaaaaggttcactgaccttgacactgatgcttcaagcaactacaaaagaactccacaaatcatacccatgtccacgctgctgtg

SEQ ID NO: 230803 - DNA, 670 bp, Homo sapiens
ttagtaggccctctctcccctaagccctatggtgattcactgattttcaattatggcacagtaattgcaaatgacaagaaatgaaagatgggtttgtttgttataacaataaaaagtctgggaaatagactgtttggggttattacaacttggagaccgtttttaaaagcctcttgttgatttccctgtcttatttttttttagatttgactgaatttgagggagaaaagcgaaaccgatttaatttttattgctttgaggggacatgcctgttatttgcatctcatttcatttctgtgcaccagcctggtatccttgtgatctatctttatgtgctattgcttcatcaggtacatgccaataggctactgagttaaaatttttctcctttggacccatatctttatcacccttaaatcttgcctcaaacttgacttaatgtggtgtattctgggtggctcctttaagggcagttgagaatagtgttgggggatatgtttgtagtgatttaagtataagggttctctactgtcagagatatgtaagtgaggaaaggatacatggtaggtgaaaggatatctttgttgtatggaattgagatcatcagtagagacttatgttactgcattttgtcctgttcaaatgtctgcattatatattaactcatagt

SEQ ID NO: 230804 - DNA, 355 bp, Homo sapiens
tcgggttacctgctgcatgggccaggggtcagaaccccagcgaacgctgcctgggcccacctctccacggggctaccccttggaatcaaactgagactgtcactccctgtagagatggagaaactgaggcacgagcaggtggctggccccagattccacccaaggtgggccaccccatgtttaactgccgagcaccccttcttggcctctctggcccctcccacctgaagccaggcttcctaggaggcaagaagagtacggcgttctcagggccagggcgcaggccgggggccggggatgacgtgagcttatcagagaaggaaagacgaggccagtccaagaggcggcagcccgt

SEQ ID NO: 230805 - DNA, 150 bp, Homo sapiens
atgttatttgcctttttcactgtattatttacatagtggtacagaaatctatggtggtcacgtgaaactgttagtgcctgagcacaaatcaaggtggtgacaccaagctgtacaggtaggtcatgttcttcactgccataagcttacagt

SEQ ID NO: 230806 - DNA, 392 bp, Homo sapiens
agccccggggctgccctgtacagaccatgccctgagagagctgccccagggcaattccaagaggggcacagaactgtccccatcttccgctgctccctcaccgagtcacatccctagatgagcagatgtcactgcactcacacatgctcagttccctgaggacagcaccccaggctcttccctctctttagcctccagagtaaatgacagttgtgttttgtacaatggggcagctcaggtgattgaatgatgggagagcccttagctaggcatggtggtggcaggcgctggggcaggagaatcgcttgaacccgggcggcagaggttgtggtgagccgagatcacaccactgcatcccagcctgggcaaccgagtgagactccatcttgaaa

SEQ ID NO: 230807 - DNA, 518 bp, Homo sapiens
aagtcaccgcagcaccacgaggtggccatctgggcaggcccaggcagtctggcggccgggtgagtcccgcaccaggtacacgcactcgtgcaagcacacgtgtgacggcaggtctgccttcctccatcggaaaggaacgtagcgtctcttcgcaccccccaccccaggcgcggggcgcaaaagtcacaggaagggccgccagggcggcagagtccatcggaattgaaatcccgttactggtgtgtagagaattctacgtgggtgtcaagagcccctcagggcacgggctggcccgggtgggccctgcctttcccccaccaaggctaggggtggcttggcccctaggagtggagaactggcccaggccaatggggcaaggcggcggggaagtgagactcccccattctccgcttgaaatcccattcaaggaaactcactacgagtgaatacagattgaaatggaaactgggatcgctcgaagtctcttgattttaaaaagaagctcccctcccttgccc

SEQ ID NO: 230808 - DNA, 1092 bp, Homo sapiens
ggggtggggcgggggctggggaccagggagtccgaggtggccggggctgcgacggggaattcgagactgtccgaactgggcagagaagaagggccgaccgggagagtcgggcagatccgcaggtgacaggcacttccgactccagcagagaaggggacactgatcacggaaaaccttcggaggcaagagacgcggggctccccgggtttcacgttcggtccctgtctcgcaacccccgcgggcccggcagagttagttttgaatttatggcagcgctttgccgagcgctatttgggtaaacttcggtctccggcgggggtttccgtgggcaggtggtttgggtgttggtggtagaataatgcaaacccactttcatcacttttagcacaactaaaatgcagtcccatggaagtagctgtccccttcctttaaaaacgtccgtcagatgctccctgaccctcttctaaaaaaaaaaaaaaaagaaagaaagaaagaaaaaaacgtgtatatgttctttggtctgggaaatggatttttattagcattgggagactcccctggcgatggactacaggactgaaggagaacagctcaaattggcggtgtagccaccttactaattcaagagaaatggctgtggctagaaggtgtgattgcagggtgctctttagaaaggttttagaaggaagacatgtgttaactttagttagaggcgatgggtaactgaacatagataaacttactggtattccttaggtgaaaatgtgtcatctatgaccatttattggtatttggataaaaatctaatacatatttccaaactgtgccttgtgcaagtttttccaactcagttgacaaaataagcatatagatgattacatctacttccttcccaatagtagggaacttcttaaatactggagttaattgaacaccctaaaagatggggaggtgaaaatatttgcctcattcactcagtcttgaggctgggagatgtctactcattagcatacctgttggcacagcaggcctcatcatcatttaagtatccaaataatttgatttttgactggtatttattcatgatatgtc

SEQ ID NO: 230809 - DNA, 1137 bp, Homo sapiens
ctgcacagcccgccaaatcgaaaggtcctttcttttgagcaaatagcatcatacacgttgccatcaagaaaatgaaagcatttgcagtggcgcagcatccagcttctctctgtggcctttggaaacaattttgtgaccagagaatggttggagacaaaggtctttctatctgatctgctcaccaggctggcatgggatcgtggggggcctatgtccctctttcctggcaccacatggattgctatcactgcatttgtctcctctctttgattaggacaagacaggcaggcaggcagagggttgtatttcaactgcccttgactctgtttataatcacaaacatgaaaggaaggggaagagattgagtttataggactggttctttgtgtagcctaatttatctctctcaggcagcagtgggccgagcgagtttcctttttgtttccaatgcaggaaactgaaatatgaatctatgttgatgagagaataaaggaattgaaagaggcataaatcttatcttctcgcaaccctagaagatcagcttcttgtgaagaaggggattatacttctgtaattaactgctttgcagctcctggtgatggctcagagctgaataatagcacccagccaagttggataaaaggctgttggatgggcaggtgcggccgctcatcgtgaacaatggtctcagggcttgacatctttttccagtgccccgtgctcagagagtccaaccaggggatatttgttccctgtctatcaacattcacagcagagaataaaattccagaacaaatagctcaaagagacctgtttcactggaggccagtagctgcaatgagctgccttgaaggaccaacccagattctacacctctttgtgttccgaccagtgcccgggacctgttaggggcttatggaacgctggttggcagtgactgcttctcagccgctgtgctgtctcaggaaagttgcgtgagttctctgatcttcagagttaaccgtccacacaatgcaaggggttcttatggaattcttatgaggaagaaatcagatcatgagtgtaaacaaattacttagtacagtgcctggcacagggcaggtgatcaataaatggtagctattattattaaattgt

SEQ ID NO: 230810 - DNA, 378 bp, Homo sapiens
tgggattacaggcatgagcctgcatgcccggctaattttgtatttttagtagagatggggtttctccatagttggttaggctggtctcaaactcccgacctcaggtaattcacccaccttggcctcccaaagtgctaggattacaggcgtgagccaccacaccctgccctgagtattttttaatgactacaatgctatgttgaactcataagtagttttcaaacattttgaagttgaaagctaactactttcttataatgtatgtctcgctgtagaattatccctaacgcttgaatttttattcctttagcaaacatttaatgatcatcactatgtgccagatagtgaaatcatttcagaacttgaggggctcaagcc

SEQ ID NO: 230811 - DNA, 207 bp, Homo sapiens
tcagtacattatggctgcaatatcagtagagggtgaagctggaacttgaacacaggtgtgcccggaagctgtaattttgtcgttctgcagtcccagcttctgagatttttcagaagaaacctttccatcaggcactaggttctttcagaggatcctggggctgttgcaaccgagttgatcaacctacaaaaaggagaaggaatatta

SEQ ID NO: 230812 - DNA, 483 bp, Homo sapiens
ctgataatcaagaaggttaggaataaacaacacttcttcaatctgatcaagggcatctacaaaaaccctacagctaacatcacacttaattgtgaaagacaatattccccaccttcccaacgtcaggaacaaatcagggatgcctgcttttaccgcctctgttcaacattgtactgaaggctttagactgtgcaatcagagaacaaacagaaataatggacatccaggttggaaagaaagaaagaaaaatgtattcacagatgacatgattatttatgcaaaattcagcggactctacaaatgagctactagaacaaataagtgagtttgtcaaggttgcaggatacagagtagtgtacaaaaatcagttgtatatggtagcaatgaaaaattgataattgaaacaaaaaatcaacatttgcaatcacataaacaatactacctttgcaatagcataaatacctgggataagtctgaccaaaa

SEQ ID NO: 230813 - DNA, 389 bp, Homo sapiens
agtggctctttggagtagctgtatcttggatcttgatgctccaagagtgaaactgtttctttcaactatggagttcagatcttgagccaaaaatctttcagcggctggtacaaaaaaaatccgctgtaaaaccatttacaatggtaccagccagaaatgtgataacctgtgtacattcagatttctgggttacctgaatggaactcttacacttattacctagcacaaggcttggacaaacacaagtaccttacattctctgcatgaaagaatgagtagaagtaggattctggagggaatccaacctgacccaaatgtactttttactggaaaacaaaagcatttgaggaattgctgtgtctgtggatgatttacctgccaaaaatgaa

SEQ ID NO: 230814 - DNA, 579 bp, Homo sapiens
agtaggctgtatatgaagtctgttgtgttctagtgatgtatatttccacctcaatagatgaaaattcagtttctccacatccttgccaatacttcatattgtaggtcttctaaatgtgagttattgccattctagtgggtgtgtagtaatatctcatgtggccttaatatggttactgtagctttgtagcaagtcttggaatcatatcatgaaagtcatacaaatttgttctttttcaaaattgcttttggcttttctaggttctttaactttccatgtatattgtataatcaacttacctgttgctacaaaaaggtcttgctgagattttgaatctatagatcagtttgagagaattgacatctcaactgtattgaggtttccaaagtgtaaacatggcatgtctctccatttatttaggtttttaatttctctctgaactgttttgtagtttttagtgtatgtattttgttaaatttgtccctaagtgtttcatggggttgttgtatataatattgcttaacattttaaattgtgggaaaatatatacaaaaataaatgttaccattttgatcattt

SEQ ID NO: 230815 - DNA, 438 bp, Homo sapiens
gggttgggataccctttgcattgaataaactagcccaggatctcagtttgctgggggcggggctggagtggggatgtgccttctagatgttggcaccagtaaatgatcatcagaaagggctcaaagtttatatagcctttttccctagctatagtggctggcaggtgggaccaccccacgtgatagtttgaatttattgatatcagtgataacgtgaaacagttggcatgagaagcagcgtttaagaagtgtcagtgtttgtggtatggtgcaagagttgtttaaaagaactgtgtaaaaattgaggactgactgcctgtttacttaagaaagtgcatgataatttaactgcggaccatgttctgtggttagagataggttgtctttttagaaaggtgcttgtctctaccatctatatagtacacaatagttgctcca

SEQ ID NO: 230816 - DNA, 307 bp, Homo sapiens
tgagccactgcgcccagcgcagctttggttttatttgttttgtttatagtggagggttagacatgaaatcaacatagaagatgacgtaaacttatgactaagcctggtgtgggctctcggtgttctggggcatgagctagaggatggctggagccaggtagagaccgctcccttccttagaatgtcaccttgctgacaaggacagcgctgtgagcatccacaccttcctgtgaggtatctggcattgagcctggtcaggaaacaggaagacaagcaggttccattgagcctgggacctggaccttgt

SEQ ID NO: 230817 - DNA, 476 bp, Homo sapiens
gcaaatggaggaagtagacctgacccctgactaaggaagatggtgctacctgtttggggcaaatgttcaaaaagaggctgtgtctgtatggtggatgctgttaaaagggactcagaaaccaaatgagagtctgaattagctgagtttaacattctgtgagttttgtgccagacttgggactactgcagaagaccctgggagagttgggattgaattccaaaggcagtgctgatggacactgacttgaggagccaggaaagaaggcaggaacagtggtggggatcacagcctcacctgtatctgtgcacttctataaattcacagactgggaatttttaatgtgaactggatattagatgatgaccaggaattgttttaattctgttaggtgggataataccattcactgtgctgtgtaagataatgtccatattgtttagagatgcatactgaagaatataggatgaaatgaaaaa

SEQ ID NO: 230818 - DNA, 411 bp, Homo sapiens
agaggagagcaaagaaattgtaataaaaattacctgtagtgccatgacccaagtataaccattgattcagggaaaccatttaggaataactgacttcattttatcattctatgagtttatcttttcatactttcttttacgaagttacagttatgctgttatgtattgtattgtaacctgtattgttttgtaatctgttcaattataagtttttttgaaaatttataaatgatctttatcgacatataccaaaatttatttaaattatttccaatttaggatattttgattatttcctttatttttaattatttttatgctatttttaatgatgctataatgaagattgctttgtgcattaatccttctgtacatttgattgtatgcttgcaataaattcctaaaaacaat

SEQ ID NO: 230819 - DNA, 488 bp, Homo sapiens
gtcttcagtgtattaatttcctgtggttgctctaacaaattaccacaaactggttggtgtaaaacaatagaaattaattctctcacagttctggaggccagaagttcaaaatcagtattattgggccaaaatcaaggtgatggcagggctttgttccttctggagggaggctgtagaagagaatccattccttgcttctccctgatactggtgggtgctggcattcctggctatggcccatgtccttccagtctacgaaagcagcattttcagttctctctgccatgtcttcttcttcttcctcttttttggagacagagtcttgctctgttgcctaggctggatgcagcgacgtgatcttggctcattgcaacctccgcttcctgaggtgggaggatcgcttgagcccaggaggtcagggctcctgcagtgagccatgatcacatcactgcactccagcctggatgacacagagagcccttgtctca

SEQ ID NO: 230820 - DNA, 1006 bp, Homo sapiens
ccatttttagcaactgttaaagtgaagaaattctcacctctagacaatactctcctttgtaatatgcacttcaaaggaagacaaacaccactccctcactctactcaagtgtaatttaaaaccaactctcaagcataatgggatgttacagccaatatttatttttttcctttcattagataaatagtattaaattgggatccttgagaaaattgtaccaacggtatcatagttgaatgtattttgagctcaagactcactcaggcaaattttcctcatatgcaaatcaccatcattatgcaaataaggacatccgcattgccatgcaagtgtaaaatggatgtttgtttttatgatgatgaattatcttccccagtagcagcctgcagcgtgcagtttggaaacctgcgtggggattgtgtttgtttttcaggcgtttttgttggctccaacataaatctattgccaattctggcaatgtgggggtctctctttcattccaggtctggggtctaagtttctctcttgaagtgttctggggttctttattgtaagttggtgtttacctgtaatagcaagtctatggaacactttttacagctgcctttcaagtccgatttcaatctgtaactctactttggggttaaactgggaagtccccagcttacctgcaaactcttctgtgttctttcctggaaccaaatgacttattagaataaggagagaaagtgataaagagtgatggattattttactgttctgctgtatggtaaaagtaaactggataatagcattacagcaactaacgcttcttgtgaaaacaccgtgctaagtatttaactcatggtttctcattggatcctcacgtaatcttccaaggaagttattgttgtcaaccctatttcatgcctgaggaagcatgggcttagagaagtttaatagcttgctcaaggtcacaagactaatgcctggtagaatggggactcagaccccaggttcctgcttt

SEQ ID NO: 230821 - DNA, 457 bp, Homo sapiens
cgatatactcaatattttacagatttatctcctaatgttacctgactgcttcaaatagtgaatatacagtcctacttaggatataaaatgccattatagaagatatttattgagtaaactaattcttcattgcaaatgaggaaaccaaagagaaaaccaaggtatggaatcctgaagaataaacaagagttggacaagtttagaagggcattccaggaaaagggagtatgctcagaagcaaggccctgcgaaagggagtggtgagaagttggcaaaagcctagggtagtaagaagatgaatttgtaggaaatggttatttgggagccacaattgacaagataaactagggccaactgtcaagaacctgtaggccaaacactctaaaaacttttctttaaaaggtaagtggtatttaaacctacttcttaagcctccttgaataagaaaaataggaaa

SEQ ID NO: 230822 - DNA, 448 bp, Homo sapiens
atgtatcaatatggataaatctcagaaacctactgttgagatggagggtaggggagtgaactgcggaaggataccacttatgtcatatttctaactaaatgtatacgttgatactttattgtttatggctacacacacatctgggtaatagaggtataaaagcctgcacaagaatgctgtcaatatcacaatcagtcatagggagtgctcctgggagggccgcggagaggagggaactagggatgccactgcaagggtaagtaggacgctggacttcaacttcaactatacacataacatttcatttatttttttaaaatccccatcaaatgtagaatgacaggatttttcagaggtgggtgatgtgtgcacagatgtgggctatcttctccacactcctctgtatatttgatattctttgcaataaaagagaacaagccacaataca

SEQ ID NO: 230823 - DNA, 376 bp, Homo sapiens
ctgccaaggtttacaggtgcctgccaccacccctggataattatttgtatttttagtagagatgggatttcgacatgttggccaggctggtcttgaactcctgacctcaggtgatccacccaccttggcctcccaaagtgctgggattacaggcatgagtcactgcgcccagccaatttatcttgttagaatgattgtaactgtattctgtaaaaggccggtgttaatagattgcttagctacattttagagtatgcttcactagagccttaaaaatcattacatatatatcctctgaaatgtattattgctttgatattttaacaatgattaattacattcaattatgacaattaaatgtttttctaaattccca

SEQ ID NO: 230824 - DNA, 2200 bp, Homo sapiens
gagaaatgcctgaaattgctccaggctggtgctcagctgctgagctgggctagttgttaaaatattcagtggtccccaacctttttggcaccagggaccagtttcgtagaaggcaatttttccatggactggggaatgaaactgttccacctcagatcaccgggcattagattctcataagaagcatgcaacctagatccctcgcatgcacagttcacaacagggttcaagctcctatgagaatctaatgccactgctgatctgacaggaggcggagctcaggcagtaatgctggctgaactgctgctcacctcctgatgtgaagcctggttcctaacaggccacggatgggtgccggtccatgatccgggggatggggacccctgaatattggctagctattgccctgagccctccctagccaaccccagtcactctgatcttgtccccaggaccctctaaacctctccaccttccaacaactaaagggtcccaggaccctcctccatcactatgacatgcacccatcccttctgaatggtcagtgcccagctgcactagttgttaaatattttgaatctcagctccgggtgcagggagtcctggctccatgagaaagtgagtgggtaacttggggcaacttgcttaactgctctgaccttccattcccacatccctgcatggaggggttgtgatgggagtgagaggatgtgtataacgcattaagcatggaatacagactcagggcttggtccatgggaattaatattatgaaaaggcttcacaaggctggactcacactccagcagctgggactcctgggagctcctggctctgcccagactctagacacctaggagtcgaactggggtctgggacacctctggaccaatctcaggagtcctcgttgcctcctctcccagggaaaactccagtcattagaggacagggagattccttcagccaggctgagatccttggagatttccacccaggcaggatgctgcagctgtttgccttaaccatggcaaggaaattcatctcaacacatccatctctgtgtgaaaagccccatttggactgaataaggaggagagggagaggtcttgggtctcagctttcaaagtccatgatcttcctatttggttaggggaaaccaaattacagtcatttgcaataccgtcattcacatcccatcttcactattttttgccttatatgcttacattgctgtaccatgatttactaaaggtttttttttcttttagatcatctcatttttgataaagttaaattcttatcactgaaatgttcactgaggaaagcgatcatgaaataaatccaatgaaagcaaactgtggttaaattctaactagataatattgcctgcctaagggcctcagctctctcattgttaaaaagggaaggtagcaagtgatagaggctaaaggcgttaaaggcatgttagtacttagcagagacattccttcagatgtaagtagaagcactgaaagagaactgaagaggaattactttcccaccaaatgggtttaaatacaagtcacttggttagagaccttggacttgtctatctctctgagtttcagtttccccataagtaatataagagcattgtcatggacaatcaggaagatcctttggggccctgatactctgtggttcaatgatcctgcaatttgtatgatactccatcttgctgtcaagatgccaacatgtaaggtcaaagactgcaacgtaattctcactccaccctaagaggtgggtactattattgccccctttttttctgcaaagaaacaggttcaaagagtcaagatcaccagccccatgttgtgtggtcaggaagagtcagaatttgaatgcacgtcagcctgcctgcaaaacccatgctctaggccatagccaccctgtcacactgtacctggtgtgcactgggttggtgtgcacatggttaaacagtcagcccatccccagcattgggagggaggtctaaacttttgactttgtctccgcttcaaaagcttgacttggcagctttctagttccctctttttcttccaaatgggcttcccagaagcagccttgttcatctccatggttccaatctggcaaggaatctcctgggtagatacggctcatgtggctacaggttgttgtacccacaaaaaaagaaagaaag

SEQ ID NO: 230825 - DNA, 436 bp, Homo sapiens
agagagagcgcatttgtataagagattagtgtgtgtgggtttgtatgtgagagagaaacacacacatgcacccagttacactctccagcagagtacccctgttcttgcctgagtatctgcccgtccttttcaaggaagacacatttcactgtccctcttgttcctttagcctcctttcctagtgtctcactgaaggtctgtgtatttgtccctttctgttgagtgcttcctagtgtgtgttgtttgttggagccttgggtcgtttgatggtgtatcaaatgatgtatctttctgtaactgggtaagaatatgtctttctcagtgggtggtgaggggaatatatccaattgataattattttttgtactactccatccattttattcaaggaaaatggaagggtgtttaaataaaatatcacttttttttctgtgta

SEQ ID NO: 230826 - DNA, 731 bp, Homo sapiens
agctagtgtgacatcaccacagtttagtgtgacacccccagagcttgggcagtgtacgggacgacagtgcctagcagaggagcttcactgccggtgagggattacctcaggttaggctttaatgtttcgttgccgtctagagacgttctagcaatgtgacatctgtgtaccatatctggaagtctccctgtacgtcaagagccccttaggggagtctcccattgccgccgtgggaacctgtgtttacattacgaggagagagaatagctgtactctgaactcaaacgctcaaaacatgcagtgagcgaatgctagcataattttcttgcctctaccagaaggaaggctgggtatttaggaaacagaacgcgttgggcacaacattctgagaaaatggacacagaaaattaggttatcctaatagaaaagcagttgcatctcccaaagtcaagagattctgtaggacttccgatgtatctcctgctgtgtaaaatattcaggttcctgaagtgggggacatttttagggcaactgtaatttcttcattttttccatcccacaagtgctggaggcagcagtgatctgagctctagaaagtgactgtccgtcaccatcggtatttgcatatactctgtgaggagaagggcagttgtggctaagacaaaattctactatcaagttttgtttctcaaatctcactcattaacatctttgatttccttggatcccca

SEQ ID NO: 230827 - DNA, 571 bp, Homo sapiens
agctagtgtgacatcaccacagtttagtgtgacacccccagagcttgggcagtgtacgggacgacagtgcctagcagaggagcttcactgccgaaacttccttctactacttaaagtcctcacattgggctgacctgggaaacatgaagataaaaagagtgggtaaacatgcctgcttgatgagccagaaaaaaaggcagaaacctgtggtctgggtagaacagatcctgctcagaatgtataaaccaggaaaagttgttctggcccctcatctggtttcatgaaggacaatatctagcatgagagtgacaggggttagaataatggacattttggggactgggtcctagcagaaatgatggaataatggaacaggagtttggatgaatgggcatattatgggattaaagaagatttgaatacaagctttcctaataaatgaaaggggaggtgaaactagagcatgctgatggctgcacagcattgtgaatgcactaaatgcactaactgtccactttaaaatgtttagtaatatgtcgattttacctaaataaaaaaaaggaagcaacat

SEQ ID NO: 230828 - DNA, 540 bp, Homo sapiens
taaggatacatagatgcgtaatagttcttagagttacttacactcaaatagccacagtgaacttaatatatagcagtcggattcttccattaatgttgatgttagtaaatataacgtcataatgtttgaccttggacttacctattttatttttttaaacttatgtagattataaagcattgtcttttcaaagtttttttctgacattcttaaaacttattttctttcaatatatggttcaaaataaataattctgctatttctaaagttcagagttaaagaatattccacaatggtacagaagcttttgagttttatatattttggcctgaattatccaggcaacagccaaaattcttcccttatatttatggcttatgacagtgctgacttttcatatcattatgagaaactcagagatctatctcatggataaatcaggtttttcaaatttgggaaaaatgaaaaaatttttgaaagaaattggggttgatttgttaatgacaaatttgtactaacatggcaggaaaatatccatgg

SEQ ID NO: 230829 - DNA, 409 bp, Homo sapiens
cagtcaagacgtgaggctccagaagtgaacactgaaggcttccgttgttgctgctgtgctccccttcacgcccccagataactatgttaattttcaaaagtaaaataaggggtttcctccaaaagtttaacccaaaatttaagtatcatctttaattcataaaagcactacttagtaactgaaagagtaggtacaatgtgattgttctatcactagattcagaactcatgggattccctaacccatataaccaaaggatttgagaactgctggtcttcctgcatgttccatggttgaaataaagggatttttggtttttttaaatttaagaaagtgaggcaagtgctgacagagatggaaataaaaaggtgaaagctgaaaggcaatagttacaaacatcaaaagaaaa

SEQ ID NO: 230830 - DNA, 448 bp, Homo sapiens
aatgccttacttaatatttacgtagggggaacaaaagaaaaacatcatcaatccatttgccaggcaaaatagcctagccccctgctagggtggacttactgcccaagatggcacactgggttcacaggactctgcccttccctccctggggccgccaaaagcagaaagtgcttagagagagggcgaactcctaactatgctggcaacagagaaaaggggcctccctgtgggcaggacagtattgggctgggctgaggaagaggctggagtcgaataaaccttgaccagaggtgggaggaaggatgggtctccctagctgggtgcagaaaagcccaagttgggcattacaaactactcaggtcaagactggccggggcgcaggagcatttgggatggcaggtgctcgcctggttcctcgtctcttttgttaaccagagttgctggtgac

SEQ ID NO: 230831 - DNA, 361 bp, Homo sapiens
ctggagtatatgagttccaaggtatttttttctgatgaaaaatatctatcttggtttttacttattagaaatggaaatgtaagcactttgtactcactatataggccactggataatcaccaggttggtgcaggtgtgagggtgagtgtcagaaccccaaagaactggttatgttttgaggatccatattcaggaacatataaatttatactgggaaaatgtaaatcccacttgtactgaatgcttgactacactttcccatggtacacatcatcatttccttttaagacatgatcactccagttttctccaagttttaatcacttataatataatatgatataatgtaatacagtataat

SEQ ID NO: 230832 - DNA, 415 bp, Homo sapiens
ctggagtatatgagttccaaggtatttttttctgatgaaaaatatctatcttggtttttacttattagaaatggaaatgtaagcactttgtactcactatataggccactggataatcaccaggttggtgcaggtgtgagggtgagtgtcagaaccccaaagaactggttatgttttgaggatccatattcaggaacatataaatttatactgggaaaatgtaaatcccacttgtactgaatgcttgactacactttcccatggtacacatcatcatttccttttaagacatgatcactccacttaaaattgtaagccattccttcatgtagtggcattccctgcctctcttctctgttttctccaagttttaatcacttataatataatatgatataatgtaatacagtataat

SEQ ID NO: 230833 - DNA, 421 bp, Homo sapiens
tgcaaactgaagctttcaacctggcctgggaaccttaagaatattttatgaacaatcaatccaccgaactgcacctgtcagcagaccccggttaactgcacagagtacctgaaagccatcccctgtctgaattcacacagaaaacttttagagccacggcactgtgatggagggaaagaaggtgtggaccacacctcatgagatgtgcaaacaacatggctcatgacaaacccagcagaatgctcaatctttagaaacccaagatggctacagcaatacagaccatgacaatttttggtaaggacatggagaaactgaaatcctcaaacattattggtgggattataaaataatgtagccactctggaaaacaatctagcagttccccaaaatgtttaacataaaattaccatatgtctca

SEQ ID NO: 230834 - DNA, 420 bp, Homo sapiens
agaaggaatggatgtaacgaaagaggcagaaaaaaaaaaattgtttgccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230835 - DNA, 420 bp, Homo sapiens
ttaatcttcctggattagataattttaataaattaggggaacatcatccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230836 - DNA, 423 bp, Homo sapiens
  misc_feature (48)..(48): n is a, c, g, or t
ttatagattatttatacataattcaagtgaaaaaaagaaggggcctanttccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230837 - DNA, 477 bp, Homo sapiens
tgcatggcccagacggggcgcttagatacaagctaagaagagagacctggtggtccgccggtggaactgggacaatggagtggaacgtccaaccatgccaggagccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230838 - DNA, 426 bp, Homo sapiens
tagcaccgtgggttccaacatatatattatggaaggaaggaggcgcttcatggccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230839 - DNA, 431 bp, Homo sapiens
atagttacttacacaatacacgataatataatattaatattataagggatactttataccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230840 - DNA, 431 bp, Homo sapiens
gcgggcggggtgagaatgtgttaatattgttgataaagaggggaaaggaggcttcctgccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230841 - DNA, 420 bp, Homo sapiens
  misc_feature (33)..(33): n is a, c, g, or t
atatttaaggggaggttttaagaggcagaaagnaagaagccttcctaccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagctccaatgtgtatttcactaacaaaaaaagtaaaaactggcctcagtggcctcaa

SEQ ID NO: 230842 - DNA, 343 bp, Homo sapiens
ttcttttctccttttaaaaagcatccatgtgctcataagcaatgggagtgaatgaagagccaggcccagcaacagaggggagcctgcccacatggagcaaaaggagccggacaccagattcacccacggcgcgatcccggtgacggaggcagtgtgagcaggcaggcggcggccactctggggaagggagaaggaatgagggtgagaggggcacagagggcctccagggagacggtcctattgtgcctcttctcctgggtgtctgtcacctgcatgcaaactttgtgatcattcactgagtcacgttttcttacatgtctccttaaaaacagttcttaaaagc

SEQ ID NO: 230843 - DNA, 492 bp, Homo sapiens
ttaaaggctcaatgaataattgaaatgtagttttgattatgctgaagttggtgccattttgagttgtaattgtaactaataaattaattaaataggtgagatgatgaaatcctgtctcaagggggggcactctttcaagaatttatctacatgtcattcagaggatttatgcaggaaaaaatagacgatcagaagaaaaccctgagtcttattaatcagctacctcctccctgtaagtgcgggagcccgctaataattcacagtcaccccagtgtgagaggaaggagggcagcacctgctcctccctagaactctgtctgacttctccctcaagtcagaagaactggagacgggaaggggtgtggctgtcactgtttatcccatgagggtttactggggtcccccctctggatgcctggattcagccgtggatgaaacaaccattggtcccactcgctgggaaagggcagaccctgagcgaagctgcggccg

SEQ ID NO: 230844 - DNA, 210 bp, Homo sapiens
gtcacaattgccttattttggattagactaatatttattttttcactttcagtgtgttaatttgttaaaaatcctttatttttagtagttgcattagagattggactgtgcaaacctgatataatctactttaaattttactttcactacttccccaatgatgccagaatctcacgacttcatttaccaaccccatcttctgcattattg

SEQ ID NO: 230845 - DNA, 466 bp, Homo sapiens
gtgctaagctagtggcaaaaccccgaagctatttggtctccttgcgggagctcggcgcttgctggggccacgctctgcttgcttgggcgtggcctcctgtgagagggggccctaggatgaggcgatatgctggattcctgggcttccttaacatgagccctcccctgctgtagacgtgaatggaacccgttaagttatgggaacgttcccggcactcctttcctttcctctcaagtgccagtgggatgtccgaatagggtctggcaccatgactgtctggactcaaaagtgccttcaggaggccctagcaaaatttactagtgtctgcttggagtagtagcagctcttgtgatggactccggacagccagcgttcattccctgactcccttctgttactttttaagtaaaataatgaaaatatttcaaatagagtaatacagattcctgtggaccgaccactaaat

SEQ ID NO: 230846 - DNA, 712 bp, Homo sapiens
accctaagaaaagattgatcaagtgtgaaaaaaagagataaaacacaaattaccattataagacatctcttctataatggagggtggtattaacaggatgaacacaagtattactgaaatactaccatgaccagtcagcaaaattgaaataacaaaataccatttctaacccatgagactgaccaaaacttaaaagtctgatactgtcaagtgttagtaagcactattgtgggctactgacagacctgtgaactcgtaaagtcattgtggggaacaactgatcattatccagtaaaactgaaacttgcaatcccttgcaccctgcaatgccattactggagcacagaggcatggagacggatggtcactacagcattgtttgaaatagaaaaaactagaaacaatttaagtgtccaacaaaaagggaataagtaaaatggggtatatgcctactgtgtagcagtgagactgcaacaggcccatacacatatctacaaataggatactttacactttcagagaaggaacacactacaggagtaccctacagtggcaggattgaaccagcattacacacataacaaggacaacttccccaaaggtaaagttatatgaagaggcaagctacaggtgacactgacagtatgacaccactatggaaactctaaaaagcccacacaaacaatatcatatgtcattcaagtatatctat

SEQ ID NO: 230847 - DNA, 447 bp, Homo sapiens
ggttgatgtgtgaagtctctgtctgcccatctgaataacaagagatggggcttgtgattttcctccacgcacccctacctgagggcctccaggaggaatgacatctcaaacagaaacctgcataacatcagcccaaaccaaggacccattttatcatcaaagaggtgtgccatgaatgcatgactgtgggatccactgctttgaccacatatggatgacttggaagctgccagcctacatgaacaatggaaaggccattgatggctcagcaaagttgccagctgagggccaatgctccccagggttggcctcgagggtggccacagtgctgtaacaacagccagtgtggtgctgaacctgcagcctacctatgatgctttgacaccaattgtcaggacacacgggtctggaaaccaaatcttggaagtaggattggttgctttccgt

SEQ ID NO: 230848 - DNA, 399 bp, Homo sapiens
caaattcccttgatttagaacatttataaacactgtataacagctgaaaccatgccatctggaaatgaaattaaagttgatagttcataagcagaaaatagttccacatgccagttaggtcctagtgatttcattatgctttctgacttttctccttcaagagagtaattgcttactcaaatcggtgcatcttgttttaaaattcatgtaagctataactcctgtccttagcttaggtggacttagaattttcataagaacgtttggccagatgcggtggctcacgcctgtaatcccagcactttggggggccgaggagggtggatcacgaggtcaggagatcaagaccatcctggccaacatggtgaaaccccacctctactaaaactgcaaaaactt

SEQ ID NO: 230849 - DNA, 380 bp, Homo sapiens
aactgcttcagaacatttcaaaatgttttctaatatttcatccagctttttctgtgtattaattgatactgtaagaaatgcatacttgcttcctgctcctttttttgtctcactgtcattttctgtgtgattgaaaacattgctacccatagctcttaaaatgtataattttacagttataatcattggagaaagactgatccgtgtttgaatatttaaacaagtgcctgggtgtggtggctcacacctatagtttcagctactcgacaggcttaggtgggaggattgcttgaccccaaggctgcagtgagctgtgattgtgtcactgcactgcagcctgggcgacagagcaagagcctgtctcaaaaaaaaaaaagaga

SEQ ID NO: 230850 - DNA, 448 bp, Homo sapiens
ccacctgcaaagcccattcgaggctcagagcccagggcgtgcatcctgcgctggccacgtgggcccctctgcatggcaaccacccaaatcccagactcccagcaggaaagcagctgttcagcacaaacccattgcaggaacagtccaggcccggcaaagcactcctagcagtcaggggacggagagacgctccaaaagccccgttcccagacaccaccttgaaagcaggcccctctgagaaggcaacctgagatctgctgcaccgagtctgtcccgcacagaagccgctctcatctcaccaaccacggtggtcactgcagcaggatgggaagagggaccaggtgtgttcctggctgttccttcctgaggagtggatggaatgtccctccttcttgtggaaagaccagggcggaacgagtggtgagcatcgtctgccacaaacacaaaa

SEQ ID NO: 230851 - DNA, 343 bp, Homo sapiens
gtaatgagtgaaaaattaagtgcttttcaaaaggagcccatggagaaagcattctgaaatggctatttggcaaggctgtcatcattttgttttactgtatgttcttttcttaaggatctttgaattgtagactagtttacatactttataaataatctaggttaatattggcaacacatgtaacagatattatacttttataattattcagaaaattatatatacctttaatccctccccaatactcactttaataaatattaatttattaccaaaagaaggtgtgagatctaagaactctgagtcttgtagcaggtaagacatttgtaagggctacttctta

SEQ ID NO: 230852 - DNA, 1145 bp, Homo sapiens
ggctgaagtgcagtggcgcaatctttgcttcaaggcaacttgtacttcccaagttcaggcaattcttctgtttgagcctcctgagtggtgggactgcaggcatgtgccactatgccccattatgtgtttttggtagagatgagatttcaccagcctggccaacagggtgaaaccccgtctctactaaaaacacaaaaaattagctgggcgtggtggtgcacgcccgtaattccagctacttgggaggctgaggtgggagaattgcttgaacccaggaggcagaggctgcagtgagccgagattgtgccacttcactccagcctgggcgacagagtgagactctgtctcaaaaaaaataaaaataaaaacccatctcaaatcatggcttaaaaaaaaataaaaataaaaacccacctcaaatcacggcttatagcaacaccctttatttgcttataatcctatgctctggcagtctgggcagagctctgctggcgtgatccaccactgctccatgggtgccagttgggactccacacacctttgtggttagtgagcagattggttggaggctgattgaccttgactggcctcatgtatgtgtctcaaagttggctggggctgtcggctgaaattccttagttctactccacatggcctttccccatggccagcccaggctgagatctgagattgaagagggtgagaacagaaagtacaagatcttcttttgacttgaaagctagcccagaatcgagggaaataaaccccaccttttgatggaaggagcttcaaagaatttgtagtcatttccaatccacgaagagtaggtacccactatttgttgaataaagccctattgaaagctttttagctatccagatgcaaattactggccaacctttgggtagaattataaaattctgcccaaaattctaccaaattactggtacttgtaaaattctaccaaataactggccaacttttgggtagaattgtaaaaattaagttgtaaataaagcctattgcctaacaggaacttcaaagtcagagaatcctaaaatgattgtgctacacagggccacatagagcacagctctgtctcaaaaaaaataaaaataaaaacccatctcaaatcatggcttaaa

SEQ ID NO: 230853 - DNA, 657 bp, Homo sapiens
  misc_feature (197)..(198): n is a, c, g, or t
  misc_feature (202)..(202): n is a, c, g, or t
  misc_feature (210)..(210): n is a, c, g, or t
  misc_feature (212)..(213): n is a, c, g, or t
  misc_feature (219)..(219): n is a, c, g, or t
  misc_feature (227)..(227): n is a, c, g, or t
agcccctctgcctggctgcccagtctggaaagtgaggagcatctccgcccggccgccatcccatctaggaagtgaggagcgcctcttcccagccgccatcacatctaggaagtgaggagcgtctctgcccggccgcccatcgtctgagatgtggggagcgcctctgctccgccgccccatctgggatgtgaggagcnnctcngcccggcngnnaccccntctgggantgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggcgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgcagagtccaagacaaatggtcattttattttatactaggtcctcagcggtactctggtttattagaataaatttcaaggacatagaacaaattatctttaattcctaaaataaacaccattttacaaaata

SEQ ID NO: 230854 - DNA, 380 bp, Homo sapiens
tatattaatttttatatttttatataacacacccccgcaccactgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggcgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgcaaaaaaaaaaaccatctgccctcgttggcctaaga

SEQ ID NO: 230855 - DNA, 503 bp, Homo sapiens
ccatggtagtcatagcttctactacctgttctggtgacagcatcttcctcactattgtggactgaactgtgtccctccaaattcatatcttgaagccctaacactcatacagtgagtatatgtggagatgggacttttagagagttatggttaaggttagatgacatcataagggttgggggccctaatccaatagggctggtgtctttaaaagaagaggggccgggtgcggtggctcacgcctgtaatcccagcactttggaggccaaggcgggtggatcacttgaggtcaggagttcgagaccagcctggccaacatggtgaaattcccgtctctactaaaaatacaaaaattagtccggcatggtggtggatgcctgtagtcccaggtacctgggaggctgaggcaggagaattgcttgaacctgggaggtggaggttgcagtgagctgagatcacaccattgcactccagcctctctgtttcaaaaaaaataaaaaaat

SEQ ID NO: 230856 - DNA, 733 bp, Homo sapiens
gtatatgtatgtgtagaaagccttctcacctttctgagaatgggtgaggataaatatgacaaaatactgcagaagtaacctcagtgaacactgaaactatgtggaaattgctttgactggaaaatgaagggagtttgtattgtggatcattaaaagataagatggggtagaaaaaataggatcagatcatgaagcacatgaaaggttaagtacatgattttagttaactttgatccaaagagtgtggaagtgctgctacttgtggtttctgagtgaagggagatataataaatgtgataattttggaaaattaatttagttgtagtatataaatgtgattgaaggtaaatggagcttggagatagaaaaaccaattaggagtctgttgtagtaattcataagattgaaagccttgattaaagtcaatagagagataaacttggagaatactttaaagggagattcttttttaaaaccagcccccaccgttttataattttacaagttgaagaagaattaagatgtggttgcaaaattttaggaagcgaaattaaataaatggtggtggtagtcatttaagtggcaaggttacaaaagggagctattttgtgagaaagaataatgtttatgttcttttacgttgaatgtaactggtggttggacatccagtagacagttttttgtttattggagaatttgtttacagtcatttctctgtgggggggaaatcctc

SEQ ID NO: 230857 - DNA, 358 bp, Homo sapiens
ttagtataacaaatgttttcaagttgtttgggaaataaataagctaggaagcaaggtttaaataagaatggtttggtttggtgctgaatgatgttgttagtacaccgcaattcaagtgttggctatgcatttgggccaatttagggaagtccaaaacaacgcacattcgctcagtagtgtgagagattaattgtaggcaggtcccatcttttttacagtattcaaacgttcaaccttaagaccccaccagggcgtctcattccaccgggaactagagaagcttgacttgtgtgatcacctcctgatgaatggactggggcggaacacagatccggaggtgggggcttctcttcaccaa

SEQ ID NO: 230858 - DNA, 1884 bp, Homo sapiens
gtttgttaccgtcacaccaccctactccagcctaggcaacaaagcgagaccccatctcttagaaaagaaaaaagaagattcacaagagggtgtggcaatattagacaggctaagcccccaggtgtacccaatgtaaccacaggggcccttcggtggaagggagaagcagaagaggtcagagtgaagccacacctgctgtgacaatggagggagaaagtggctggccaaggaactccatcagcttctagaagctggaaaaggcaaggaaacagtctccacccggagccttatgggaacacagccgcctcatgggaacacagctgccctgtgacactgattttagccccgtgaggcccatgctggacttctggcctccagaactaagatttgtggtgctctaagcaaatcataaatttgtggaaatttgttacagcagcaacagaaaactagcacaggcagcctacgtgctaattctcatcttacctgaggtggggagtacaatacaccctgtgttagttggaaagctgaaacaattctctaatgctaatactgaaattgtcaggtcggtgtaactgtgacagtccggaagcaatggaggcttcagtgagcaggaccagctgcctttctcaccaccacagcttgatctctctcacaacttcctctccacctccactgacctctgggttggttttctcctgcacgatctttccacgtgtcaggggcctggaggcaccctacaagagctgactttacatttccttcctagaggtaatcccagaacaaaagagagcagttttatttatttttttcaagagaattaaattgtttattgattacacatgataatggatgatacacaagcttcattcccatctataatttaatctggtaccattattcaattagatatgttacataggatgtgccaacaattacttttataaccaataattccatgattttgcttgggtaatcccttttaatggtgactgaaatcatgactgaccgagtcagtggctagaaaaggggctttgcctttgtaacttttgatgaccatgactccgtcgataagattgtcattcagaaataccatactgtgaatgaccacaactgtgaagttaggaaagccctgtcaaagcaagagatggctagtgcttcatccagccaaagaggtcgaagtggttctggaaactttggtggtggtcgtggaggtggtttcagtgggaatgacaactttggtattggaggaaacttcagtggtcttggtggctttggtggcagtcgtggtggtggtggatatggtggcagtggggatggctgtaatggatttggtaatgatggaagcaattttggaggtggtggaagctacaatgattttggcaattacaacaatgagtcttcaaattttggacccatgaagggaggaaattttggaggcagaagctctggcccctgtggcaatggaggcctatactttgcaaaaccatgaaaccaaggtggctattggcggttccagcagcagcagtagctatggcagtggcagattttaattaggaaacaaagcttagcaggagaggagagccagagaaatgacagggaatctacaggttacgacagatttgtgaactcagccaagcacagtggtggcagggcctagctgctacaaagaagacatgttttagacaaatactcatgtgtatgggcaaaaatctcgaggactgtatttgtgactaactgtataacaggttattttagtttctgttctgtgggaagtgtaaagcattccagctaagggttttaatataggttttttttttgcacccatgctgttgattgctaaatgtaatagtctgatcatgacgctgaataaatgtcttttgtttt

SEQ ID NO: 230859 - DNA, 583 bp, Homo sapiens
atattctattagataaccatttctggttctaaatggaaggcaactgaatatgtaattattaaaaatgacattaatacaaaattacagacaggtaaaagttctgtttaatatttacagaataaatggaccaataaaagactgtctatatatatgaggaggataaaatataactagagtgtgtgagtacaattttagtatagtgctcagagaggacttctagatgagcaatcctgaaggatgtgagacaacaatccgttatgcaaatgtctagaattagcaggtgcaaaggtctaggatgaaagtttgcttggcatgttaggaattactagaaggccagagtagccagagtacaaagggtaaggaagtaaggtccaaaaaatagtagagaacaatattccaagggaaatatggtggaatccctaggcagcataaagagctaccttttactgaattaaagggagaccaggcctggtacagtggctcacacctgtaatcccagcactacgggaggccaaggatgggggattgcttgaggctaggagttcaagatcagcctaggcaacatgacgagaccctgtctcta

SEQ ID NO: 230860 - DNA, 537 bp, Homo sapiens
ccccagtgaccaacctcaagctttgtacttgaatagactggataattaatcatattttctgagtctcattatttaagtttgaaaaaagccaccagcccaatgaagaagggcaaaaacattgagcagatctcaaaaagatctataaatgtaccgatatattttctatatgaacaaatagcgcaacaaatactgaacattttttgacattggtgaaatgtggatatcatgtattggcaaggatgtgcaccaactggcatttttgtagaatataaatgtatatcttgtttgggatggtgattaactagacatacacatttgtcaaaacttgtgaaactggaaattgtacatttaaattgagtgtatttaattttgtgtaaaatgcccttctataatatggatttagaaagtaataaatattttgaataacaaagtgttagactttgaattaatttaatattttctttgtaaatttgttaatcttcaatgatacatgtgccttccttttataattaaatgaataaacagttaatataaatg

SEQ ID NO: 230861 - DNA, 586 bp, Homo sapiens
tgagaaagccacgggaggggacttgctgggctcacagccagtgatccctgccctgtttccttatggggactgcggtcagaaatggggagtggggcagaaactgtcactgtcacggtcctgtttagagaggaaggtcggagaaaccagtgccgtggaaggctctggggcgttgacaggcgctgtccccagctcaccggctctatgaccctggaagaatggaaacttcgtcagagcagggacgtgagggtgaactgctcacccgggcaccgctggcgaccggaacccagctccctccgggctccgggagaggcggcctcagctgtgtgctggtgctgccctccagcggcgctgggtccccatggcacctggctttctcctgctccccaggggccttttcttctcccgcccacctgtcaccagccgccagggcaagtctctgtgtgactctagggtgaaggtggagggaccttgcctccgaggattcatcccacccggattccgatgagtgagggaccctctctggcacctggtgtttgaatggccagcctcacagttaataaagacaagtttggtatcaaaaaaaaga

SEQ ID NO: 230862 - DNA, 152 bp, Homo sapiens
actctccactgacggctgccccttcccttagtgaaaaagacatgcttccactattctgcagtggaataaccctcactgctctacaacaacctcttctgtgctgaatccttcagctgactcccacttctcttattattattgaatttctttat

SEQ ID NO: 230863 - DNA, 440 bp, Homo sapiens
ggcttcccaaagtgctaggattacaggcacatgccaccatgcccgtcctgctctacattttaaaaatccttctcaccacagtagtaataggagaagctagattctcctgtctgcttaatactgtcaatccctagtgatacgtgtttttttgtagaaatctatgtcctcatacagatacaaaattagaaaaatgaagagaatcttaatagccttttcagatagttttggctatactttaatattacattaaaacttaaaagtgggccgggcatggtatctcacgtctgtaatcccagcactttgggaggccaaggcaggcggatcacttgaggtaaggagttcgagaccagcctggccagtgtggtgaaaccccatctctactaaaaatacaaaaattagccaggtatggtggcgcatgacagagcaaaactccatttaaa

SEQ ID NO: 230864 - DNA, 301 bp, Homo sapiens
atttttttttcccttgcaaattatctgttgaagaaatcattgtttgtcacttagatcttctcatggtctagattttctacttgtatccctgagctgtattttaacatgtttctctgtcttctatacttcctataaataggtaagtagatcttaaaacttcatcagagtgaggtttgattattttggacaaaactacttttatagatgatcatatttgttatcttgctgcataatgaattacccctgaaacttacaggcttaaagccacaataaacatctctaacactgcacagtgtctgta

SEQ ID NO: 230865 - DNA, 461 bp, Homo sapiens
gtgcagctgcccatgcagaggctcccgtgctcctgtgctctggaaaaccctctcttccggacagcttctggccctctctgttgctctgtctggcatcacccttcatgccttggcactagagcctcccaaagtgctgggattataggcgtgagccactaggtggcactgctgctctgccaggcatcagggtctctagcctggcctcaccctgagtgctaaagttcttgaggtgccaaagctgactggtggctcctgcaaggtgtgggtgaaaaatagaagactcccttacagaagtccagagccgtgctgtgccacagaggagtaaaggcaagagaagccatttaggctcataaaggcaggaacacccatcccatcttcatttaaaattttgttaatcatgggtgttttttgcactaaccttgattttaaaaagtattgcaatacaatatgattaattttga

SEQ ID NO: 230866 - DNA, 624 bp, Homo sapiens
attcaaaccaatccagggactagaaaatacttccaagaggacacttacagggtgagcctactctattctttttctctcaaaaatggaagattaaaaagttttattaattaggtgtttgctttaatcaggaccatttatttgatatatattattaaggatttcaacaaaattaactcttttgtaataagaaaaaacattacttttgcatggaaaatacagatccatggaaaataattgtggcatatttcctccaagtatatggtaggattataggaggtttttcttctttatactttacatataatttgataatgtcaacatgaatttcataaataattatacaagtgaagttttaaccccttttaaattgtttagtccaactttatttaaaaatgtatatatatttttttaaattaagaccctaagctcattcaggaaagtgagataccatggtgtttttggtgcagataagtggatttttaaactagtaaaaactaaaaaatcagacatatgaaggttatcaacacatcattgtagtccatcagttttctaaaaatcaagggagtggaagacactcgggatagataagaaacccgctggtccaaatgcagtggtgtttacaac

SEQ ID NO: 230867 - DNA, 348 bp, Homo sapiens
gtgccggcacctggagctgcccaccccatggcagcagccagcatgtctgtgcaatgcccggaccccacactcgctcacacacccctctcactgctccacgtctgactcatcccttggaggcgtgggatccaggccagtaccacgagctaagcgcagcctgccaggccgagtgggtggaacgagcctagctggcccgagcaaaactcagtcaaaggcgccaccagccacaggtttccagccagaaaagcgacaccccagagatccccataacagtatctcaataaattttagagaaatagaaaaagcaactagaatgagaataaagctgtaattgattttttaaaaaac

SEQ ID NO: 230868 - DNA, 280 bp, Homo sapiens
gagggggctctcgctttttatttttatttttttgtgagaggcagtctcggccatattctcttattctatttgacttttatattacacacatgttatttaagtttaaaaacagattaaaattgggccgggcgcggtggctaacgcctgtaatcccagcactttgggaggccgaggcgggcagatcacgaggtcaggagatcaagaccatcgtggctaacaacggtgaaaccccgtctctactaaaaatacaaaaaattagccgggtgtggtggcgggcgcc

SEQ ID NO: 230869 - DNA, 485 bp, Homo sapiens
tgtcagccaaaactatagaagtctagcaagacaagctggcatctgtcatcacactgctgttttgaaactatttgagaggaatttcatgtctgctaaagctaaagaaggctacggaagctttagtaacttgtcctctacaaaagatacctaagtcccagagatcatacatgaaaatgatgattggaatatcagtatgagatcattttcaaagactcctagccaagagtgtttattgctaggataagatgaccctaacagaaaggaaatatagaaagtaacatcaggggcacattatgaaaggatatcatctcaagaagagccattctgcactaagaaaattgtagtgaaatgggaaaaacaagttttcagagaagccatgaaagggctccaaaagaaaaacactcaggtctgaatattagtaaggcctaaataatcaatttaatttaaaaattactcaaacaagaatttagatatctccttttttt

SEQ ID NO: 230870 - DNA, 599 bp, Homo sapiens
ttcagcaagagtgagcctctgtcttcagcaggctgtctcagccagttccctacattcagccttgagccacttgccttaatacctcacttagcatgtgagtttcctgttgctattgtaacaaataacacaactgtggggtctgaagacaatacaaacatattatcttgtagttgtggaggagtaatgtctaaaataggcctcactgatctaaaatcaaagtcagcagagctgtgttccttctagaggctgtagaggagaatccgtctcatcgacttttccagcttccagaggcagctggcatcccctggctcctggcctgctacctccatcttcaaggcccgcaaggttgggcccagtctttttcacacttttctcaagctctctgattctccggtttctgcctctttccacttaggacttgtgattatattgggctcaccaggttaatccaggataatttcccgtgttagcttcctccctaactttaaggacaattaattagcaacctccattccacctgcaaccttaattcccctttcccatgtaatccagcagattcacaggttccagagataatgaggatggggacatctttgggg

SEQ ID NO: 230871 - DNA, 445 bp, Homo sapiens
cacacaggaggttgaggtgggaggatctcttgagcccaggagttccaggctgcagtgatctgtcacaaccatggtcacaaccatgccactgcccctgagcttgggtgatagagcgtgaccctatctctaaaaattttgtttaaaaagaatgggagaggatcttgagctgataagacccaccgtgtcaggcactaagacatcttcttgcagtgctgctcactcctccctggactgtcttcagtgtcaagatgaggccgcttcactaacgagatgcgatgattcgtatgatgcaaagcccacggcttacagagagcacgtgaagatggtgtcggcagcagggttatcacatcctctggcaggcagcttgggaagggaagtttcaatctgtgttgatattttagcactgattaaaggtggatgtacaattagaccttttaaatttaaa

SEQ ID NO: 230872 - DNA, 325 bp, Homo sapiens
taattgggtgtggtggcacgtgcctgtagtcccagctactcgggcggctgaggcaggagaatcctttgaaccaggggagtcgaggttgtggtgagccgagatcgcgccactgcactccagcctggtgacagagcgagactctgtctctaaataaataaataaaataaaataaaataaaaatcatggttaatttatgaaggtctctatcaaatttactttgaaatgattacagtctgtcataacttgctgacttccttgtacctaaagaaatttagcaagtaccttttcttagtgtcatgcatttattaactgagtacttattata

SEQ ID NO: 230873 - DNA, 590 bp, Homo sapiens
ccttcccccatcaatcagcacaggcaaaggccagaagtgacaagtgattgtgtactagacaagctaatgtttgtgtggagaaaacacttttgttccctgaatctctggtggcaaaggacccagaactcaagaagcaaatcttccagtctcctttaagccttctcttccataagtggcctcctccctggaattggaaaccactgtcaagtatctacgtccctgttggcccagcgtgagacttctacacctttggctctttgaatgccacctgacatgaaccctctggccacttgcaaaaggaggtcagaggttgctgccactcatgctgctaataatgtctgataatgataaaaccacgtcctgtttgtcttgtattttatcataaagagcactttgatgtgcagattctctttccaaggtgttaggaaaacaaaagtagataagacacattttcaacccttaatgatcatttcaatccagttaattataactcgtttaatcccagaaatgtagaaaggaggataagagagttattattatccccattttccaaatgaggaagctgggtgttaaaaaataattttcagaaa

SEQ ID NO: 230874 - DNA, 520 bp, Homo sapiens
agcttgggggagaggcggatggggagaagagcatggaaaacagggaagcggctctgggaacaccacattaaagcccatcttctcccagaggtgcatctaaataaatcctggcttatttcatagctatttctgtcaggcttctatttttgctttgttaactgggaatttagacctttcgtctctcttcagccacatatttgtaaacagtctcttccctattctattagttaccatgccccgttatgtagttgcagtagaatttcaagaacatgagtgtacattcagtggaaaacgaggaaggactcaatggaagaaagggcaaagggttaggaatcttagagttgagagaaagtcccggcttcagagcgaagataaagaatgcaacaaaattctacttgctcaaactatacagggaccttgggaatgtcccaagtcagggaaattgggtcaggtcactgaaaaggaattcaaaaaaatagcgtttttatcaggggtaagagtgtgtgtgtgagacctgcag

SEQ ID NO: 230875 - DNA, 392 bp, Homo sapiens
ataaccccagctgggatcccctactttgaactaggggcctccaaaacagaagcaatgtccattagttttgtgaatgtgttttcagtccatgaatggatgctcttaggtaaaacattaataaactgcatcacgttgttggggaaaattaaatgtaaattagataattaaaaacgaagctgatgcccgctgcttggtgctattacctcttattaaaagttatgagaggtggccctgggtggaggctggttgcagggttccaatgagggtgggggcagcaagggcctgcctactggagcccagtgtgatctttagaagaggcagacctagaggatgctctggtatgggcgctggagagctctgggtgtgctggggccacagccctgttgtctctt

SEQ ID NO: 230876 - DNA, 427 bp, Homo sapiens
gaacttaaccatatataagtagttccagggtcacttcagtttcagagcctttgctgtgctgttttgagtctgtctgcacatgtccagctcaggggtgagccccagacatgtactggttcatacccagaattagggatttattttctctcctctgtaggctccacacccccactctcccattctcagttgccccttttcctggctcttgctgctcccttatagtatcacataactaaagctgccctctgaacaagctgcagaagaaaaaaataatggggattgtccccatactcttcagaccacagggaccctttttcccaatccctcttgcctcaaagatgacgtttctcttggaatttcagctgcttgggagccaccaccatgcagctctgcagtaaggctgccctcagagcagagcttggagata

SEQ ID NO: 230877 - DNA, 276 bp, Homo sapiens
acatagaaaatagtcaccatccagtgcacataaggtcacataagacgtttattagagtaatgagaaatcagggaaaatcaatggactgggtgtgttttagcaaacaacataatgacatttgaatatttctttgtttagaaaaagtggtttatagaaagaggaccaggtggattaaaaaccattgaaaattttgagcaaagtaaaatcaaaggcagattaagattatcaatatatttatagtgactaacccaaatgtaaattaatgaaattgttggg

SEQ ID NO: 230878 - DNA, 312 bp, Homo sapiens
acacctaggtggaaagaggggctacggatgcgctcagcatggcttccagccacctttgtatacctggagctgggccgcttccaccacggttgcaaggatggaggaaaagcagaaaggactggggagactggtggggtggaggtttcttccttggagagcttgcagagatgccacctgccaaagcctggggaccaaaggagggggttcttgttttaattgttcttataaaggtaatacacaccagagagaacattctaatagttctaaaaggtgtgtacagtgaaaagtctccaatttacagcattttgttat

SEQ ID NO: 230879 - DNA, 398 bp, Homo sapiens
tcaaggctgcatatccggtgatcttttatgattattatcccttacaactgaacttgagatctgaattgagttactgctatagtttgaggttaaattatctggttgctttactggcattgtgcgttgttgattaagggataatcctaagtaagaaaagttacattgtaagaaaatatagagtcaatataataactagaagataagatggctaaaagaaaaagtccataaaggatgtaaatacagtcatcccttgatatacccaggggattgcttccaggaccgcccacatatatgctaatctgcacacattcatgtcctgtaatagaccctgtggaacccatgtattggaaacacagcttttgcatccttgtgttactatgaataccatatttttactg

SEQ ID NO: 230880 - DNA, 164 bp, Homo sapiens
tgaccccaccccaccccaattctgctcctttgctgtaaattcccagctgtctctaccacatttggagttaagcccaatctgtctcttctcttgcaataatcttttctttaagaatacctcctgggagtaggagagagaaatatataaaaataaataacaaacca

SEQ ID NO: 230881 - DNA, 418 bp, Homo sapiens
ccagatttctccctgctgcttgtgaagttggaagcactgttgctggctcagcgggaagaggcaacagttgtcttgtgcacctgtgccctaaatctcctctactggtgatgagccctttacatctccagggatgcaatttcccctccctcaagtttctcccttccaatagaacttgtgtgtatgaaagctgaattaaccacattccgacttcaggaatgcaacggtctctttcaaaatgtttccaaaacaagggagcaatggcagctattaatccaagaacttagatccaacaattctctccaaaaatacaaaataacaattttcagcccagcaagaatgtatgacaagtaaattgatttatgaaaatgcattagcattttacacagaaaaaaataaagatttcttaaagataaactgt

SEQ ID NO: 230882 - DNA, 341 bp, Homo sapiens
atctgagaggagaagaaaatttaaaaggtgtttcaaacagtagggaaaaggccttgccttccaaaggaaatgtggtatcttctgtgctcagcataggatcctgaatacaatcgggaccagctgctggccaaattctccttcactccacccttggaaccaggccagagctgggcttcaaagtatatttcagtgaaagttcatttcagcttcatcaacaaacatgagtgcagccaagtaatgctgaattacccttatgtaaacaatgtttatctgttgtttccctttgaaaataactattgtgttatttgaataagccaataaaacattgttttcctttgtga

SEQ ID NO: 230883 - DNA, 399 bp, Homo sapiens
aaggctgtttcaggtcacgagttcagtgtcagcctgggtcacatagtgaaaccctgtctacagaaaaactaagaaatcagccgggcatggtgacatgtgcctgcactctcagacagtcaggaggttgaggaaagagaatttcttgagcccaggagtttgaggctgcactgagttataactgtgccatcgcactccaacctgggtgacagagcaagaccccatcttgaaaaaatttaaaaataaaaataaaaacaaaatttgtctcatgggatggggctacactgtggttagaagtagatttctagtcttgtatgtatatgttatctttttaaagattaaaaatacatggcaataggtatgttttttaagatattaagagaagattgtcaaattagccca

SEQ ID NO: 230884 - DNA, 892 bp, Homo sapiens
tgctgggtgtggatcggccgagggtcccacttctgaaatgcgggcaccagccttgccccatggggtggcgacaggacaggcaggagggcaggccgcctctgcaggctgagcaggtgtactcgacctaccgtgtggcttggggaacccctttccctctcgggactcctctagaagttgaggcccatgtgcgtggcgagcatcagctatctgacgagtgggcactgggagggtgaggtgggaggaggctgggtgcccggggcagggagttcgtgggccaggacacccaggtggccataaatcctggctgagcctggggatggcaagtgtgggcccaggcagggacgagagggtctgagcagtcaacgttgggtgtcgcaggccccagctcatgccctgtccgtgtgagggggccatagctcagagattcccggggccggacctccaagtcttgtagcagctaaagttcactctgcctcccactccgaggacagaggccctgcttcaggcccgtcgctcctggggtccaggcccctgctggggctctgggccgacagcctgtttgcctgtaagtgcatggggcctgctggggccgccccttctcagcccttctgcagtggctctccagccagacccactgcccagcactgcaggtttccaccaccgcgtggccccaaataattcccctgtgaagagttcctaagggcacagatgccatgtcggggcgtggaggtttctgactagaggcagagcccgagtagaaacaggtctgaacggatggaactgcaggctgggccccggggtgggatttggaacttcctcctctctttaacaccaacttacaaccaaaacgtctacatctgttttaaaaagattaaaataaccctcaaaatgg

SEQ ID NO: 230885 - DNA, 140 bp, Homo sapiens
aagccttctcagctttccttaaaagcagcagcatctgggaaaagaggttgtcagaaatccccttaagggaatttcacggtcataaagacagaaataccacttgaccctgcttaagtaagcattatcacaaacttcatctc

SEQ ID NO: 230886 - DNA, 256 bp, Homo sapiens
gctctgtgtccccacccaaatctcatcttaaattgtaatccccacatgtcaagggagggacctggtgggaggtgattgacacataggggtgttttcctctatgctgttttcatgatagtgagttcgttctcagatctgatggtttaacagtgtttggcagttccccacccatgctctctcttactcctgacaccctgtgaagaaagtgcctgcttcccctttgccttctgccacgatagaaagtttcctgaagtct

SEQ ID NO: 230887 - DNA, 663 bp, Homo sapiens
cagtatggaaacagaggaaggtcccaagtgataggacggcctgacttggcacttgagtcagatttgtctgtgttccaatcagcattgccacttcctgggttttacaccttgaaacctttttttcacttaattcaaccttagttttttattaactgtccattgcattttaaccgtagagtttccaaggtaagaaaatgtttaagaggtggatttcagaaaagaccttacatatatagtcaaatattcacttgttaaaaattctgatttacctttttcttccctagagtatagtaagtttgtcaggcctgttcctttttaggggtgattttaaacagaatccccgggcgtagctgtgggaatgctaccagggaaagtaatagggaaaatcctcttcccgtatggctataggaaatgaatacatttccacaaaaaaagtagtagattaattggtgaattacattgcttcatcaaaatattagttcctcttttttgcagggtagaggacttgtggagttgatatctctacttatctagatcgtctgagtttaatactgaattttacaagatgggacttggcatctcctagatatgttcatatgtgattgtttactgaatgatttgaattacggaaataatgtgacatgtttattgtctgaaactgat

SEQ ID NO: 230888 - DNA, 492 bp, Homo sapiens
ctagccacgcatgtcccaggcccatggaggtagggaaatggggaatgaatatgtgggcaaaggcaggtccaaagaaaagcctgcatgaaggaggagggagggatcttgtctagtattgatgcctccctctatctacttctagaaaggatggagatgggttgggtaagaccccagtctccctcatccaagaagcagcagctgactgggtaagagccaaaaggcctgggttgtgatgtgaagtgtatgaccttgagccatttactcagcctctgttttatcctctgtaaaatggagacaatagtactgcctgcttcagaggattacaagtacctgtctcatagggtgattgtgaggattgaattaacacatgttgcccaggcaccgtggctcatgcctgtagtactaggacttcgggaggctgagatgggaggatcgcttgagtccaggagttcacgaccagcctggtcaacgtaggaagaccccatctctaaa

SEQ ID NO: 230889 - DNA, 269 bp, Homo sapiens
acttgattgctcatcaccctatacctactgacctctaccgccacctcttttggcatttacttttatttgtttacaagcgtactaatatttcagcatattttataatgttttcccccagagtactacctatgtccaagtagaggctagttgtaccccattatttgttctcttttcttcctcattaactcaactttttgttgggcacttggtggttccagaacacttccaacgtcttttgcagctgggtgtggccagatggctaggttctg

SEQ ID NO: 230890 - DNA, 525 bp, Homo sapiens
aggtcaggacttagagaccagcctgaccaacatggtgaagccccatctctactaaatgcaaagattggctgggcatggtggcgggcgcctgtaatcccagctactcaggaggctgaggcaggaggattgcttgagcccgggaggcggaagttgcagtgagccgagactgcgccattgcactccagcttgggtgacagagcaagactccgtctcaaaaaaaaaaaaaaaaacttctgaggtaggggctgtaccatatttttgccccacacccattaagcgaataccaaaaacaacttgtggaaatttgataattttatcaaatttattatttgggcaggattggcatttaccatgcttttccctattgctggcagtaaaacatgggtttaaggaagagtgtttttcagaatttacactgtatatctctgatttggaagttatataattggaatttatgattatgagattaaaataccaaaaagactaagtaacatatcagtgatgtcaatgaattgttttaaatgg

SEQ ID NO: 230891 - DNA, 340 bp, Homo sapiens
agataaatggattgaaatgatgggtggtcctctcctgcaaagatttctatttcagacctatattgagatgcattttgtgttaagatctccaaactgagtctattccatacttccctactcatttcataaagtgaggctaaatcaggctaactagtgtcaggtataaagactttgctgcacataattgaagcaggaagtatcaactcgtcatttacagtgaatatagaagtttcctccattacttcaggtccataataaaagcctgttgtagggactcagaaatttgggtaatatttttattattattttgctctggctggagtgcagtggcatgatcata

SEQ ID NO: 230892 - DNA, 570 bp, Homo sapiens
agaaggagcattttgacatcactggacttagcatacaggcaatattaatacaggagttaaatcaaaattattttagggagttagtaagagtaagggttctcaatggaatttttctttaataaaacagggccccagagctatttgttttcctaaaagaaagcagcctaaaacgtgaagctgtaagcatagatcagcaagctggaagcttgcatatgcaaatgccaggagctatactaaaagccaggtacaccacacatgacaattttccctcctttttctgtcatcacgtgtgcaggtgtcatggcatcggccaggtagagattacatttacataataaaagattagggtagaagggacattttctttgtgggctatgtaaatggcacacctggtcaaaccaatctcctgggccctgtgtaaatcaatcactgcctcctcaatccaatcctctataaaattgaatctattctgccccaaactcagaaacccccttgggtgacccactttttctgaaagaggaagctctgtctctccctttcttctattaaactttctgcttcttaaactca

SEQ ID NO: 230893 - DNA, 618 bp, Homo sapiens
aaaaacatcagctctcaaatgtggagtctttgtatgaaagggctggcagtaagcactgaattcattcagacacagaattaagtctaaataactctagtaattacctacagctatccactttaagttgcctgtcatttttggtaaaagctgccaaatccatctgattatctcctctaactatgccaaaatggaaacacacaaaagaaaccctctcctgaacggaattaacttgctctacagataatttggggtttagagcttaccctttgaggaatagtatactgaagaaattcctcaaaagagataatacaaatcacctggcgtactgttccaagcacccaagtgcttgctttggcccttccattgacttaccatgccaccttggcaaactccttaattgctttgggattcatacaaaaaaccgatatacctgtgtagtccagctcatggcattgtaaggatcaaatggcatgctgtatgcaaaaggtctttggaatctatacacaaggctgtaaaactatgtcacactgtttggatggaaagaattctgtattcaggagccaaaatcagatattcagagacaaaaaaaggaagagatggctcctgcggatctatccc

SEQ ID NO: 230894 - DNA, 460 bp, Homo sapiens
gagaaatcagcctaatccaaagtctgttggggtacctcattcttgaaatacttaagtgcttgtcttacctggtggggacagagggtgggggtgagggacaaaagacaatactaaatctaacctgatttataccactttctcagcttatatagtggggtgattcaaggggactgatttcatgagatatatccatatactttttatcaagtaatatttcaatattaaaagtatacagataacattttaatcccatcacttgtgatgcactactaatttaagttagaattacaaaactaggaaactccttcccagtcaagtaaattacaaatccttagccaggcacagtggcccatgcctgtaatcccagcactctgggaggctaaggcgggcagatcacatgaggccaggagttcgagaccagcctggccaacatggcaaaaactcatctctacaaaaatac

SEQ ID NO: 230895 - DNA, 1224 bp, Homo sapiens
  misc_feature (491)..(491): n is a, c, g, or t
cttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcnctcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaa

SEQ ID NO: 230896 - DNA, 387 bp, Homo sapiens
actatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttcctggcatacgactctaggttctgaacaataagcagtgtagtctttgcttttcacattagtgcattcctagtgaccaacaaggtggggttcttgacaggttctttttactcacatgaatgtttgagtgggacattccaca

SEQ ID NO: 230897 - DNA, 353 bp, Homo sapiens
taaaagagaacaaaatttaaatattaattctaagctgttctcttagctcagtggagctggaggaggaaggaaatggggccagatatcttcaaagtagacatatacaatggctgaacacaaacagaatcacattttgcaggtaggagattaagcgtcagaattcgtgtgacattaactggtcccctgcctgcctccagcctggctccagtcaattcaactctgagcttctggactctagccaagctgtgctcctgttcaaataccttcaacggtccccaccaacagcagtggactactaatttctttggccaagaaatcctctctccaaaagatatgtcactgaaacctaagca

SEQ ID NO: 230898 - DNA, 480 bp, Homo sapiens
ccataatttagcaaaacaaatcctgctcattgcgggcatctaaatggtatcctgttaaatttccatacatgcttttcttttctaaagttatggcctacaactagaagaagggatgaaacatcacccctacctccacatcttatttcctgtatcaaatttcgaagcccttggagatgcaaggcgggtttccctaatgagttgagaatcaatgcgaatcatctgaaatgagaggtggcccgtgggtgtaatccatccctgctggtgctccaacttggttacacatttccagaaaccagcacctccctgttgtccatgtctggtcatcagaggcctctctcctcaggtgggataaccagagaccaagaaagaaacatgtttctctcccttggaatttctcttccttagtcattttcagaaagttaggagtcggcaaccttaaggaggagtttcctatcatctctcctccacttcctcccctcg

SEQ ID NO: 230899 - DNA, 326 bp, Homo sapiens
acattcatgtcaaggggtgagaacgttcagtgacaagtgcatgaaaactgtacttatggtcaatgaagatacttctttaggagaagccaggcgacgattctggttgggaagcaatagataaggaacagttcaaaatgaccagtgaaaatctttaggcattaaggatccagtcactgatctaaagtaaggcttctctaaggcttaaggattagagtatctttaggaaaagcaacttatgtaaaagatgtctcaaagaacagaataatggtccataaatattagaagatagaagtcctaaaacaactaagagtaccataataaaaaga

SEQ ID NO: 230900 - DNA, 722 bp, Homo sapiens
actcctgacctcaaatgatctgcctgccttggccacccaaagtgctgggattacaggcgtgagccactgcgctcaacctaggtgtccaccactatgctcggctaatttttgtatttttggtagaggcgggatttcaccatgttggtcaggctggtcttgaactcctggctccggttatccaccctccttgacctcctaaagtgctgggattacaggcggtgagccaccacacgtggccttgatcatgcagttttaatggaggggagtggaagtgacagtagaggccttttgacaagattttgctgaacaaatcaacaagtagctagaggcaaagttggcacaggggaggtatgacatgattgggtagaactgagcatgtttaattaccaagtagacagggctcagtggagaaaggggaaaaggaaaaaaagaagaaagcatggctccggggtatgtgaggttggacccagagcagagctgttgttcacgatgtccgctgtaaggggcccactacgtgcttacaaactcctggactctgacttgacttcacaaagtccacttccaagagtaatgtcaaccagctggagaggaggtgagagtctgtaaggctgccccagacatctgaagggctttggacaagcagggtgctggggtaggacagtgggcgatattgagggcccgcttactctatggctgttcactctgattttcttttttttttc

SEQ ID NO: 230901 - DNA, 408 bp, Homo sapiens
gctgtgtaaaattttttatgccagacctaaattttattcatgctttcaatgcctgtactttgtgtatttttaaaagctatttgcattgtaagtttgaaagtgagttatgttctctggtgtactcttagtatcttagtatcttgagtgtgttgaacttaattgtaatttatactaatttcctctctattcctttcatctcatctttaaagtgctgagggaaaggaagaggacttggtggcaagagccaagacaaaagaacaatgtgtgtgtaatttgttcagaaggtacaaagttagatttgtgatttgttgatgcattatctcatttctcaagtaattccactaagtaggcactattattcccattttatagaaaacaaaatgtagtgacagagcgagactctgctta

SEQ ID NO: 230902 - DNA, 499 bp, Homo sapiens
tgcctttaaatacttgttatgaagaagttatatttgcaaagttctaagaaagctgcaatcacttgctgttgccggaaactgccttgtggcctggcgtcctgggaatttgcttggctttttgtggccgccatccaaaactgggaaccacaagtcaaagatgctgggaaatgccatcaatccagaagagaaatgcagccgcgtgatgcctcactcaccagaagggattgcagggtgaccctgtctgattaccagcctcgacttaggaaatacagccaatgatgaaattcatggcaggcaaattccctgttcaaggtggagcaacagcatgatggatgggccagcagtgatggatagcccctctgaattttggttcatgggtttcctccggcaaggactgagttgtcccagagataacactctaccagcggctgggctctgggctgaatgcttgcttagggataacaccctcattacccagtaaagcaaattattattgaca

SEQ ID NO: 230903 - DNA, 162 bp, Homo sapiens
tatattcactcaaaaacacataatgattcaccaaatcatttatgaatacaaatcagcaattttgtgatctcgtaagcaaatatgtctttggcacgtgaatatttttccatctgtgttcattgatgttaacaataaaaatcttgtttatgtgtataagcctaa

SEQ ID NO: 230904 - DNA, 267 bp, Homo sapiens
atatttatagtggctttattcatggtggcccagaactgggaacaactcaaatgtccttctattactgaatgaataaactgttacacatctatgtactgtaacactacttatcaatggaaacgaacttcttctttttatctgagacagagtctcactctgtcgcccaggctgcagtgcagtggcactccgtctcaaaacaacaatgacaacaacaacaacaaaccatgtgccatggtggtttgctgcacagatcatcccatcacctag

SEQ ID NO: 230905 - DNA, 466 bp, Homo sapiens
ctgtgaaattatattaaaaatttatgttaagattcacaagtatttgcagtctgaatctattgtatttatatcctgagtttgggtgataagagtctggatagtgagggatagcaggccattcacatctgttcaattcctgagttttggatagcaagagtgagagttcagagagtgggaccgggcaccgtggctcatgcctgtaatcccagcactttgggaggccaaggtgggcggatcacgaggtcaggagttcgagaccagcctggccaatgtggtgaaaccccgtctcgactaaaaatataaaaaattagccaggtgtggtggcactcgcctgtagtcccagctactcgggaggctgaggcaggagaatcgcctgaacctgggaggtggaggttgcagtgagctgagattgtgccactgcactccagcctgggtgacagagtgagactgtctccaaaaaaaaaaa

SEQ ID NO: 230906 - DNA, 553 bp, Homo sapiens
gataacgaaataagttgcccaggacaaaacaaagttttggaaaggtttgaacagactccgtctgcacagtttccttgagacatgcgaaatgtgtagggaacgaacttcctttcaatatgagcacacatttgccttccatgggataagacatgcttagtgcagctgctgtcggagagctctgtcagggcaagactcacagttgaaactccctgcctcaagttcttgtatttgcttaaacctggctgagtttttgcagctggtacttctatttgatttgcagtgtgacactgcccttctcattttctgtctttgtggttgccgatttttcatttttattgatagcagcaggtggcagaaagcataagaccattataaggaatggatgtatttgtggagcatttatttatgggtcctagtagatattaaaacgttttggaggctgggcgcagcagctcatgcctgtaatcccagcagtttgggaggccgaggcgggcagatcacaaggtcaggagatcgagaccatcctggctaacatggtgaaaccctgactcta

SEQ ID NO: 230907 - DNA, 446 bp, Homo sapiens
ccactcttcaggaaagggacattcctggaggcagaaatgtagcgcagctctgaatgaggccccaaaagatgggagatgcagaagcccctttgggaggagaggacacctgggcaacccttgaccccctttcccacccccacctccaggttgggagcacgttcctgcacgtggctatgctgtggggcctctctcatgagtcagagcggagggagacagctgtgcctctggagtctgcttttaattgtctggaaatgcagagatgtctggtttttgcctgagcaaaataggagtttatttttgtactatcccgagctggctaaggagagtcacgtagctgtgggcggggtcttggggatgaggaggggtacagcaggcagggactatgctgaagtggagctgggattacaggtgtccgccaccacgccgagctctatgcagtctcaaaa

SEQ ID NO: 230908 - DNA, 460 bp, Homo sapiens
tgaggttgaggcaagagaattgcttgaacccaggaggcagaggttgcagtgagcggagatcacaccactactagcttggcaacagagtgagactccgtctcaaaaaataaaagaagacctgtctgatagggaaggttcttttaagtgagagaaagatctttaatttttatgtatttatttatttggagacagggtctctgttgctgggtttggagcagtggtgcgatcacacctcactgcagcctcaaactcccaaattcaagtgatcctcccacctcagctggtgtgtgccgccacacttggctattattatttatttatttatttatttatgtagaggcgaggtcttgctctgttgcccaggctggtctcgaactcatggactcaagcagtccttgcctcagcctcccaaagtgctggaattataagcatgagccaccgcacctagccaagttaaaaa

SEQ ID NO: 230909 - DNA, 352 bp, Homo sapiens
gcgttgggtttgaggttctgggagagcaagaacccagaagaatgcttacttgagccctgtgagaagctgggaaaatggaactgaaactctggagatagggtttggggctttggctttgtattggctattggatttgtactggtgattggtgagaggatgagaatgtcctgggggagagcttccttttggaaatgggaagaagtgggttgaggtctgaatgataaaatgaaccagctacaaacagttcaaagtctgttattgactttttggggtcaagtgccatatcttgcaaataaatcaaatgtttatccgaatagaggagtaaaataacagtctccaacttttgaacatg

SEQ ID NO: 230910 - DNA, 516 bp, Homo sapiens
tttatgattatcctctgcttgtcaaactcattattgtgactcagcaaatttgatttgagctttgtaaacaatgtttaatgaaataaaaaaaaattaggtaactcaaatatcatctaggtattgccaccctttaatataaaatatgttgagattgaagacttattctatgctcaaaaatccaatgccaccaatttctgcaaatcccatgtggtagagggaggattaagttctcacgctcacttttcttcccagctccctgcatctgtcaaatctcatatttctttggattcttatgacttttttttaaattcacattagcaacaaccaaaatgtagttccccttccttcatggatgacaaaaaaaatacagttaattaaaatcttggtaggtgatgggaggtttatatcacagtaatgcaaagggtgagttttagatatttttgttcttaaaagtcctttggatgcttcattttttcttgaccttttttctcttctcttacccatactcttggggca

SEQ ID NO: 230911 - DNA, 539 bp, Homo sapiens
caaaagtccctatcttaatggggcttacattccagcaaggaaatacagacagtaaataatgagttatatgtgtatcagatggcgatagctgaaacaaagcaggcaggccagggtagcgaaagttttcaggaagcggggggtttcaatttgaatgagttggttagggaagccctctctactaaaatgacattaggcagaaacctgaataaggtgagggagtgagtcttgcaaatatatattgaattcttgctatgtgcgagacactagtctaggcactggagttatacctgtgaagaacacaggcatggtttttattctccaagaacttaagaaaatttgggatatgggaaggtgggataaataaagttatcttgcttcaaagtcacttgatacttttctatatacaaaaatgactttagggccaggcatggtggctcacgcctgtaatctcagcactttgggaggctgaggtcaggagttcaagaccagcctggccaacatggtgaaaccccatctctactaaaaatacaaaaattagc

SEQ ID NO: 230912 - DNA, 605 bp, Homo sapiens
tctgcagatactttttattgcactttttcgcaggtatgccatatttcacaattaaaagtgttaaaaactattcatgtctgtacatggttagtgatttctatccgttaaggaaagatacataatgaaaagccaattccagcctcccacctctgccgcctctcagctcaaagaaccactgcccaccagattcctctgtgcttatgaagtccaagtgacacctaatgtattttacgtttttaatgtatagaaaaggcattgttccaccactcaggtcttcaccttgctcttttcacgtagctgtagtattttgaagatctctcatattggcacctgtcactctttataacagctgcagagcgttgtgttactttaaaagggtcctgttgatatttggacagtggttatttaatagctttttatcatgataaataatgctgtaatggagtcctgtataatcctgttaaatgctgtttagaatttctatagggtaaattcctacggggtgtgtgtgtgtagtgtgtacatgtggtttccttaagtggatcttgccagttcgccctccagaaagatttgctaattatacacttggtctgtttgtgctgctg

SEQ ID NO: 230913 - DNA, 598 bp, Homo sapiens
tttcactatgttgaccaggctggtctggaactcttgacctcatgaaccacctgccttggccaaagattcaagtcagtgcaataaaaaaagtacatttctgatcacatctccatttcttcaacatttacatatttatatttccaagatactccatacagcatgaatccacgaagaattaggcttcgactaagattctttctacattgatctcgagtttagcaaagggagcctatgaatgagctgccttccctgatgtcagcactgaaactcgagaaacaagtttctctgaaatctctggatcatcttacattctggcgagttctaccttctgttaatgaaggtagtcgtctctttccaactagatggtaaatttgttttcctgatttgtcattctctaaactaataacctgaagagaaaatcagtctctctccagaattttcttaaaaaaaaaaacaaaaaaaaccttctgtgacacttttccgagctaacccattcattcattgtaatcactgacaagttttttgacctattcagctattcatccttttatccatttgggtagtaacttaaattccaaacttttcccagcacaccgtt

SEQ ID NO: 230914 - DNA, 509 bp, Homo sapiens
tatgattctcactttcaagcctactgcaaaggtagctcagagtcaagtcagaagggctagtactacaatatgaagccagacaagcgcagcatgctggttcttccacaatgatatctgcaacttctgaccactcaggccactcatcttcgttatcactctgtctcttagggatttcctaacaaacctaatgtgccatgtatttccagaaactttagctgtccttttaaacaataacaatgatgccagtttaaatcatttttaaactttgttttcttttttacatttttattaataggtaatatatatttgttatagaaaatatgaacaagaaaaatatatgaaaatctctcagggaggtaaccacggtttatgttctgggatataatctactagagttaaatgtaagcatttaggcaattatgcacttaaaaataagcatgagatggtactacaaaaattgcttctgtaacctgtttttccattatatttatatatatttattcatacac

SEQ ID NO: 230915 - DNA, 204 bp, Homo sapiens
accccccccacccacaccatgagaggatttccagggcccacccgcctccagtccccgttctctctgctgctttcgaggtcaccctgggctggaaggggtgcctgggatgctgctcagacgtcttggccgccctcccaccccccaacaccccgctcctggttttcaggatgaaattgtcctcaaataaagcaagcttttgagtca

SEQ ID NO: 230916 - DNA, 449 bp, Homo sapiens
acacatggattacttttctaagtagtcattaagaagtttctctcctgggcacagtggtttgtgtctatggtccctcgtactatggaagctgagacaggagtatcgcttgagcccagaagttcaaggctgcaggtgagctaccactgtgtcgttgcactccagcctggaggacacagcaaggtgggtctatccttaaaaacaaaacagtttcccccaaaataacctctgaagtactttaaagtacagcaattaaggaatggcaagcctggtataacactgccaatgtaacaaatactggaccggctcttatccatggaggttcaattccaagccctccaaaatgtccaaaatgtcaatctctgttcttccttttctagtctagtatttctttggatgataaaaaacacactgagtcatctgattctcagaaaattcatactaaactgcac

SEQ ID NO: 230917 - DNA, 482 bp, Homo sapiens
tctgcagtttctgcatttctaatattagtccaatttttaaaaatcctgatgtaagtcagtatccatatcttgttcctaactcctcctaatattctaccattaagaagcacactggctttacggttaaaatcctatggttttctttttttatcatgttaaggtagcaaacaaatttgctatttttataaaatctaaaatatattttaaaattaattttttcatgtaattgaagtgattttattttccccttaacttactgcgatggtaatattagtagattttctgatcaactttgtgtttctagaatagaatccatttgcttatagtatattttagcaatgcactgccagcttctctctgttaataacttctcaatattgatgcttgcataatcttaagtttgaggtttcttttcaaatcatacattcatcaattttggtatctttatgctatttaataaatagaaaattttcctcctttta

SEQ ID NO: 230918 - DNA, 458 bp, Homo sapiens
ttaaatttttttaagaggcaaaagtatatacagtcgtgtgctgcataatgacattttggtcaatgtcagactgtatatacaatgatggcccataagagtataatgccatatttttactgtaccttttctatgtttatatatatttagatacacaaatacttaccatcatgttataagtgcctacagtattcagtatggtaacatgctgtgtgcaggtttgtagcttaggagcaataggctcttccacgtagcctaggtgtgtagtagactataccatctaggtttgtgtaaattcaatctatgatgttcagatgatgacagtgtcacctagggatgcatgtcacagaactgtacagtacaagctcagccaggttaggaagaaagtacacagaatagaagaggcatccaacaaagtggcctctgggtgctgtatcaaaataaataaataaataaataaa

SEQ ID NO: 230919 - DNA, 379 bp, Homo sapiens
agatgacccacaggtagcactgccaagcccaaacctaaattcaccatctttctcagcatggatttcttatttcacatgaagacaccagtatccactcagcatcttaagccaaaaacatcagcattgtttctgactgtcccctcttcctcactcatcacagtgaatttgtaaaaggcctgtcatttctaccttcaaaatgtcttcaaacatcctcaaccatctcatcatgtctgacctgttccagtcaattaactggtcctgactgtcctagttccaagctatactccacacgactgtgtgaagggcgtagcatgcaatgcacccatgctgccaccctatttatcacccctcaatggctctcccctggtgctggagatgg

SEQ ID NO: 230920 - DNA, 389 bp, Homo sapiens
gaagtggcactgaattataacccaaaatatgaaatcaatattcataagttcatactgatataaataagttattgaatacataaataaataaggacaatagagaaatctttcataggtcagttttccaaataatgtatataaatactctctagaaggtggagcataactccttgcatagtaaatgtagtttgaattatactttaagttatagggtacatgtgcacaatgtgcaggtttgttacatatgtatacatgtgccatgctggtgtgctgcacccattaactcctcatttagcattaagaatatctcctaatgctatccctctcccctccccccaccccacaacagtcgccggtgtgtgatgttccccttcctgtgtccatgtgtt

SEQ ID NO: 230921 - DNA, 724 bp, Homo sapiens
ggaaaaccaaactggaaaaatgtatggagatgttggtgaaatgacaggaacgaaagcagcttgtctgagcttgatctcttcacttcctcagtggtggttctgagcgctggtttggctgaactccacttaccagggaaaagggcataaagtaaacagggtttgtgtggaagaagtggagtagaacaaagtggagaggatctctgttcatttagtgtatctgacagtgtgcttgtcaagtcataaaacacttgaggatggaaatctggaagtcattgtatacattttcttctttccctaacatctagtcagttacagtttctgccagttcttttgctttttccatgtttttggaggctgttcctcttcgctccacatgtagtaaatgctctagttcatgacccatgtcttatctggactgccatgtcagcttcctaactcatccattcacagcaccagtgactgtaaaacagcattagtgaggataaaacagtggctgtcaaacttttttgactgtggcccccagtaaaaatacactttgtattgcaacttatgtatactttatatatgtatgaataattaaaacaaaaggttgattcaagaaaaatctttacatttaccctgtgccatgcaatcttatatcttgtattcttttctgtttcatttttttaaatgtgtgcttgccatccactaaattgattccggagttggaaaaacactgacctga

SEQ ID NO: 230922 - DNA, 529 bp, Homo sapiens
tctgggttatggactggttaatgtccagccggcctgaaatctgtggattatctgtctccctggacagagatcactgcatctgccttcggctaaaatccagataatgggacacgtctctgagtctggaacctttgaacagcaaactgggaggtgaactaagtcccccgcagcccaggtcttgggaaccagcccaggtctcgggaaccttccccccagccctgcccactttagggacttagttccaggtttcagataactttttctgacaataattaacttttaatgtatactaagagaaatgatcacgagacatcaaatctgtgacagaaagtctcccatgtaaatacatttatctaagtacaacattggttattttaaaggaaggtatgtttttaagtaaataattgtgtaggcacctgcccgtcccaaggtgccacaaggctgtgagtgacattgttttaagctgctgggcaaaccaaatctcagctccataataaatgacgtctttaattcagtgatgctatctttt

SEQ ID NO: 230923 - DNA, 389 bp, Homo sapiens
cagtaagctctcactaacttcaaagccatgtgtatatataggtattaggttggtacaaaagtaattggggtttttgcctttgaaagtaatggcaaaacagtcccggtgcggtgcttcacgcctataatcccagcactttgggaggccaaggcgggcagatcacctgaggtcgggagtttgagaccagcctgaccaatatgttgaaaccctgtgtctactaaaaatacaaaaattagtcaggcatggtggcaggagcctgtaatcccagctactcaggaggctgagacaggagaatggcttgaacccaggaggcggaagttgcagtgagctgagattgcaccactgtattccagcctgggcgacagagtgagactctgtctcaaaaaaaa

SEQ ID NO: 230924 - DNA, 486 bp, Homo sapiens
aagtccaggagatggacacatctcagctgaatcctgaagaataactaaaagttaaccaaaccaaagtggacaggaggagggatgggaggacaatctaaacagaggaaaggacctgcctcaagatgccaaggagacagcatgggcctttccaagcagatgcaagggttgaggaggttaggagactgagcaacaaagacatggatgttgaagggtacactggttccattctttcgtgccacccaagcatcctctcaataagctcgcctcccactgcacctactcttaaatgaatttgtttgacctgtggtatttcatctgcaatcacaagagactggactaacacaatgtgttcagtcaatatttacaactcgaactaaatggacctggaacttccgggaaggtagaagaaggcacagaagtagtcatcagcttactgcgaggtaagaggaggaagctacagttgagttgaggaggctttgcctggcc

SEQ ID NO: 230925 - DNA, 113 bp, Homo sapiens
gcaaactgacacctcagggacaaagagatctggacagaatcgccggacaggtggcagctgccaacaagaagcattggaacaaaccatgctgggttaataaattgcctcattca

SEQ ID NO: 230926 - DNA, 890 bp, Homo sapiens
ttagaggctacttccttctagtaacaggaagggaagttccagcatgaggtagttatccagggtagaaggtcctttgaggggcttggttgaattgagagcatcatctctagatgatgctgttcctgctgcagatctctaggatggagagaattctctctttagtcagagaagtttatgtagggaggggtattggttttgcctttgtgtgtctttaaacaaatgaacatttatttagctcagattaattaggtattttgcccacataaagacttctggaaaatacttaaacttgaaaaatcaacatcacatgttttaaagctagggagaaagaaggggggtattaaaatgatgttgattattttgtattttgccaaggtgtgtgtgtgttatttccctcccactctcatgagcagtgagtatagatctccttctctgattagtatgaatatgatggcaggactcggggatagtccctgcccttgacatagccccctaaaacggaaaaagaaaaagccagtttttgcttgtactttgaatgaagatgttttaggcattgtaccatttagcggggatgataccaggtggttgttagaattgtgcagtgtgatcattctaaacagctgctggtgctccctgtcacctcaggtgaactctgtggtctcttggagaggtagcactctgaaaatacctcaggtttgccaccgcaactctgaatacacacaaaaggaaagctgctcagcatggccattttgcatttgtataggtagtgactagatgtacacaacttaatttgctgggaatgaggggcttaatattatctgagatcattgagaacccagatcagacagaatagcttgaataagttacattttccaattaccctttttcca

SEQ ID NO: 230927 - DNA, 862 bp, Homo sapiens
cttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtccagtcttactgagttgcttgttatctgtgctacgagattcgaaaggtttgactcgttctgggatatttgggagggatggagggaaggaggcggggggtggttctacaccccttcggcctttaacctgtatctttaaagtcgttttcctttttgtttctgaaagtaatgaacgagatgagatttcccatacagatgagaaaccctcggtccgacctcttactatttcttag

SEQ ID NO: 230928 - DNA, 525 bp, Homo sapiens
ttttttttttagagacagagtgttgctgtatcaccccagactggagtgcagtggaacaatcacagctcactgcagcctcaaacccctgggctcaggcgatcctccccacttcagcctcctgagaagctgagactataggcacatgccatcacaccgctccaattattctaaacctagctttaattctggagtgactaagcaactcagctatttgttggagaaatgagaattcaatactcactaagtaactgatattgcttaaattaagcccctgggatacaatgatgagtaagacggtccctaacttcaaagaactgaaggtggcctagcagttacatcctgtagtcctggcgtacatataaacagcctcagaagaccaaagagaaaactaactctatctgaaggaaagaaagcttcaaaggggtgatttgggttttgaagagcaaggaagtttactaggaggataagaaggaaagcatgcctgattcaatgtcactcgccataggaagccacaccaatctgaac

SEQ ID NO: 230929 - DNA, 604 bp, Homo sapiens
ctgtgccaggctcaggattggacatttatggaataggtcaacaattatttattaggtgcttactatgggccaggctgtgtcctaggcacttagggtacagtatagagcaaaaagaaaaacacttgccctcatggagcttttattctagtggtatgttagtttgctagggctgccatagctgggtggcttaaacaacagatgtttattttcctgcagttctgtaggttggaagttcatgatcaaggtggtgttggcagggctggtttcttcaggggagctgtgcgggaaggatctgctccagacttcttcttgttgacttgtagatggccctcttctccctttgtcttcacattgtcttccctctgtctgcatccagattttctcttaaagaacatcggtcatattacattaggtcctactctaatgacctcatttgaacttaattacttctgtaaagaccctatctccaaatacagtcacattgggctgggcatggtgtctcacacctgtaatcccagcactttgggaggcttagatgggcggatcacttgagcctgggagtttgagaccagcctgggcaacacagcaagaccttgtctctaca

SEQ ID NO: 230930 - DNA, 1213 bp, Homo sapiens
cggacgcgtgggggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaa

SEQ ID NO: 230931 - DNA, 529 bp, Homo sapiens
gggggggtctagaggatcccgcccggtatccccacccccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaagcccctggtatccccacccagcattacagttctggaacatgttatttctccacttactggtttaagtgggttcaagtcactggataagtatcataatagagctacttagctgtggtttcaatacccttctgttaacaatttg

SEQ ID NO: 230932 - DNA, 331 bp, Homo sapiens
ccaccccgggatgctgtcggggggaagtttttattatgattatttatttaattaaaaaaaatttttttttggaaaaccatcttgtttgttgactgagggatctggtttaaaaaaaaaaaagctgcggctgctgacgctgccgggccccagtgtgtgtgtttgtgtgtgtgtgagtgtgagtgtgttggtgcatttgtcttgggtggccggagcagcgttggggaaattccgcttattcttcttcttctgcaacttgttattccggagagtctgcctgcacccctcaccccggggccggccctcccgcattcgcccccgccgccggcggccg

SEQ ID NO: 230933 - DNA, 360 bp, Homo sapiens
atggagtactcagccagctgtctcctctaccacatctctattctgtttcatattatcagttgtccgaggaactagcaagggcgtatcctgagctaactctcgccatattctcaggtatgatcaatgaactggttagtagtttctatttgtcaatcatttcttcagaaacaatttttagaaaattataaatttattaaattacaggttaaatcaaaaccagacatgtctttacataggaaatatttttttcttcaataagaactcttaattctgatcagtcacaatatttaggtttttctatcaacggcgtccttatagggttttatacctgaccttcccttcgctccctactccatcaaa

SEQ ID NO: 230934 - DNA, 623 bp, Homo sapiens
gacgtagaacccagtgtggcaccaaggcttttggcctaagcaaccagaaaaaggagctgtcctggaatggtcaagagttcagttttggacatattcagtctcaaatgcttattagacttgcaaatggaaatgtcaaataagcactgagacaaattagtctggagttgatgggagagtcccagagcaagagtcatcagagcacagccagtatttaaagtcgagagaagagatgagaccccaaaggagtgagggaaatggaggcgcaaccaaccacgctgaagagaacgaaaacacagagcataggcagtacattcagaagagtgtgtgggaactactagcccttagaggaaagacaaaacaagaggacagaagtgtacaacgtttatattctcccatccccaaaactgaaataaaggaagaacacaactggagtgtgaccaagtggctctgcacataccccacccctagctgtcctggcaacaggcccctttcataagacaacaataaaatattgcatgcaaatgaagaaaacagaaatcagaagcagggccaagacaacagcactggctcctcctttgggaaagttctgggaggagacaatgaagcagactcacatggctgca

SEQ ID NO: 230935 - DNA, 588 bp, Homo sapiens
aagacagagtctcactcacgttgtcacctaggctggagtgcagtagtgcaatctcagttcactgcagccttcacctcccgggttcaggacacgccaccacacccagctaattttcttgtatttttagtagagacacagtttcatcatggggctggtctcaaactcctgacctcaagtgatctgcccaccttggccttctaaagtgctgtattataggtgtgacccaccgcacctggcctaggaagaattttagaaagaaagctccatatcaggaattgagaagccggtgttttaattgagaatatatttgcacagaaaaatcttggcataaatattggtttacaaaacaaacaaacaaagtaatgtcctttaatcttggatcaggagctgcccaacaactccaaaaagtcagctcatgcaaaaccatccaaggacagatgaatcagccaaacaagagagaaaggggaagggaaagtgtcttttcacaggcagcttttgaggcagtgcataaaccatgcctctgcaccatccagaccagacagttgtgacacagggttgacaaagcaggacaacgaagggtagctgctc

SEQ ID NO: 230936 - DNA, 421 bp, Homo sapiens
cacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtga

SEQ ID NO: 230937 - DNA, 625 bp, Homo sapiens
caaaaaacacatgaaaaaatgctcatcatcactggccatcagagaaatgcaaatcaaaaccactatgagataccatctcacaccagttagaatggcaatcattaaaaagtcaggaaacaacaggtgctggagaggacgtggagaaacaggaacacttttacactgttggtgggactgtaaactagttcaaccattgtggaagtcagtgtggcgattcctcagggatctagaactagaaataccatttgacccatccatcccattactgggtatatacgttaagattcttatacaaagcaatgtattgccttatatggtatctctataaatgtacataaagcaagtaattataattttgacatctaaccatgatatataaatctatatctcattctttgactaattttaatatcgaacaatttatatattggttggaagtttgaaagactttttttttttttagacgaagtcttcctctatcccccaagctggtgtgcaaggcgagatcttggctccttgcaacctcaacctgccaggttcaattctctggcccaaccttccgcgtaactgggattacaggtgcccaccaacccgaccggcttatttttgtatttttagtagagat

SEQ ID NO: 230938 - DNA, 554 bp, Homo sapiens
cgctgggccatgagccctcttcacttgttagctagaatcttccaggaagcgcatcggtgcctccttccctgtgcctggttcctgcgggacggcgggagggtcactggccacgctccttgattcaccgagtgcagggtgaagagctgcctcctctaacagtgacagtcatgttgtaagcatcattttgcgtggctctaaacacatttggtggccttactttccctaatgcagccacagcatcctgtctgtgaccagaggcacctccgcatctgctctgtctttatgaccagccctcgttgtccttgcagcttcgtggctcttgggtgggacaaggggtccttgtcttgtcccctcctgccctggccctggggagccctgatttctttggggaggagaggcatccacagcctggacttgacaggtgctcgccgtgagccagccctgcctctcaggcctgcctggtctgtctcctcgaaaggtcaaacagcccgtgggctcccatggatgcttcctgtggcccagggctaaggtgccatcctcccaccctcgcctgg

SEQ ID NO: 230939 - DNA, 515 bp, Homo sapiens
cagcacagagctaaagcacagtggtgacaatggccgggaatcaagtaaggtgaggtaccctatatcccatcttgctgactacccagtgtagtgcctggaacatacaaactgcacattcatactttttgggtaaattattgacaagtaaaaatgaatgaaagctaaacagtaacagaacattttctaccctttgtcttcttgagatgttttaggagactaatccttgttgttcttttccaatgtaaatttttatgaaccatcaagatgtaatgcaggcattaagattatttctgtagagattaagaacatgaaaatactgatgcttaatatttagcagaaccaaaaaaattgtggtataattacaactctgtaaaaacaaagtaggccgggcgcggtggcacacgcctgtaatcccagcactttgggaggccgaggtgggtggattgcttgagctcaggagttcaacaccaccctgggcaacatggtgaaaacttgtctctactaaaatacaaaaa

SEQ ID NO: 230940 - DNA, 413 bp, Homo sapiens
cccccgctaaaaaaaataggaagaatgaaataagacctagtatttgctagcagcacaacagcgtgactatagtcaattatttaattgtacattttaaaataactgtaaggataattgaactgtttgtaacacaaaggataaatgcttgaggggacggatacccaattttccatgatgttattactcactgcatgcctgtattgtatttcactgcagaaattccatttgattagaatgctcaaaatctactaaaggttttatgtagtatgtaaaatatgcaacatcaaaattctgaagtctgaaatatttgaccacaagaaatttagaaaaaggagttgtggattctttctgttctccattacatatatccccaaagcacacatactttaacctgtgctgaaaatcataatcta

SEQ ID NO: 230941 - DNA, 369 bp, Homo sapiens
ggcatgttggcaacatggcccccaaggaaaaaaaaaaaaaggagagatccagcacagttgctggtaagggactcttctgctgggctcccaccagcagctctaggatcagacctggatatgagatatctcttacctgttgcgcttttgaaatgtttctgtgggaacatttgtatgagcatcctatgagtgggagagtgggctgggatgtgcatcctgctccctgaacccttccatccgagactgtgcccacatccgaagcacaaggacatcaaatcatcagcacaagaacatcaacaggaatgccaccctccccagtgtctgaactccctgtccctgtcaaataaaccagaacaaatgcccatggaaaaa

SEQ ID NO: 230942 - DNA, 379 bp, Homo sapiens
actttctgagtctccatctcctcctctgtgaaataaaaatgatcataatacctccctatggggattgctgagaggagtaagtataataatcactgtgctgttcctgggcatatcaaaggtgctaaggagttgcctttgagtctgaatgtgaacaaggaagctcccggaaggctgaggtgcatctccttcatctctatatgcagagcgtaacgccatcatttgacgcctaaagacagcccagtgtttttgtagttgaattcatttgcagctctcaaccctttactcattccaggtttctgtccagtggaaaaacaaattgactgtgaccttttagaaatctaaataaatcaatgaagaaaaaagatgttaaaccacctca

SEQ ID NO: 230943 - DNA, 2138 bp, Homo sapiens
  misc_feature (1)..(1): n is a, c, g, or t
nagaaaatttgaaagaatagtacagtgatcacctgaaaatacgtgttctttaaagtccaagaatgcaaaatagcaaggagtgattaggaagttgtcttattaacctttcttttttcagaaaaaaagttctaaagaagtgataaaaataaatattttaaagttttaattacattgacaatatgtgccttttttttttttaaaaaagggactttattattcttacttcaagaccattattgaagcaccttcatttttgggaggactgtggatgattatgaatgacaggcttactgaatatcctcttgtaattaatgcagtaaaacgcttccatatttatccagaggtgagtcataatttgagacaaataatatttgtagagtgatcctctttgtcagataaaaatagtaagcacaatcttgttaagaaagggaggggacgtttcaggtttattaattgtatgtatccttatagttgagtagaatatcataagttcctcttaaaatttaaagaccccagaaacagttctctcatgaactcgaagaatgaaccttagtgtgtaaataatggccagggtaatagacaagccaaatggaaaagagggtcatgggagccaaaaagttctaaatagggatgggcttttggccttggacacctcgtgggtgagcacgatgaccacgtgaagggacagtggagtgatgagcttgaatagtgatcttggagttatgttagtaaagtaagatttatttagtcacacagccagaaatctattactattttccaacacttagcctaaaagagtatggttgttatagtagtctataaatgctagaaatttgaaaaacggagacaaaattagtgaactcagtttgtgaactcaagataaatgcttaatttgacaccatggtaaatactactgttgagtttaaagttgtctcagaatccagcatattaatgaaaagttactgctttctagtcctttattcatatttttatagcttttaaaaattattattctttagattttgaaatgcttaaaactacagacttagaaaataatattcaaatatgtgtgatcaaccatctaaaataaataaatgctaacctttgtcatttttgcatcagctattttaaaataattaaaatattataaatacagttaaaatcacctttgttctgctcctagtccaacttatacctttattaaaatttggtgtgcgtatccatccaatctctgttttcagagattgttttattatatgctttaagtccacataaatgatctcatactgaatgtgtcactgtaggattttttcttcaaaattgtatttttgaactttctgtatatatatatttctttaattttaaccattttatgaattgtaaagtttatgtatttccccatcttaatatattatttccagttttttgattacaagcaatgtaatctaaaatgtacatttttgtatggttttcttctgtatatgtgcaatattttgtctaggatatatacctagaagtggaattgttgttatagagtgtgtgctttttcagctttaccagatattggtaaattgctgtctgaagcaaatgtagcagttcacactgctgtctagaattttctcatatccttattagattttgaattgtcagaccctgcgatttttactcttatgatggctgtgatatgctttttgttttaatttgtacttcctttattatttatggggataaatatatttccatgtttaataagcatttggatttgttcttctgtcaacaacatatataaatctttgtcaccaaatcagcttttttgaggtatgacttacatgtaataaaatgtgccaattttgattgtaccattctctgagttttgacaaatgtatgaaactatatatccatcaccacaattgagttacaaaacattttcagaatgccaaaaaatgctccattgtggtaactgtcttttcccccattgaattaattgtcttggtacaatcgttgaaaattggttgaccacattatatgtgaatgtgtttctggattctattattctcttgatctataattatgccaataccacactgtcttgattactgtaactttagaataaatcttgaaagtagatagttctccaa

SEQ ID NO: 230944 - DNA, 1110 bp, Homo sapiens
  misc_feature (1)..(1): n is a, c, g, or t
nagaaaatttgaaagaatagtacagtgatcacctgaaaatacgtgttctttaaagtccaagaatgcaaaatagcaaggagtgattaggaagttgtcttattaacctttcttttttcagaaaaaaagttctaaagaagtgataaaaataaatattttaaagttttaattacattgacaatatgtgccttttttttttttaaaaaagggactttattattcttacttcaagaccattattgaagcaccttcatttttgggaggactgtggatgattatgaatgacaggcttactgaatatcctcttgtaattaatgcagtaaaacgcttccatatttatccagaggtaatcatagcctcctggtatcgcacattcatgggaatagtgaatttatttggactagaaactaagacctgctggaatgtcaccagaatagaacctcttaatgaagttcaaagctgtgaaggcatgtttcctccaaaaatgctgtcatttgtaaacattcataaacatttaataatattatgattcacttttaagaattattgtaaaattctgttgttgatttaaaaaacattagaactgactcacctcaatgagtattttacattttgaagtagttttctgagaaggctgtgtacttaaaaatttgagtataaattttggaatttgagtattaacatatcccattgtaaggcaaccttgactataagttagtcttctatttcagaatgagaagatacagaaagatgttttttggggtagcttcaatatataaattttgaggatacattaaatagtcaaatagctatttgtaatagctaatgtataaatttaattatgcatacatatttaaaaattggatatgccataatagattgatttagaaatattacatttttatatatgctcatagtccatgagaggactactaacccctcgactaactccacctggggccttggcaagaaccgctcggcactccaaccgttcggaaacgcggccccccctaagattgacgcagccttacacgatggggcccgaaactctacccgtttctaccacagaggtgcgctcaacgcccatattataggcgccccaaaggggcgcta

SEQ ID NO: 230945 - DNA, 731 bp, Homo sapiens
  misc_feature (1)..(1): n is a, c, g, or t
nagaaaatttgaaagaatagtacagtgatcacctgaaaatacgtgttctttaaagtccaagaatgcaaaatagcaaggagtgattaggaagttgtcttattaacctttcttttttcagaaaaaaagttctaaagaagtgataaaaataaatattttaaagttttaattacattgacaatatgtgccttttttttttttaaaaaagggactttattattcttacttcaagaccattattgaagcaccttcatttttgggaggactgtggatgattatgaatgacaggcttactgaatatcctcttgtaattaatgcagtaaaacgcttccatatttatccagaggtaatcatagcctcctggtatcgcacattcatgggaatagtgaatttatttggactagaaactaagacctgctggaatgtcaccagaatagaacctcttaatgaagttcaaagctgtgaaggattgcgagatcctgcttgcttttatgttggtgtaatctttattttaaatggactaatgatgggattgttcttcatatatggaacatacctaaggatgtcatgcccagagctgtagcagtcatcttgtgaccataagggaaaggtcataaaaatagcggatatatctggcctaccatccttctgctgctgaaccaatgccaacagatacttacctttcattttcttgttgaatgatataataaacaacatccatattgtgtaagcca

SEQ ID NO: 230946 - DNA, 499 bp, Homo sapiens
gcgaggcttttccaaaacatgtcaagccagagaaaggttcctgggataaagagagaggctcatgaggagacaacacttcataaatcttcagggacgcatggagtcttcaggggtttgagagagtctcaggtgacagcgggattttcctagcgtagtaaaggattcacttcaataaaaggaaaactttctaataatcagaggcttttgtgaaatcattccttgctagggctgtgcgtgaggacctcttcgggagtttttcccctgcaaaatacaaataactttggctctgcctttacaagtttagctctgtattttgcagtgggacctgaatacacatattgtgagaacgctccccagcagattttggtgcctatcgtgattaagaacaattttttattaacccatgtatgcctagtgttccattattggaacgctaagcatgtgggagttatttacatcctactgctcaaggtcattgccaaggtctgattgcaaaaat

SEQ ID NO: 230947 - DNA, 125 bp, Homo sapiens
tctctcatggttcttgacctagaaccaaggcatgaagaactcacagacactggagggtggagggtgggagagaccagagctacctgtgcacaggtacccacctgtccttcctccgtgccaacagt

SEQ ID NO: 230948 - DNA, 580 bp, Homo sapiens
atgaaagataattataactccagggaaaacaaataattcaactggtttgtttttagcccataccttccctaaaaacatcctattttagtttccttaataattatcatccttacaatggctgtggaacaaagacaatattttaagacaacatttgtctagacacacctttgaaggatgcctgaagatagtggtggtagggagggatgcagggaggagggtatagtgtatgggggaagagtaatgagggtagagcccacttgtaatttggtaattgttaatatcagttctggggaattctgaactctcaaaacaaaacaaacaaaaaatccagctgacctaaccaacctacttacctacagacaaacaaaaaccttcaaagaccctagaattgatcataattatttgaaagtgaaattatggatattttaacaattctgattgatatggctttggtttgaaagtcttccaaaatgaattaatctcttttcctgattaatcaaaagaatgtactgaatatataatcaagatgtccttcatgctttagaattctctttctgagctttttcattgtatagatctg

SEQ ID NO: 230949 - DNA, 796 bp, Homo sapiens
aatccattgcagctcgtcttatcaatgctacctttttatttttttcttttttgagttagggtctcactctgttacttaggctggaatacagtggcatgatcacggctcactgcagccttaacctcctggggtcaagccatcctcccacctcagcctcccaagtagctgggactacaggcacatgccaccacgcctggctaatttttgtattttttgtagggacggagtttcgccatgttagccaggctgcttttgaactcctgagctcaagcaatctgcctgcctctgcctcccaaagtgttgggattacagaggtgggccactgtgcctggccttctaatcaatgatacctaattctgtcttcggtcagtggaactcaactcaatttgtctcctgagtccttttgaaactattctaatcttgtcagtttcctcgctttctggtatggtaagatttccagcatcatgttgtacattttcagtccagatctgaaatcagtcatttctccaaggagccctggttttgttggaaatggtatttagcaaccagtctgggcaataagcaaattcattgccacttgtttggtcataggccttttcggtggacagagctaggaaaatattacctgattctccctctagccacacaaatcatgttaccttctggtcatctgaaggtcctctcttctccaagcggaaaccctctcaaccctgcctcagtcagtgccacagttttgaatctcctaactatatgttgtctttctgcactcttaatttgtgagtgccactcttttttt

SEQ ID NO: 230950 - DNA, 474 bp, Homo sapiens
gactttaagatagtctatttaaaaggagcatgccagacagcagctggttttggctatgaggagagactggagttgaacctgcgtttaaaatagagtatgttagttcagagactgaaagctagacaagaatggccaactatttggattctgtaacattttagatagattttagaaacccaagtgcagcattttttttcttggactcttatttgcacagaaaaagtttgttaatatcagttcaaggagattaatgctaatttgcattcatttatgcaaacagtagctctttaggaaatctagaatgttgaagctggaagagaaggtttactcattcctcatcatttggcatatcaggaaatgaagatggaagcttccgactgcttgccaaaggtcataatggagactgaatgagaatcaaggttgtctgaatcccaaatggttctcttttccccgcatgtgctgcctcctgtttgg

SEQ ID NO: 230951 - DNA, 1112 bp, Homo sapiens
ggggggcgcagggacgggcgcggtcagtgcctgagatccctgcgatcgctgggagatgacggtgaagacctgagatttaggcctgcgcggcgggtgacgacgccggtccgggtcttcactggaggacgctggccggggccttcaggtgttctcgtggcctgaggacgcgcgtccctgagaatgtgcgtgcccgcgccgcgcgggtcccacaggagcctgggcagccccgccgccgcatttccaccctgcggccgtatttccacccgctgggcgccaagcccgggatgactgcactctagggcatcactgcgcgctcacactcagcattcaggcacaagcacgttctctttataaacagtttcgaatcttgtcgagtctttctagaaggttgaaatgccctggaggagcagcgtgaatagttttttccaattaggaaaaaagaatgtggggcggctggagggagagaggcaggccgagaaggccaggtgcgtccaggagccgcagcccccgtgcctcagtttcctcctagaaacatggaggtggcggtgcacgctacaggatttctgtaagaacagatgagttaacgtgtgcaaaacatttaaaacagtgtctggtgtgtagcaagcaaatatgagtattagtcttttccttgttaaaatgtgtgcatctacatttggtgcacattacaggaagtgtatagtatggattcatattttggaaaagtaattttagaagttatttctgatgtgcttattgtaatagtgtttcttgaccacatgcttttagataatgtgaaggcaatgaagcaggcaatattgcttgcacatccccaatttaaacacctgtctgtccctccttccctctctcctttcttttcttccttaccctctctctttattccttccttcattcccttcaaggttgcggattattccattatataaatgtatcaatttattagaatagtttctatgatgtctatgatgggctttagattgtttgcaatagtttgccattataaataatgcccagtagtgctgtggtttgatttaacttgtgaaggtatatttccaaataaatcgctatgattggattgttgtgtaaaccaaaaa

SEQ ID NO: 230952 - DNA, 411 bp, Homo sapiens
agctgagctaaatgaaatgacctgtaggcccttccagatgtagaattcttggatcctaattgcatgcacaagatgaaggtgtgcaagaggaaaatgataataataacagcattaatacttaatagttgtatggctgggcatggtggttcaggcctgtaatcctagcactttcagaggctggggtggatggattgcttgaggccagagtccaagaccagcctgggcaacatggcaaaaccccatctctattaaaaatacaaaaattagccaggcatggtggtgcacacttgtaatcccagctactcaggaggctgaggcaggagaatcactggaaccccagaggcagaggttgccatgagccaagattgcaccactgcactccagcctgggcaacagagctagactctgtca

SEQ ID NO: 230953 - DNA, 438 bp, Homo sapiens
atcaaaattcaggacttggggagaattctaaaggatggagttaaatttgtaatacaatggtcctcaggtcaaagatgactagaaggaacaggtttgttgttcttttttgccaataacagagacattaaattctaatgtatgaccctagttaagtcactttacttttttggatctctgttttcctatctaatgtggaatatttttgtatttcctttgctattccaaaagtctctttggaaaatgaaaatggaaatcctttttaaatatgaatactctgaaagcacttcggttgaagtcccacatttcaccttctaaaatattgtatttcaagtgtttgtcttaatctttcagattatttcttctagtacagttatttgcccaacagattgtgtatgtttttagaaatgtaataaagacaactacctttgtggcttcttt

SEQ ID NO: 230954 - DNA, 446 bp, Homo sapiens
cttgcctgcctccatgtgaaacatgcctttcactttctgagatgattatgagccctccccagccacgtggaactgtgagtccattaaacttctttttctttataaattacccagtcttgggtatgtctttatcagcagtgtgaaaacagactaatacaggacatttctctagaaaataaattaactatgagtccatagccatcaacactcacagcagctggtatgggcaggccagcttagtaaagggatctgggtggggcaccaaaatcatccactacaatgacattgacacctttctgataagaagaatcagctgggcatggtggctcatgcctgtaatcctagcactttgggaggccgaggctggcagatcacccgaagttaggagttcgagaccagcctggccaacatggtgaaaccccgtttctagtaaaaatacaaaaaaa

SEQ ID NO: 230955 - DNA, 755 bp, Homo sapiens
tgccaggacagatgaggagttagctctccacttcccaccatgcctgcccctccttcacaatctttgttaattatattcttactctgtttccatattgaataactcacttaaattcttaccataaaagatgacaaagatacacaaaagtacagagaacctaaatacctgatataatgcataattgtaagacgcacaattatgtttcttcgtcaagaaacagaaaatacccagcccctgactcggcttctagaagtaaccgggccctccccgaggtgtagcctgggtctgaacacacctgccccgggggcagagctgctttctctccatcccctctaaccgcccttcacagcatcctgaagattaaggctccctccagaggtgggaggtggtctgggcgtccctccccaggcagcaccaggggctaaacctctcttggagttcaccctgtcttccccatgggcacctagcggggttcctggaggcggagtctgcaaaaagatggaacttccctctgtctgcggctcccagggactccacacttccctgaagctcacagccttcagcagtttgttataaaatttccaattcaaccatcttgccctccgttgtggccttcaggtaagaaaatgccaggaccctgcaggtgcctgtctctgggtttcaggtaagaaaatgccaggaccctgcagctgtctgtctctggatttcgggctagagatttgtcctgtgacctcggttctctgatgggctcaaga

SEQ ID NO: 230956 - DNA, 467 bp, Homo sapiens
ccagttgaataagctatattataaatatttctggtggctgaaaataattttgtaaaacagaaaactataaatattgtcccaaatcaagagcaagatattaaaggctgaaagtgttctcaatttcatgtataaattcaaactagaacaaacggcaaaaggcaaacagaagagttgaagagcaggaacagctgaagcctgcacaggaatgctgaaatccctcacatgagccatcttattttaggagagatctcctttgctcttgtatctcttccactcttcaatacacatatttcctttattcccatactatactttctctcaggaggaaccatctgaagggggcaaaggagcaaagtgtacccatagagtggttagaagccactcacagttttctcctggctattcaccagcctttactaagtagccaggcctattttaccaggtcagggaaaagggcaaaaaaaaaa

SEQ ID NO: 230957 - DNA, 723 bp, Homo sapiens
agcaaactaagacaaggcataactctccaacatttgtaaaggagtgtcaaatacgtcactgttgatcttcacattaaccctgcaaggtatatattattatgcgcatttaaggaaactgaggctcatcagataagtaacttgcccaaaatcacacatctacaagtagcagaaagatacatagagaactgggagcatactgcacatatttttatctgccatttttaactcagttgttttatcatggacatttcccatatcactgaaaatcaaagtatgtcagtttaggtttgcttatctcaactttgaataagctgcctaggaaatctatgtaacagaggaacatcttgaaaactaacattggaaaaaataaaaatgaaacataacttgttaaaaccagcaaggaatttagtgatcacccaagaaggccaaacactatgacaggtgacaacaaggctatggcacatcctgggtcctagaaaggctgtcctagttcatgtgaatattctgggaaggactttctcatcctccttgaccccaagaactatggagggctgaacaggcaggttgatccctctctagctctgggtctcatagagcaaagaggatgatgctattagggttcacctcacagtgtattaaaggagggaaagacttaaaatggtttacagtgaggtttgggaaacattagcaatgatttctgtgatttagaagataaaaataaaa

SEQ ID NO: 230958 - DNA, 454 bp, Homo sapiens
caattttaaaataaaaccaagtcacaaagttaatgtggaaaaggagccagctttggtccttaaaaatggagaaacctattcttgattaaagtgacagctctatttagtaggcatggatttaagattcttaaccttgtaaaagtaattcgcatttccttcctcttccatatgttatacattatgcttcaaattaaccctattttccattttagatttcattattcaaaaatgccaataatatcagtgggtgaagaaacacttaaaacatttttatccaaatattgaccttgctttggacaacatccatgtaataagtagtgagattttttccttttaatgtcaccaatatgtttatgattaaaggtcagtctgtggcaacagtttgcatctctgcgctataattacttgttctgctaaaaaataaaaaaataaaataaaataaaatcctgactta

SEQ ID NO: 230959 - DNA, 125 bp, Homo sapiens
gaatgtttcaatctttgttggcctctctgttgctttgtttgtgctgtggggctccgtgttctttatttttctgtggatcatgaatctgcagtgaatcgggaggtgggccaagacatgcaggtgtc

SEQ ID NO: 230960 - DNA, 330 bp, Homo sapiens
  misc_feature (72)..(72): n is a, c, g, or t
gctgaggcaggaggatggcttgagcccaggggttagaggttcagcaaccaatgattgccactcactccaganctgggtgacagtctcaaaaaaaacctgattatgtcactaccccctctccaactataatcatttttgttctttgcaataactcattgaagcgggtactcttatacctccattttataaaagaggaaactaaaaaaattagctgggcatggtggcacacactacttgggaggctgaggcaggaggatggcttgagcccaggggttagaggttacagcaagcaatgattgccactgcactccagactgggtgacagtctca

SEQ ID NO: 230961 - DNA, 454 bp, Homo sapiens
attcgtgtcttgagtttgaaacatttttctcatggtaactctatgctataggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctgtatg

SEQ ID NO: 230962 - DNA, 322 bp, Homo sapiens
accagggcaggatgagatcacagggcctcagaacctccacctgcacttcatctcccaaacccacttggtgattctctgggtatctgtcggtcactgtgatttctcccatcacttccgtggagtcaaaggctgagtaaatgtgtgcagaactgacactgcagggcgcagtgggtttggggagaatggccacctggctttgtaatctctgcctccgttctctgccacatgggagccaatctgcagtgctgacctagtcagggccccacctgacaggctggagggtgacctgaacacccaggggcgtggtaactgagatgggcag

SEQ ID NO: 230963 - DNA, 561 bp, Homo sapiens
ccctaatttcccactaaaaggtccagaaaaattgatgccacctgtagtttggcaacgtgcactaaaaagttcaaggtaccgtctttggcatagcaatttaattgctagaaatcctaacaataaatatcttaagctctaagaatcttcatatatataaaatatatggataatcattctttgtcctacatatttaagctctatcatctattttaagtaatttttttttggtatggtatgaggtaaggatcaggttctatttttctcctatatagaaatccagtgccttcatttgttcaaaggacttttcctactgtcttgttacctttgtggaaatcaattgaccatatatgtgtggctctatgtctggaatttctgttatgttctgttgatttatatgtctattgttacatcagtattacactgtcttgactactatagctttatagtaagtcttgaaattaagaaacgtaagtccttgcttgatgacttgggatacagaaaaaaaaatctcctctgagctgttctaacactcaataaagtttgtcttcatcttgctcacca

SEQ ID NO: 230964 - DNA, 743 bp, Homo sapiens
aggcttttttaaaatatatatacttcccaaaataacattgcttcagagtagtttcctaactgccctgggacaggcctgagatcctgtcccagggtacttggggggcacatcctgtcttagggagaggtattcacctccccattcccatccccagtcctggctgcttttcctaaatgcatcatttatccacccacattgccccattctaaccacatatcacctctttagagataccttccccttcattgagggagcatccctctaataaccattagctccatattctgctgggtttctttagagcacttgtgaaaatttggaagtatttaatttgttaaatcttcattgtctctttcctccattagaatgtgagctccctgagaacagggaccgtgtgtatctatattattcactctgtatccctagcccctagcatagtgaccaccacagcacaagcactctgatatcggataactgagtgagtaatagtagaagctgacatgcacctagacactaggaattcaaagatggtataagacacggcccttgtcctcaaagctttcatagtctggtagagcatatagatgtgtaaatgagtaaatatggtaatattaaccaacatatgttcattgaacagttactacggggtcttctagtaggtgatatgggaagacaaaagaatgcaaatgacaatattccagtcctcaaggagcttataatttaaaaaacttaaaatagcaaaa

SEQ ID NO: 230965 - DNA, 380 bp, Homo sapiens
gcagaactatacatgtttttgatttgacatgttatttgcaccggagaggaacaaattcatagtctaaaataatgtgtggccaggggcgggagctcacgcctgcaattccaatactacgtggaggcccaggtgagaagatctcttgaggccaggagtttgagaccagcctgagcaatacagggagaccccgtctctacaaaaaaaaaaaaaaaaaaaaaacctaaaacaaaaataagccacacatggtaagtgtgtgcctgtggtcccagctacccaggaggctgacatggtaggattgcttgagcccaaagtcgaggcttcagtgagccaagaccacactactgcactccagcctggaccacaaagtgacaccgtgtctc

SEQ ID NO: 230966 - DNA, 632 bp, Homo sapiens
gtgagccaccgcacctggctcagagggactttataaaaatgtattttaattactttttgagacagggactcactctgttgcccaggctggagtaccatcatagctcacagcagcctcgaacccctgggctcaagtgatcctcttgtatcagcctcctgagcagctgggaccacaggggtgcaccactatgactgactaatttttaacttttttgtagagacagggtctttctatgctgctcaggctggtctcgaactccttgcctcaagctgggattacaggcatgagctactgcacccatccaataattaccttttgaggctacttggtttctggactctagacgacctgataccaagtagctctagagtgtcacacactctatagttcaaacatgtatagccaatcactaatcaatgtgatgtctgtaaaccaatgacaattcctgatgaacaacttttgtaatcaccgcctctcttgattcgtccttttttctttaaaaagttgagcctttggccgggcgcggcacctcatgcctgtaatcccagcactttgggaggccgaggccggcggatcacgaggtcaggagatcgagaccatcttggctaacgcggtgaaaccccgtctctact

SEQ ID NO: 230967 - DNA, 279 bp, Homo sapiens
gaagttttagtaataaaaatattactaatggaggcaggatagggagagccatttcaagttcagaagacaagtggaaataaagacgagtgtgggaggcggagcttgcagtgagctgagatcgcgccactgtactccagcctgggcaacagagcgagactctgtctcaaaaaaaaaaaaaaaaaaaacgagcgtggaacttaaaagctccattacttagcagagaatactttgaaaacacacataaatttctaaaaaggaaagcacagaaatacagttctt

SEQ ID NO: 230968 - DNA, 399 bp, Homo sapiens
gtctatctacagatgaatagataaaatatggtatatacatacaatggactattattcaacctttaaaaagaaggaaatagctgtcatatgcaataatagagatgaaccttgaagagattatgctaagtgaaataagctagtcaccgaaggacaaatactgcatgattttacttatataaagtatctaaaatagttaaaactcatagaaacagaatagaatggtggttcctaggggctgttagaagagagagatggcgttgctattcagcgagtataaagttacatttatgtgagatgaagaaattcttgagatctgctgaacaatatcatgtctatagttaatactacattttgttgagaaggtagatctcattttaaatacccttgtggcaattatta

SEQ ID NO: 230969 - DNA, 505 bp, Homo sapiens
tgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccg

SEQ ID NO: 230970 - DNA, 636 bp, Homo sapiens
ggggatggtttacatttttttggaagatctacctcaatcctttcacttcattttctgtaaaatcacaggttcatgaaatatttggaagacagcatgagatctaacaacttgtgaagtgggaagaactgaccatacaatatgaccttaaatatattctcattaccttggaggcattttgacccacgaagtagcatagatatgtgctggcttccagacatgcagtattcttgtgcggacatttgcagccagtcagtggaactgactttggtggtgccatcagttagttaagccatagatgagatataagaaatatttcgcattctctactgtactggattataagttattggtaaaataatttttatgctttccttatttaaacatatttctagaacatgggttaaatagatatctataatttgattcttacgcattttactactttcaaatcacatcctctttttgatgttgcccagtgttattcactttcaggagatttatgtttaagtatatcttccatgtaaatattattttcatcttgtctttttttaaggttaaatttcaacatgttattttctataaagaatcactgacctagtgataaaaataaaacctactaaatttaaaaaaaaaagc

SEQ ID NO: 230971 - DNA, 459 bp, Homo sapiens
gttttcgtgtacatttcctgccatcccttaaaaaaagaatattagatcatataaatggaattgtataaagattcaggaaaatgttcggccaggcgcagtggctcacgcctataatcccagcactttgggaggccaaggcgggcagatcacctgaggtcaggagttcgagaccaacctggccaacatggtgaaaccttgtctctactaaaaatacaaaaactaaccaggcatggtggtgggtgcctataatcccagctactcgggaggctgggacaggagaatcacttgaacctggaaggtggaggttgcagtgagccaagatcaccccgttgcactccagcctgggcaacaagagccaaactccgtctcaaaagtaaatacataggctgagtatggtggctcacgcctgtaatcccagcactttgggaggctgaggcaggtggatcacgaggtcaggag

SEQ ID NO: 230972 - DNA, 428 bp, Homo sapiens
gagaatctcagtgacatctaagtgagctaagttgttagtctcattttaccaaggatattacctgaggagactgtaactgcttttatattctgttactacctccatgcaaagacccacagcagctctgtgaagcatttcatttatataaaataacttctttaagtttatgtagtttagtttaaaagattcattgaagcccctcctctgagcctttgagttaggttccaagagcatatatgggaataacattacttcctgctcttaagaaaactcacataaacagatcattttatggttaattctgagaggcacgcatagaatatcttagaacacagaggaaagttactcagactaacttagagcttaagtgactacttcttggaaatgacattctgagctcaaaagatggttaagagtcaagcaaaaaa

SEQ ID NO: 230973 - DNA, 1015 bp, Homo sapiens
catgtatacaaggcatttaagcttagctgggttgcatctccacatggtaaccaagtctagggcaccagaggactttgctgaccatctcctgctcattggcttaatagagtttcaacatgatgttatcttttgacctgaacattattcctattattgtgcagacttctgctagacttgtgagtcattcacacaattataatgcaatcagttgttacaatgatctctgccatgctgcaagctaggccccagtagggactctaaggctctgagttttcctctttgttatttatattcttggataccatgaagcatatttgaaatgcacacttaactagataagaaaggaccttcaccctgaaatgttagggagaatgcttattacatccttcctagaagatagagaagaatgccataaatttactttaaccatctaaatatatgagagatgtcaaggcttgtacagaggctatgccaaaattctttcttgctttccattaaaaaaaaaaaaatcactactttgaagcctggctttttttttttttaaccagaaatgtaacagtgtctcctttgttcaattgtattagcttatttttctaaagtagattcattttcaaaaacatagttacgtctgggcactgaaataaatgtaaatgctaatttcaaataaccaaagaaatcaatactattgacaggaagactgactggtctgccatctgcttgcttctgctgaaatttccagagatatcatcaggactttatgatcagatgacagaaatgtttgcctttcagctgacagttgctctggggatttgagaaaagtaaactgagcaggcctaatgaaaaacgtgaagcttcctagggtcaagatattgtccaaaatatatattggtctagtaatatagtattctggaaacttcctctagagaatgtctgtgatatttttagctggcatctcatgaaatgttagatactattctgaaaacaaaaataaatttctcatgtttagagctatgta

SEQ ID NO: 230974 - DNA, 432 bp, Homo sapiens
ttcgggcccagaattcattttcatccaacccatatttaccagtctgcccatcttgtgccaggcactgtgctaggtgctaatggtcacagtggtgaacaagccagacatggtttcctggaatctacattctggtgcaatgttcctctgcctttctcccttcttatcagtctcatttcttcttcaagagcccccctgagttcttcccacctctactcaaatcatcccagcccagagtcacatggtacctgcagaacttccctagctctcattgtttgtattgctcttttggtacttacaattctttatgttacattttgtgtttatgtattacctatgcagcttgacttttaaatgtttgaggatagaagcagccttttatatttttgtgtggtaaagcaaattggcatgcaataaaaatgatatttatcatgt

SEQ ID NO: 230975 - DNA, 274 bp, Homo sapiens
gaggtgtcctaagtgaggaacaggcccttctcagaggccctggaaggattgctacagaggggaaggacaagggtatggaaggatgacagttaatattttgtcagttacccagcgttgtcctggtaaatttaaacactcaccttccttctctgctcccacctccaccagagctcctagtccagttgctcagaacactgacagacgacccggtggcactgctcctctgacactgcagacccagtgtgtgcaggcacatgtccacaacaactctttg

SEQ ID NO: 230976 - DNA, 1252 bp, Homo sapiens
tgagccaccgcgcccagccagagagagaatttttaatggaagataaggagaagatttggcaggttttagtatgtattagggcaggaaaataaaggaatagaattacagagaatctttacttctgggttctgtgtcaaaagtaattggtagatagagattccttatgtttttctcccaagttggcattatagctctagggctgtttttaattacatgtttgtttgtttgttgagacagagtctcacactgtcatgcaggcccgagtacagtggtacgatctcactgcaacctccgcctccctggttcaagcgattcttatgcttcagcctcctgagaagctgggattacaggcatgggccaacaccccggctaatttttgtatttttagtagagacggggtttcaccatggtggccaggctgatcttgaactcctgacctcaagtgatctgcccacttcagcctcccaaggtgctgggattacaggcatgagccactgcgtccagcctagttacatgtttaaaagtgagctggtagacactttaaattttttgaataagttccctaaaattgatgttttgggtacagatttgatgcctttcctttctttaaaactgtaactataaaatgaatcaaatggaggcgtgcgtggtttgtagggttattaaagtcacagttaatcacacatggattatcttctttggatattgtctaaatggaaattcaaatatcagattaccttcctgactttctggtgcttgccactctgtttaagaggcatccagctcctgccagttattggtgcgtgctcagagaatgagacacagttttgctttcatgttagttgtgacatctaacgttgcttacaagaaacaatcactgttaaaagttgaatggaactaaacaaaattaaagatggaattgtaatatttttagaaattataataattaataccttgctgcactaattagtaattctgtacaaagcatctctgttggccacattgattgttctgtccgtgagtaaatccctactcctgctgctcttcaccctggagcatacattatggtggtacccatgtgaagagagcagctcaactgcaaagcaacgcctgcagtccagagactctgcccttgtgacttatctaatctaatgcagtagacgcccacttgaagctgcacatgtttgaatgaagcaagagaggttgggtaatttaaaggaatctgtggtatttagaaaataaatagataatt

SEQ ID NO: 230977 - DNA, 512 bp, Homo sapiens
gatttttcaattctaaaactcaatggtagtattattgatatttctgttcaccatacacaaagccagacaaagtcaagtatgcaatattattcctagttctccaagtaaacattatcctagaaacagtgcagaactttctgtccatggagtctgtggccagtcatctatacttcttctcgcatttatttaaagctttgtctcaatgtgactcttatcctttcttggggcgtgaactctcaatttccagttcatcatccctattctggttccacaaacctggtttctatggtaccatttaactatttcacttattattctttttctgttaagaatctctattaaacaccttccaacataaggaataattcatcatgtgaatgaagactgtcctcaggtttgcagactagcaaaaaagaattcctcacccaccttgattctctactgccgtgcacttcgtgtcactccccagttttagatacttcccagggtctcctttcttcagtgtcaaaaaa

SEQ ID NO: 230978 - DNA, 510 bp, Homo sapiens
taagcacctttatatgttattagttaatgcttttaagtcagagtagtttatcaaaggaaaatttgaatgattggaataaggactccacagcatctaattgtagatgtccaattcttctcatactacaaatcatttccaggaaggaaaagataggacctttgaaaaatctgatggatcggccatgtgtttttatccaccatcactaaatgatgcatcttttcctttgactggattcaataaatgtgttgttttgaatcagtttctttgaattgaaagaagccaagaaagacaaaaacatagatgctttcattaaaagcataagtacaatgtattggctggatggtgttcattccggaggaaggaatactggagttacttatccacaagtcttgaaagaatttgcacaaacaagaattattgttcacacccatggaacactttaccaagtatgtgatctaatgagatcttgcattggaaaggagcaaaataaattttttagatacttgggga

SEQ ID NO: 230979 - DNA, 425 bp, Homo sapiens
aaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaatttttttt

SEQ ID NO: 230980 - DNA, 709 bp, Homo sapiens
aattttactacatggcagatactgttttatgaggtttccatgattaagtaatttatcctcacaggaactattacagataatcatataaagtaggtataattccatattatacccattttacagatgaagatgttgaagaactaaataatgaaataacttttccatcacacagctagtaaatggcagagccaggattcagtataaggaaatctacgccagggaaaatgcacttgtgaacttgccatggtttggaggtttcctaagtttttacataggcccctcccaggaaatggcaattcatgttctaaaacagttttttaaaactaaaacctaatcctctttgaaaagatagtaaatttgaaatacatttataggtacatttttgatagtgtgcaattcaggactcagagttggaaaacaattaacctcaggtttatttgggtagctggaaaaattaaaggactaaatgtaattttggctggagagtaaatgatcatgtaaagcaaagacctgtccaaaaaatttcatattggattcattccaccttcattatgattagccatgtttgaggtttgcattatttcttgttctttatgtggacattagttatctactttataaagaatattttactgtaatttttaaaagaaataccacaaatactttgtactattggatgtaaataaaacacttatatgcagtgaaatga

SEQ ID NO: 230981 - DNA, 339 bp, Homo sapiens
agaaattgacgttgatacaatagcatcactaactaacctaaataacttatttcagtttgccgattgtcctactagtgtcctttttaaagtccaggatccaatctagaatcccatacaacacttacttgtcacgtcttgttagtctcatctagtccggaggagtctttctataattttcacgacttaatacttttgaagagtcccgaccagtgattttgtacaatgtccccagtttgggtttgtctgatgttttcttaggataagaattagcttatgcatttttgacaacaataccactgaagtgatgttgtgcccttcccaatgttttttgttgttgtt

SEQ ID NO: 230982 - DNA, 453 bp, Homo sapiens
agctaaaatttaggggttctgttactaaaggtggaaaaattgaagaagaatgtgtaggtatggacaattagcagtatcttatatagtccacacttcttgtatatatttgcagtttttttcataggtagaaccactcactcctccctaaaagagtcaaaattctatgtagttgtgaccttcagctcaacacccaaggtctttggcttgtatgaagtacttttctttagttctccgtgtgttccttcattatcttgcaacccataaactaaaatgtaagtgtttttgcttctctctcaaccctcatcacactccatatacaatggtggagagaagagtgtgtgcacagaatatctgcaataaaaactgctttttggagaaggtaggaatgggaaatacacagttgttacgcttcttaacaacttattaaatcttgctgtgaaaatattgtgaaca

SEQ ID NO: 230983 - DNA, 385 bp, Homo sapiens
ctttgaatacatgaatcattgctatatatcatgctaagtgctatgtaatgttttaaaaatcttcagatagtacaattttgctggggtgatattgttaagttttaatattttaaatgtgcacatgtggattgtgtaaatgataatgtgtattattaggatttaaagttagaagattttttaaagtaaagccctaaaagcaactgaacaaagaaagcaaaacagatacataacctactagaaatgagagctcagatttcctgacatctcagtttgatgtttgtgtattgtatcccattgtttctctaaaatgggaaatcatgcaatgaaaatgcagaagaaagcaaaatggtgagagtttgaggtgggccttatccagtctggtttt

SEQ ID NO: 230984 - DNA, 498 bp, Homo sapiens
gtgaaactgctcaggccatcaagggtatgcatatacgaaaagccacgaagtatcttaaagatgtcactttacagaaacagtgcgtaccattccgacgttacaatgctggagttggcaggtgtgcgcaggccaagcagcggggctggacacaaggtcggtggcccagaaagagtactgaatttttgctgcatatgcttaaaaacgcagagagtaatgctgaacttaagggtttagatgtagattctctggtcattgagcatatccaagtgaacaaggcacctaagatgcgccgctggacctacagagctcatggtcggattaacccatacatgagctctccctgccgcattgagatgattcttactgaaaaggaacagattgttcctaaaccagaagaggaggttgcccagaagaaaaagatatcccagaagaaactgcagaagcaaaaacttatggcatgggagtaaattcagcattaaaataaatgtaattaaaagg

SEQ ID NO: 230985 - DNA, 274 bp, Homo sapiens
ctagtcatgcaccccatgcttgctcaatctatcacgaccctgtcacgtggaccccttagagctgtaagcccttaaaagggccaggaactctttcttcggggagcttggttcttgagatgcaagtctgctgatgctcctgtctgaataaagcctcttccttctttaacccattgtctgaggggttttgcctgcagcttgtcctgctacaagacaattcaatgtgcaaggtaaaaagtgctgataatgacgagtaaagtgatacaggttacagaag

SEQ ID NO: 230986 - DNA, 259 bp, Homo sapiens
cagagtcaggagtaactgataagccaggttgtctttatttagaagcctgtgactccagaaagcacagaacagcaaactgctcccccagctctctttgtctctggaaatcaaacatctcacttaggaagatttctacttttccattaagagaaaaaaatgggcaggactctggggaccagaaatccatgagaaaagacatctcagtgattttattattgaaatcttaacatatggtgcccaactttaaggcctctttcca

SEQ ID NO: 230987 - DNA, 429 bp, Homo sapiens
gagaaatctagatcaaggcaagtcctgggacctgtgttcattggcaggaccccatgctctggcctcccaagcactggtccagccctgggctccgtaagtccccaggcaccgtccaggtgcttcagagagcaccaggccctgagtgtttcaacatcgtgcaaggacctggggtttctgcttttgcaatcgcccctgggttcatccacacctcactgcctcatgtctcgacccctctggtggtgtcctgtcctctcattctggtcagttctgcctgcccctccaggttcgtcgtctccaaagagtgacttttgagtgttgcttctctggtaaataatttctaacggcttcccagagtcaacctgcaaaagccactcctctgccggacttctgagaaccttgtttttccccttcccctccattttctcactt

SEQ ID NO: 230988 - DNA, 986 bp, Homo sapiens
gcagctggaacatcggagcgtccatcgcacgtggcagacgccgtgtgagggagccggggtgcacaggctggagcaggagccccccggttaacagaacctgtctgtgcttctccgatcacgtgccgtgccatcagctacatctcaaagcagttttcaaaggtagcgccgcgctgcgtcaccttaaatgtgttttgacgcagcttccggaagattaaagagacatccgtgggatacatttttacatggttcgcctgcctcagtcaaaacacgtggttgttaacgtcaggtcaggagctgccatcaggagcaaagctacagtcagaacatgccgccaccaccgccgcctccaagcctggagagcagacagggcatctctctgtccccagattccagccacctggcctgcatcctgggctgaggcaaggactgagcatgtgaagaccccagggacagggatggcccctgaggagctctgggggctcggcagagcacctccgttcatgctgaagccagaggtcatcgggtcctccaaggagacctcctgccgggccaggagggagcttccatcaaagctcatctggagcggccgcgcctgcttttctcacagacacttccaaaagcagcagttcttccacgcgatcatgcgtctgggctcagggcttccagcaccctggggctctgctgggcagggccagcaaaactcagggaggcaaggaaaggttttgccctaagaagtcccagatgggggcaagatgtggtgggcggatcccagccctcaggggccagtgcagagcccagcacccgcagaacccctccctggctccccagtgggagtgagtccccggtgcgtggctgtgacctccgtggctgtgagtttccacgtgaatgccacaccccgctgtgtgcgtgtgtgcaggtgtgggtgtggccgtgtgctctgccgtgtctgttgaggtgccgtgcgcagtggctgtgtgcgtgtgtgc

SEQ ID NO: 230989 - DNA, 545 bp, Homo sapiens
tctttgtggaaatgtcacattggaagtccagaccttttcaaacagccagcgctcctttaggtgtctgtgttccaagacatttgtgaaatagaaaaatggttttaagctacacttcaaatgggctcttttttcaaagaggagactgtctgagcacataaaccctctgtaacaacggctctgtacagagttcctcattcagcagtccttgtacagtgtcttcgtgcatgtaatgctgctctaacagaatctcacagaccaggcaattataatgaacagatatttatttggctcatggatctaaaggctgggaagttcaagatcaaggagttgcatctggttagttggttggttgtttgattgatttggggacatggtttcattctgtcgccaaggctggggtgcagtggcacactcatggctgctgaggccttcacctcccaggctgaggcaggagaattgcttgaacctgggaggtggaggttgcagtgagcccagatcgcgccactagcctgggcgacagggcaagagtctgtctcaaaaaaaaa

SEQ ID NO: 230990 - DNA, 380 bp, Homo sapiens
tgagaaggttaacgtagttcattaaggtttgcataacttcttatgtttgatgactcattcacaaaaatgaaaagcaggacttaggatttgttaaccagaattatgtaaaccgtatatctagcatatctgggttaaaatcccaactctttaacattttactagctctacattcttgtggaagtctttgagttatagttccctcttttgtagaaccgaaagaatactacccatcccataaagctttgtgaagccatagtacctggtacataactctcaataattggtagttgtttttataacagtgctggtagtagttattattctaactacaaattataagttttacttaataatacaaaataaaagccactaccataaat

SEQ ID NO: 230991 - DNA, 450 bp, Homo sapiens
caggctggtcttgaactcttgacctcaagtgatccacccaccttggcttcccaaagtgctgggattacaggcgtgagccaccacacctggcctgtatttgtattttttaaccaactaattctctctactctgttcttatcctctactttcctatcacttacctcttatccataagataagtgaaaaagaggtaagtttacgtgtttcttattggaaggcaatgccatctgaaacatttgtcttgccttctgtgtgaacatcctaaaccaacagagctaacagttaagtggaaaacagacttttttttttttttttgagatggagtcttgctctgttgcccaggctgcagtgagccatgactgcaccactgtactccagcctgggtgatggtgcaagaccccaactctaaaaaaataaaaataaacagtctgatgaagagtcttttgatat

SEQ ID NO: 230992 - DNA, 466 bp, Homo sapiens
atcactgagaaatgaccttttgttatatttatttgtttcttctatttctactgtgccaagcaatataagaactcataccttctctatcatgataaaaatcaaatgtctacagatgtagcataaggaaagaagtaattttctgcatgcagttcttattttcttttgcctgtgataattgcaaatccgtcaatagaaatgaactttttgttacaaatatattttttaaaagttgattataagaaatgttggctaggttatggaacaactagagctctcatacactgttagtgggattgtaaattgtccaacattttgaggaaaagtttgacattactaaaatgttaaatgtacactgatatagattcagccattccactcttagatttatttatgtattatttttttcttagagatggattcttgctctgtcgtccagtctggagtgcagtggtgtgatctcggctca

SEQ ID NO: 230993 - DNA, 184 bp, Homo sapiens
ataggtgttcaaaaaatactaatagggtaaataaatgaattaattttatgcttttattttaatattttcatggtattaatatttctctctatgtgatattttgtatgtacctattttcttttaatttgaagatttatagtttagttatgtgctgtataaattatatttagttctttaatttttg

SEQ ID NO: 230994 - DNA, 401 bp, Homo sapiens
cagaacaaaactgaatgaaattgagaatgcatacaaagaattaacaaaaccaaagcttggttatttgaaaggataaacaagattgatagactaacaactagattaagaaagaaacagagaagatccaaatgagcacaataaaaaatgacaaaggtgacattacaactaatcctccagaaatacaaaagatcctcagagactattataaatacccctatacacacaaactagaagacagaggaaatggataaattcttctagaatttcctctggaagaacacagtctcccaagacaggaagtaattaaaagtctcctaaatcaggaagtaattaaagctctgaacagaccaatatactgttgtgaaattgaatcaattatttaaaaaacctacaaatcaacc

SEQ ID NO: 230995 - DNA, 424 bp, Homo sapiens
ttttaattttgtaagaaacaatcacatgtgggcaaattaattacaaaacaataaattatctcatcttctgtatggacactaaatacatggtaaaatatagattgaaaactaattgtattataggcaaaagctgctgtcattaacttaatttctgactttttagttttgctttaaagagcaactgattgccaggtgcagtggctcaagcctataatcccagcattctgggaggccgaggcaggtggatcacctgaggtcgggagtttgagaccatcctgaccaacatggagaaaccccatctctactaaaaatacaaaattagctgggcatggtggcgcattcctgtaatcccagctattcaagaggctgaggcaggagaatcccttgaacccgggaggcagaggttgcggtgagccaagatcgc

SEQ ID NO: 230996 - DNA, 439 bp, Homo sapiens
aattgcttttcaagttacccacttttagggaagacattatttgggttttgtttagtgtatcaggctttttttagttagttgtatcaagaagtgtagacttttctatacataatatcctttttcccacagtagtttttttttttttaaagtctagccgggtgcagtggctcacgcctgtaatcccagactttgggaggccgaggtgggcagatcacgaagtcaagagaccgagaacatcctggctaacacagtgaaaccccgtctctactaaaaatacaaaaaattagccggacatggtaacgggtgcctgtagtcccagctaatcaggaggctgaggcaggagaatgacatgaactcaggaggcagaggttgcagtgagccgagatcgtgccactgcactccagcctgggtgacagagcaagactccatctcaaaaaaa

SEQ ID NO: 230997 - DNA, 422 bp, Homo sapiens
cctcttaccagggcttgaggggggaagtgtagagtcccacaaggacttctctgaggccattcgggcatctgttctcagttctaaacaacagaacccatgacgcggggtgatggggtcaaagcgaccctccctggagccgcagccaggtgctgagtaagcagctggggtcaaagcgaccctccctggagccgcagccaggtgctgagtaagcagctggccctgcacttcagcacattcctcgcttttcttgggattgtttttccccctttttcagtgacacaacttatacaccaaatcctcctggctgatttctgttcaattcaatatataggtgatttttggtttaattttgttattaggttacaggtaattctcatataagtgttgattaaagttaacaaagattagcttcccatctcata

SEQ ID NO: 230998 - DNA, 254 bp, Homo sapiens
tgtgtttcacctgagtatggtggctcatgccataatcccagagctttgtgaggccaaggcaggaggattacgtaaggccaggaatttgagcccagcatgggcaatacagtgagatcccctgctctaccaaaaaatatttagctgagcttggtggtgtgtgtagacccagcttcttgggaggctgaagccggaggatcctggaggccaggagctatgattatgggacggaactccagcctgagagttagagtgag

SEQ ID NO: 230999 - DNA, 305 bp, Homo sapiens
taataaattttgatgactccctgataaactatatattatgaggtctttttgtggctggtaggaattcacactattcacaaccttgtgtgactgctgggaattgtttgggttgctgctgctaggtctttgcctagcctttggtagtctgtttgtacctaatgcagataagaatttaggcaaacactgcataagactttcttgcagattgcacaaatctatttgctgctctcttctgtctccagttctgcctcccaaattctaaccatcttggctttcctagactaaaatcgtttgccctaacttag

SEQ ID NO: 231000 - DNA, 493 bp, Homo sapiens
acacgtcaactggacccagacaagtttctcatctgagtcaaaatgctgtgacccagaacagggaaagggctttcacatagacacatttcatatgagcattgcttaaagacacaaaggaaggaagcctggggttcaactgtgctctcaccaccccagaacctgatttggtctcctgctgcaggtccatgctttttaccaggccagacccctctccaggggcatctcagccagttcacctggctccaggaggcctgttcccatcaggaaaagcccctgcatccattgctgggatggtcatttcttttttctttttctttttcttttttttttttttttttttgagatgaagtctcactcccatcgcccaggctggagtgccatgctgcgatttcggctcactgcaacttccgcctccggagttcaaacgattccactgtctcagcctcccaaatagctgggattacaggcgcctgccaccatgcccagctaattt

SEQ ID NO: 231001 - DNA, 595 bp, Homo sapiens
taccctagtaaccaccattctactctctacttctatgacttaaactttttaagattccccatacaggagagaaaatgcagtaattttctttctgtgtctggtttatttcacttagcataaaatcctaagggtttatttatgttgtcacataatgacaagatcttatttttataaaacagagaaatattctgctttatatatacatatatatatacacacacacacacaaaggcatacctattttttgtgctttgctttcttgcactttgcagatattgtttctacaaaccgaagttttgtggcaactttgtgtttaatatctatgagcattggtgatctgtgatcagtgatcattgacatcgctattgtaaaccacaaccatatacgacagcaaacttaaacgtgtgtgttgtgactgcttcaccaatgacaatttctccatttctcttcctgttgtcaggcctccctattccccaagacacaacaatgttaaaattaggtcaattcatatctctacaatagcctctaattattaaaattaaagaaagaattgcatatctttcaaaatcaaaagctaaaataattgagcttactg

SEQ ID NO: 231002 - DNA, 575 bp, Homo sapiens
ttctagccatagcataactggtcgtggaagttatggaataactggaagaagaatccagattttcttaaaattaaaataagtgtaatttatacaactaaaatctgctttaaaatgtgtcatcctttgtcagtattttctgtggagaaaactgttttccttttactgtgagatatttaacctgtgtaatctcctgtaatcttttcttgataattttattttagcaattattactcgttttaatgctttgaaggctcaattcatatttttttgcgtgtgaattacttgcaatcagttcacattttcaaggtatataattttaaatctgatctattgcataaggaaaaaggaaaacgaaacatgtaaactgcagctattctaaagaagtgtttataatcagttccttatgcgtgaattcataaattttcaatgatatgttaaaattgagagagagcctggatagctccttcggtagagcatcatcagacttttaatgtgagggtccagggttcaagttcctgtttgggcgtgtcctgtggcttttagcacctaattctgactctatctttgaaaaagcc

SEQ ID NO: 231003 - DNA, 612 bp, Homo sapiens
attctggaagctactcgttttccaaagataaagctcttaaaaaacatggttttgagtaacctagggttgaatcttggcttagccatctactagtcttaagaacttgagtaagctggagagctttctgaaccttagattttttaatttaatgtgaaataaggagaacagtaagagtagcataggattattctgaagattaaatgaaatcacatgtttggcacaaaattgttagcttccctttttattttcctcttactcagatttcaactacagattgctcaaattctggatttaagtttttaatactatttgatccaaatatctttgcccagaattctctgtcttttttttttttttcttatctctatacttttgcagttttgggttgtcaagatgtataacagctgcctgctcctccctgcttttgatgcattcttaggactgtactctgatctaactaccagaccccttgctgtctggtttaatttacaggttcctatttttgtttcttcctcttcctcccacttcctttttttttttaggtttgacaatctagagaaatttttccacactataaagattttaaatatctctatggaacattagtaattg

SEQ ID NO: 231004 - DNA, 411 bp, Homo sapiens
  misc_feature (63)..(64): n is a, c, g, or t
tggttttgcccattttgcagatgcagagaaatggcagtcagtgttccactagaagaaacagannccagtagaggtaggaaggtagacagatggccaacatacctaggaaaattgacttatgtgatggtgaggctggctaagcagctgaaactcagataggagcagactccagcctgggcaacacagatagaccccacctcaaaaaagaaaagaaagaaagaaaagaaacttacaaggacctggcagactactgtgtcatcagtgggtgggatccttatgagcttctgcctggggacagtcggcctcgggccttttgttgctgctgctggctgggtggcctttcccttttttttgagatgcagtcttgctctgtcgccaggctggagtgcagtggcgggatctcggctcact

SEQ ID NO: 231005 - DNA, 399 bp, Homo sapiens
gagaaaaccacattaccacagccagaggactgcagaggaagggcccccagtgggagcttctgtagtgtggaggcatgccaccgcctccagacagcatggaagcaaggggaagtagaaaagaattctaccaacctctctctccttccacttccagtctcctgtcagtccctcccattgaccaaacccaactggagccctgccagcaaaggagccatcagcttcccctggcacagggaagagcagagaaccacagtagagaatgcatctgggtggggtgtgagcaaaatagtcgacacatagaatcatcaatagcaagagtattccagagctacagattaaaaggaagcccggggaactgctccacacctagacaggtactgcaaaatttcaaaacaccaa

SEQ ID NO: 231006 - DNA, 291 bp, Homo sapiens
cactgcgaagggaaaagccccaggagagtccagtcttttcgccttcagttcaatgaaaagtatccccaaaccacgaacacacttcccaccaggctaggaagtcccagcagccaccggcgtactcctgccagagcggggcattttcccggccggcgcctgcaaaaggagcctgtagcagggggtctccaagctggctgcagagaccctccctcagagaagagactgagaacgcgggctgctacagaatcccagccgggcttctaccatccaaaccccttttggcgaattctc

SEQ ID NO: 231007 - DNA, 98 bp, Homo sapiens
gggtttttggattctcacacctctgcctccctgagaagttcgcgattcctgctccacggaaacaacccactgaactattacagtgaaaaagctcattt

SEQ ID NO: 231008 - DNA, 178 bp, Homo sapiens
gatgtttggaaccagcagagctaataaataacaagcttacgtggcaagaatgaagagttaatgtctataacgcatctataaagcaagtatatactttcctttcaatatgttgaataaaaatcaagaatgtttttttttaaatgcatgattagtccagagtaatatttttactaactac

SEQ ID NO: 231009 - DNA, 470 bp, Homo sapiens
ctagaggatgaacattagagtagaatttctgattttacttatgtgcgcctttacatttggtagatattgtcaaaatgttctctaaagtgattgttgcagttaatgctcccatcaacaatgtgtggaattctaatgcattctcaccagcagttagtattagcagactaattaatatttttaaatctgggccaggcgtggtggctcacacctgtaatcccagcactttgggaggccgaggtgggcggattgcgaggtcaggaaatcgagaccatcctggctaacacggtgaaaccccgtctctactaaaaatacaaaaaattagccaggcgtggtggcggacgcctgtagtcctggctactcaggacgctgaggcaggagaatggcatgaacccagtaggcggagcttgcagtgagccgagatcacgtcactgcactccagcctgggcgacagagcgagactccacatctca

SEQ ID NO: 231010 - DNA, 379 bp, Homo sapiens
aattcttttaatcctcaccttaaagtaaactcaattgattctggttaaatcttcctttttttcatctgaattacaagaaacccaatggtaatgtttcttgcaatatgttttataaaaattttatttggaaagtttgaaaaatttctacacataattgaaaaggataagttgggcacagtggtgcctgcgtgtagtcccagctactcaggaagctgaggcaaggaggattgctggaggcaaggaagttgaggacagagtgtgctatgatcatgcctgtgaatagccactgcactcctgcctggacaatttagcaagactctatcttttttgaaaagaaagaaagaaagaaagagaaagaaagaaaagaaagaaagaaaga

SEQ ID NO: 231011 - DNA, 386 bp, Homo sapiens
ttcatattccaagaaaaatttattgagtcatctacattaatatttaatgttccccttcctccaaagagcaaaacaggaaccaaaaaattcatacccgaggccaggtgcggtggctcatgcttgtaatcctagtactttgggaggccaaggcaggcagatcacttgagctcaggagtttgaggctagcctgggcaacatggtgagaccccatctctaccaaaaaagcaaaaaattagctgggctttgtgacgcatgcctttcgtcccagctactcgagaggctgaggtgggaggattgcatgagcccaggaggcagatgttgtggggaaccaagattgcaccactgcactccagcctgggtgacagagtaagaccctgtctccaaaa

SEQ ID NO: 231012 - DNA, 505 bp, Homo sapiens
cagagtgggcacaggctccctcactgggtgaaggaggcgcaaagaacgggaagagccatcccgggagcccaccggcctttcagtttcccttgggcccccaggcggttcagcatataaactgttaacatgaggtaagcgccaaggtctagagaaggcagtggaagagatggcaaactccggcaccatgtctgcgtgtccagtgtgctctgctggagcagcacatttttgtacattgctgtatttgaaaaaaccctgcaagaatcatgaaactggacgaccatctttataacactcccagtgataaaacaagtaagaatggctggtttgtagtcatctgagcagcctctctagtttcgtagatatggtttctctctgatatcgaacgacttccaatgtcaagcggaatgctacatcacaaggataaccgtatgtgaaaagaaccagttttctttgtaatcctgaactttctagtttgcgcattaaaagacattatttgaagaagagc

SEQ ID NO: 231013 - DNA, 354 bp, Homo sapiens
aggctccagacaactcgtaatgaatgatcataggctcttcatgttatcaaataccacagataaggaagtgaggtccccaaacaaataagccatgcatccagatctgaagttttttcaaggctctggggacactgtcatgcagggtgggtatatccctaagtccctggggtgcctacactggggcaggagcagacacatgtataaataaagaaccaaggtagttaaaagttatgacagatgaaggaaatatcataaaacagagagatgtaacaaagagtaactgggagctgaggtgaggggcatattttagctggggcagtcagggaggtcctctctgaggaggtgacatttgag

SEQ ID NO: 231014 - DNA, 419 bp, Homo sapiens
aaatgtgtcatattcgtgtaataacttagtgaaatgaaacacattaagaagcattaaggtggggatgaagtatatcagagattatctctagaattacttgattcgaaacgacatacgtacttctttgtgcctttcgatattatccaaaatgtccatatgatcatatattagtaaggtgatgtttttattctctacatcctttgtgtagttatatattcatttaaattaatgatggttgtaattcaaagatagttttgagtagaggctattaggaatgtgaagatcatactattgctgattcctgccttcgcatgttgcaaatggaattaaatgtattaaatgtattattagtatgtgttgtttgaaccctacatctgacttcagcatccctttggtgagtacctttttcctttatttat

SEQ ID NO: 231015 - DNA, 711 bp, Homo sapiens
ttagggggaagtggtgactcatgcccgaggggcaggatgagaatataggtctcataggcatcttcaaaccaggttcgcctctgctccacatttgtgccatgaaagagcttcgtttcataacaagccagagaccaattctaaatcagtatctgcacaggcctgaagaattgaaggcttatgcaatagcagtcattgccagggtgggtgtggatcaaaacgcaacgtagaaatccttacgccattgcaagcagcttgtctcctctgccccagttgttcttgtaattttaacaaccatatgcttatcttctgttttctggcagcctagaactgttcttcatttcttttttagactcaatagaaattaagtggtttggccatcaacattcctgtctgtcgtctctcagtcttctgtgaacaggaccagatggaataagctctttgatagttacacattcattggaattgaaaaaatgggcagctgattttctattttataggcaaagtcccaggcctgcccctgtgagagtgtggcctgctgggctactgtcttattctgcaacaaggggtgaagccacaaagattatgtctaaaagagtaatcacagagacaggacagggtttaggcagaagcaagaatttcagagcatgtgagtgaggaattatctgcactggagtggacttattttataatgggaaaattctcagaatctca

SEQ ID NO: 231016 - DNA, 587 bp, Homo sapiens
tggtgtaccctgggggatgggaaggccagggctcagggctgtggtctcaggcccgggtgaagcagtgtccttgtcccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgcactctggcg

SEQ ID NO: 231017 - DNA, 888 bp, Homo sapiens
tccagcacctttctcgggtcacggcctcctcctggttcccaagaccccaccataggcagaggcaggccttcctacaccctactctctgtgcctccagcctcgactagtccctagcactcgacgactgagtctcagaggtcacttcaccgtggtctccgcctcatccttggcgctagaccactgaggggagaggactggggtgctccgctgagccactcctgtgcctccctggccttgtctacttctcgccccccgaagggttagtgtccagctcactccagcatcctacaacctcctggtggccttgacgcccccacaaacccgaggtataaagccaggtacaccaggcaggggacgcaccaaggatggagatgttccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgcactctggcg

SEQ ID NO: 231018 - DNA, 565 bp, Homo sapiens
acaattctctcccaggtctcattctctgtacagtttcaaggcaagaacttgagaaacaactctgttgaaagttgctgtttacttttctacttagagataatttgaagtttgaggctttgtagctttatttgttcttgttgaactattttgctggagggcgtttcttgagatttgaatttatgtggtcatgattattcttgagcacttgggagattaacaattgaaaattaaaacataaaagatgatttaaaaaacatattcaacttagctgaagtgaatactagtaaactagaagatagctatcaagaagtagattacctcagaaagagagagcgataaagatataaaagatttgaaagagtgactaaatatatggagaataaaggtaatgagtataggggaataatgtgcagtctttgacgtaataggtgacatatggttaggatatagttaaatttatttttccatagctgttagtacataaatcctcaatttttctattaagccatttctgttttattattaatatgtagaaatgttatgtgtagtaaagaaattaatcctt

SEQ ID NO: 231019 - DNA, 334 bp, Homo sapiens
aaactccgattctttcaactcattccagtttggcttttatgcccactacaataaacctgtgcctgtcaaggtcaccaaaacttgcatttggctaaatctaaaggacaattctcacacttcaacttactgaactagcagctcttgacccagttatcacccacgccttcctgaaaacactttcttcaaaatttgacattctgaacaatacattatcttgagtttccttcctacttcagtttttctttttcagtacccttctgtttggcataaatacatttatttcttccatcttaaaacataaacagaaatgtaccttgattctatttccctcacc

SEQ ID NO: 231020 - DNA, 417 bp, Homo sapiens
gctgtggtctgaagggctgtgtgtgaacgggggagccagagagacttggatctatcagtcagggttttctagagaagcagaaccaataagaaggaaagaacaagagttatgatgaggaattggctcacatgattatggaggctgatgagtcccaagatccgtgggatgagttggggagctgggggcccgtgagagccaatggtgcagtgcagcaaggtgctacggaccccggcagacaggtgtggatgatattctttgccaactgcctttggacaacctcagatttcaccacggtcaacaaatagagttacctctgacttcagtttggaaatttttttttttttgcagggaattctttgtagattttcaaactgctgttgattagtttgtcaataaaatttattgagtgccttccca

SEQ ID NO: 231021 - DNA, 718 bp, Homo sapiens
aaaaaaaaaacaccattatgggactattacacaacttcaagagggaaagggatttcagaattggaatctttcctgtatctgtattatgtctttacttgaaagagagagatacatcccaaatatgtcaggaaggtaataactttttaatcctggtggtaggtaatagaatttcggtgtcattattggttgtaccattctatatgtttgaaatatttcatggtttttattctttaattaaaagaaaaaatgtatctaataccagtacagtctttttttataaatacttctcagaattcttttaggtcagtgattcctagcttttcttttggtcataagtctatgagtaaagacattaaccctctccctagaagtatgcatgtatgtttgcactcatactcatagacatgaatttttttttttttttttgagacagagtttggctctgtcacccaggccggagtgcaatggtgcagcctcagctcactgcaacctctgcctcctgggttcaagcgattctcctgcctcagcctcccaagtagctgggactacaggcgcccgccaccatacctggctaatttttgtatttttagtagagatggggtttcactatgttggccaggcttgtcttgaacggctgacttcgtggtccgcctgccttggcctcccaaagtgctgggattacagcgtgagccactgtgcctggccgacatgaattttt

SEQ ID NO: 231022 - DNA, 462 bp, Homo sapiens
agcacagaaagcgatggtctgtagacattagaaaccctggacctgagggcaggactgaagttgtaatgccattgctgggacaggaaagaaagcttcaggcatggataaggtaaggagctagaactggaccctgcatcctcaaaaacacagggtgtaggaaagaccgatcattggccggggaggtgtcaaagatgtgcgccttatgctaggggccacaattgggaaaataatcactcataaattatcaaactcaaacctgcactctttgtagttgtgggatccaaattcatactatctatatggcacagaagctaataaatgaacgtagaaatggttatgaaatgggtaacacttctatgggcttggcagggacaaatgcaaaaccactttgcagggatgttttcataagcctgagcaagagagtctctcaggtaaaaagctactgaatgtcagtttactatc

SEQ ID NO: 231023 - DNA, 363 bp, Homo sapiens
agtgattgatgctggctttctgtattagtctatttgcatgctgctgataaagacatatccaagactgggaagaaaaagaagtttgaggctgggtgcggtgactcacgcctgtaatcccagcactttgggaggctgaagcgggtgtatcacaaggtcgggagttcaagaccagcctggccaacatggtgaaaccctgtctctactaaaaatacaaaaattagcccagcatggtggcaggcgcctgtaatcccagctactcgggaggtggaggcagagaattgcttgaattcgggaggtggaggttgcagtgagacgagatcacgcactccagcctaggcgacacagcaagactcagtctcaaaa

SEQ ID NO: 231024 - DNA, 259 bp, Homo sapiens
tccctattttgctccttcttggaaaaaagttagcagtctcgagacttttacgctgaagtggattttaagttgtcagaagtgtcaagctgatttgcctttttttctctcttttattaaaagaaaagagatacatactacattcagacagaaagcatgtaaggggtcttataagtgtgagcatgtgttagtggattaatgggacaatgtgtgtggatggtgatagaaaatatgagagaactattgcttggctgataaatga

SEQ ID NO: 231025 - DNA, 513 bp, Homo sapiens
aggagcagtctcagagcagcacccatcactgtcagagtcctatatcccagacagaagcgaatatgacccaggcagtagctgcacattaaacattggtttaaagggccctcagcgaacaggactgggtgcctgctgtgggctaggctctgggctgggtaccaggagttccgggacaaagaaggccaagccctgccctcactgagcccagtcaccaaggagaaacagacatgtgactagtcaagtaaatagagctctgataggcctcctggagggggcagcagttgtctctgcatggattgggagagtccaacaggcagagcaggagaaggtggggcaggggaccacaagatgtgttcagggaggcagtgaagagtgtggtgtgagcccaggagaggggcttggatgtagtgacaagatgttcaggaagcccgtggcctttctggggaagagaatcctgaaagcaatgcagcggttaatcgtattgttacaaaaatactatacacttgttaaaaa

SEQ ID NO: 231026 - DNA, 376 bp, Homo sapiens
ccttggtgactgggctcagtgagggcagggcttagccttctttgtcccggaactcctggtacccagcccagtcaccaaggagaaacagacatgtgactagtcaagtaaatagagctctgataggcctcctggagggggcagcagttgtctctgcatggattgggagagtccaacaggcagagcaggagaaggtggggcaggggaccacaagatgtgttcagggaggcagtgaagagtgtggtgtgagcccaggagaggggcttggatgtagtgacaagatgttcaggaagcccgtggcctttctggggaagagaatcctgaaagcaatgcagcggttaatcgtattgttacaaaaatactatacacttgttaaaaa

SEQ ID NO: 231027 - DNA, 507 bp, Homo sapiens
aaaaaaaaaaattataaagaaatacacagaggtgattactataagtcaaagagttacttgttcagggggaaggagggagctacgattgagtcagggcatgtggtggggtttctgaggtggccggcacagttctatttcttgatttgggtggtggttataagggtatttgccttatcataactcctcaaactctagaggaagaagtctgctgtgaagaaaagattaaggccgcggtggctcaaacctgtaatcccagcactttgggaggccgaggcgggcagattgctcgagctcaggagtttgagaccaggctgggcaagatggcaaaacctcgttcctacaaaaagcacaaaaattagccaggtgtaatggcgcatgcttatagtcccagctattttgggggttgagggaggagaattgcttgagcccaggaggttgaggctacagtgagccatgtttacaccactgtacaccagcctgggtgacagagttgagaccctgtctaaa

SEQ ID NO: 231028 - DNA, 1009 bp, Homo sapiens
gaatgtaatcaatgtggaaaagctttcagtcaaaaaacatcccttaaggctcacatgagaactcacactggagagaaaccttatgaatgtaatcagtgtggaaaatcctttggcacaagctcttaccttatagtgcacaagagaatacacactggagaaaaactctatgaatgcagtgagtgtggaaaagccttcaacacgagctctcaccttaaagttcataagaaaattcataccggagagaatgtttatgaatgcagtgactgtgggaaagttttcagtggggtctcatcccttagaatgcatataagaactcacactggagagaaaccctatgaatgtaaggaatgtaggaaagccttcagtgtttcctcttcccttaggaggcatgtgagaattcacactggagagaaaccctatgaatgtattcaatgtggaaaagccttcagtcagagctcttcacttattatacacaagagaattcatactgagagagaaaccctgtaagtgttatgaatgtggaattgctgttttcattgtcttaaggtggattccaagctccttgtctcagtctttgttctctaaaagaacgatttaaggttacaaatggctctttttttaatataacattttctgtaaatactaattatgactttttttgatccatggctgtttagaattaggtatttttaatatgtgaggtaggtatattttcagttatctttttattgttggtttctaggttaattccattgtgttcagagaatctggactatattttactgctttgttggtgtttttataaaagttgttttctggcccagtgagactggtattgctagcagccaaccaaacatttgagctcatctttccttactaatgaattccatcttagccaagaacaataaggtctctggttatagaacgcttctttgacttcttgtagctaagggtagccatatcattcattcttgctgattcaaaaatagacatatcactgggatcagaa

SEQ ID NO: 231029 - DNA, 331 bp, Homo sapiens
gaatttcactggtgtttactagtgagtcttgaccttccttaaagaggtaaggagatgacaatgccacctcatttcaatagctcacataaactaaaggaaaaaaacttatgacttgcctatgcctgaggtttggaattccttagtttgagccaccaccttcatgtccaaatgaactgggagtggaatttttacagtagtccccccttatcaacagttccactttctgcagtttcagttacctgtggccacctaaggtccaaaaatattaaatggaatattccagaaataaacaattcataacttttcaattgcatgtcattctcagtagtgt

SEQ ID NO: 231030 - DNA, 354 bp, Homo sapiens
tgagggggtccgtttaaggctactcaagttcttctgactctccagtcagaattactcaatcatttagggtagggccatacatacacatgggggaaatgtcagggtttggcgttaagaaagctaggaaagaaataggtatgggaaagtatttcatgggtgcaatggttgatgatccagcatctactttcctagtgctctacagctggggcagaggcaatggctttaattttatttgcaaagctagttaagagtcgatggaagaactgacactatttgataaactgtgcccaaactctagatgaacactatttcgagcattaagcacagatatgagcagactctccagacacctgg

SEQ ID NO: 231031 - DNA, 130 bp, Homo sapiens
aaagaaatagaagttatcccataggctttatttcatgagaattaaatgagttaacatacaaaacctaagcgcagttcctaacacatagttaatgttcaataagtattaactagtattaatgttgctatat

SEQ ID NO: 231032 - DNA, 514 bp, Homo sapiens
ccccttcctccatgattataagtttcctggggcctcctcagccctgcagaactgagtcagttaaatctctttcctttataaattacccggtctcagactgttccttacaacagcattgagaatggactaatacaagactacagaggaaaaaaaaattttttatatagttttagcatgactgctagggcatccaggtcattttgatcatagaacccttctaaccagtttccaggttaagggttccacttgtgaaactcttaatgggaacctcatttttcactgtttttctctatagctaccacatcaggttatttagcggtaaagttattagagtaattagaattcactatagtaaaggaaaatgatttttgaaaagtattatcccatgagagttggtttagttcaacagtcattctgtcatttcttattttggtagacatttaatttgtattttttcctccaaaagtgatctgtagagtgagtcataaataaatttctattattctattgccca

SEQ ID NO: 231033 - DNA, 202 bp, Homo sapiens
cattttattagtgatataggaatgacagcagaatgtcaattattctataattgataatattagttttattaatctgtgtggacacagattaaatcattcattttctactacttattttctcatcttatgaaatgagattatgtttacattataagattgtcggctgggcatgatggctcacgcctgtaatcccagcactctg

SEQ ID NO: 231034 - DNA, 169 bp, Homo sapiens
agtcaagtttgttacttcttgttttatattctctgcctagagtttattttcatttcttttgccagcttcatcagtttagggccacatatcttttgtacatctaaaatggtgcccgtttccagtgtgtccttcaatccatcctacacgatactgccagactcacctttct

SEQ ID NO: 231035 - DNA, 419 bp, Homo sapiens
actgaggcccagagaagcaaagtgtatttcctagggtcacacagcctaggtctccagactggatgtccttctttctgcaggtctgggtcagtatctgtagctgggagaggcggtgggggaagggagagggcaggcaggaattggagccttccacatgcctaacttgttagggcgttcatgatgtcacaattaggaaggaaatggagaggggaggcctcggaaaccccccaaaggccctctgattgcgccctgcggaatccctccaggaattactccctggtcctctcacagtggctgtggtctcagcctgagataaaaggccagaagcaggaaggtaaatctgatggagcttcctccaccatccccaccccttccccaaatgtgccctccttctcttggatatacaacacagttaaaaa

SEQ ID NO: 231036 - DNA, 169 bp, Homo sapiens
ttcctgcctcgcctccaccgcctgctcctccgcctccgggctcctccggccccgcgggcgaggccgccggctcgggggcgcaggggcgggacggcgccggggccccggtggcctcggccgggggcgcgggttccgggggcgcgcgggcaggctccgggctcgcggccgc

SEQ ID NO: 231037 - DNA, 411 bp, Homo sapiens
catttggatagttgggagaagctataatggtatatcatttattttataatagtatgtaagattgataatgggacaagtcaatagcttccacattgtgtttaggctttccagcaaaattggatttaaatatcatatttaaatatttatatttataaacttaaaaaatcaattttatgtaaaaaagttatattggagtttatcaaactaatatacatatatattttctttttgaggcagggtctggctctgttgctcaggctggagtgcaatgatgcattcttggctcactgaaatctctgcctcccaggctcaagtgatcctcccacctcagcctcccaagtacctgggactatacctggccaatttttttttctttttttttttttttttggtaaagacagggtttttcca

SEQ ID NO: 231038 - DNA, 389 bp, Homo sapiens
tgagacagggtctcgctctgttacccaggctagagtacagtggcaggatctcagctcactacagcctcaacataccagactcaagtgatcctcccacctcagcctcccaactagcagggactacaaggtatgtaccaccatgcccagctagtttttaaaaaaaatttttagagacaggatctcactatgttgcctaggctggtctccaagtcctgggcccaagccatcctcccacctcaacctctcaaaatgctgggattatatacgtgaaccaccatacccggcctcaaaatattttcctttggattttgcctcagcgattcacaaatgtaaaaactattgttggctcactggttgtacaaaaacagcttttagccatatttggactg

SEQ ID NO: 231039 - DNA, 510 bp, Homo sapiens
cctgtatttgcagaagcaatgagctatatttggagaaagatgaagtttgtgtacatgcaacagtgtatcaccatcagacatgtatcagtcacatttgccaagagcttaataaccgtgctgcctgtggcagggtgcttctcagaatggatttcaccatgttatgctttctcaaatatataagaatgttacagctatctattgaaaatgagaaaagaaagctaaaatgaactttagtcaactaaattgactaaagcaaaaacttgttctggcaatatatggtcaaaaattgttatttttctcaaattttatgttcactctcaaaacccaccacctcatctgataaggaggattaacacttacctagaaactcaaacattatttgaagtgagctcaaaaaacaaatgcaacttgtaaattatcagtagctaagaaatgactagccaattagaaggacagcttctaaactgctcaaatgtcaacagtgagactacttaaggcagaagtaaacaa

SEQ ID NO: 231040 - DNA, 395 bp, Homo sapiens
gtcatgaggggatttcaaattaaaacagcaataaaatatcactatacagtattagaatggccaaaatctaaaacactagcaacaccaaatgctgaccagcaatggggaacaacagaaacattcactcatcactggtgagaatgcaaaatggtaccaccactttggaaggcagtttagcagtttcctataaaaacaaacatatctttatctgacaatttagcaactgtactccttagtatttacccaaatgaattgaaaactgctatccacacaacccacacacgtttatagcaactttatgaggaaacaagcaagacgtccttcagtacaagtggataaactgtggtaccagacaatggaatattactcagtgccaagaagatgcattatgcctg

SEQ ID NO: 231041 - DNA, 192 bp, Homo sapiens
ggtagctgaagtaaatactctaaggcagattttgcaaatgtgcatctttaagccgtgaccccgatggccctggagtgggggtcaaggggactgagtggaaccccagtgagtcatgatttaggacagaaaggcaaaactgtgaccaaggcccttaatgtgtctggtatcctgggcccttctggattcagtctt

SEQ ID NO: 231042 - DNA, 313 bp, Homo sapiens
ctgggctgggttgggttgggctgggcaggcctcaggagaggagggggcagaaagagcacccccctccctggccccggcagaacgatggtgacctttgaacctgggggcagggaagaagtggcctagcaggcagattgtgggtttggcctgtggcttgggctggagggagaaggggtggtgagaggggacaagggagggcaccccccacccactgggctcactcctcatggtccagctcaaccacactgcccggacggtccccactcattcccatccatccgtttctccccaacctgcctctcctctcagacac

SEQ ID NO: 231043 - DNA, 386 bp, Homo sapiens
ataccttcccaacatggtgtattatcagtctttaatgttttccaccatgttaagcaaaaaacgtgctatttgtcattgaaactgagcaacttaccttattgattagtgttatatgtttagtctatgagttgcctgtttttttctatttttctacatagaaattagtggtagtggaaacactttgtgtaaatacctataatacttggccaaagtagtactcagaggaaagtttatattcttaaattcatttgttaaacaacaagaaagattaaaatttaaccaaaagacagtagcagagagtaactaatagattgttagggaattattgagataaaagcagatagtatattgctgatattttatgttatgtgtgctacaccttagtg

SEQ ID NO: 231044 - DNA, 602 bp, Homo sapiens
aggtgcggtatctgaatcatccatgattacatcattaataataaaaacagcaccgtccactcagcctccaacgttctctgaaaaacaattcatgtccaaggtatcaatttattcctttgtttttcatgtattcattcaataattatttcctgagcacccacccaatactaggtcctatgctatatattagagagacagcagaataaagatagaaaagagatcttatcccctaagtactatctaataagggagattaacagtaaacaggtaaccaaccaaatatataactgcaaattgagatgaatgctatgaagatcaacaggatttttttttcatttaaaagatctgagagggattttggaaatatccagatgaattcatatcaatatgaatatatgctcagttgcaagtaatggaatcatgattaacattgatcttaaaaaacaaagacatttcattacctctcataagaaaaatctggaagtagatggttccaaaatcacgaaagtggctaaactacatcataaataacccagtttcctcctcctgtctttcgcctctattatcctcctcagcatgttggctttttgttcttgtgcttc

SEQ ID NO: 231045 - DNA, 505 bp, Homo sapiens
gtgtgtgtgcatttgtttgtgaagctacgtaagatttggttttgacaacaatttatgagaacatatgggaaatgctttatcttttaaatgtgctatttactgtttgtcttaatttactccttcctctctgggataggtttactgaccgtaagtcttggattttcctgaattgggttttagttcaaatttctaaaagtttatcttagtatcagaccatgtgccttgactatttatttgaataatgcgttcagtttgggtttagaaaatttaaaggttacagagcatagataagcattaaaaacaaagcacaatcctgtaagtctccaaataaaaatgttactgaaaacatctttgaggtttctttaatatgtaatcaacatgcaactttatgcaaaattctattgccattgttaagtactttatttcacagaattattgagaaaattcttttggaaaccaatgacttgatgtatttaataaaaatatttttgtatttgtaaatctc

SEQ ID NO: 231046 - DNA, 677 bp, Homo sapiens
atgctcagagagtcatttgcccttggtcacaggctaagaagaggcagagctaggacgtaaacccaactctggctctatggcatctcatatagcatcatttttcctccagtcctctgactagaaagggtggccccttcaacctggtgctgagaacagacactggcggccccacacctctgaaggcatggttccagcaaatagaaattggactggcaaggattaaaccgctggtttgggcttcattagctatgtgatctcaccaaccacagagaattaaccagagtggagccatctctttacagacttaacacaatgtaccgaggcaatgtggagaacagtcactgaatttattgagcacctactacctgctccagacatgccattaacacgtgggctatccttcccttccacagtcactctagaacttgaggccactgtcctctgatgcagagagaagaaacattttataatcactgtagacaataaaggctttatctgttagcaagcacttttgcttaatgacttggtcatggggaaggagagacaggttgtacttggtcctcattttgcacttggttagagagtaagaggcctttccatctccactgctgctcaggtacttcctcccagtgtactctagcactcccccagcaggttctgtagaaacacagacccca

SEQ ID NO: 231047 - DNA, 320 bp, Homo sapiens
aaacataatgtagtgggcatcatgctgtaacatccagttggccaaatgctttactctaaaaatgtgccacagtggggaaagcacgatgtttgatgtttaaaatgtttttgttatgttacagacttttaaggttatgccctcaactgtgcatagcagtgaagagacttgaaaaggaagacagtaaagccttacagacttcccttaagtttgctgctctataagtatgcagcctgctgcaggtgtttcctgttggttagtaaataacctccacacattggctgtttaaaattcagctattaataaaaatgtgtacttttgtc

SEQ ID NO: 231048 - DNA, 816 bp, Homo sapiens
atactgagctgaggcttgaagatatattttaaccttaaaaatgaattcctcagggggaagaatggatgccttgaaacttgctctcaagtttttcatgtgtttctttttgtaacttaatgtctctactttgcatatgtccctttggcctttgcagtctctatgtctgtcattctttgcataataattcatatcaaaggggagaaacagctattttttgtccctagaagttctgctcttaaggttgaaaagaaagtttgaaaaatcatatcatttaggttagaagtactttgtgttgttggtatccaaaattaggactctgagattcttgtgtattcagagaatttttagtaggaaacaaggacaaatttgcatatgaaatgaaaatagttattacatgacaaaatatgtagatctgatttctagaaactgaattagtccaaaacaagtaagagtgggaaaagcagtaaaaagttcttcttgaatattgctgttgtcatccaaagtattcttatttcttttaggtgaaaaatttccattactcttttgtgatattctcaaaagaaagtttaggattttacagtgttctgaaatactgaatcttaattcagtatttcaatagagtattattgatttgcttccttatcagtagatttttaaattatttatttctaggctatagatcttcctaaaatataatccaaagtaggtttaaatgcagatttctagacccaagtataaagatctcttttctggagcatgctatatttaacagttttttcctaagtttgtttttgtttttggaatcatgatatattt

SEQ ID NO: 231049 - DNA, 724 bp, Homo sapiens
gccgctttgatatgaattattatgcaaagaatgacagacatagagactgcaaaggccaaagggacatatgtctgtcattctttgcataataattcatatcaaaggggagaaacagctattttttgtccctagaagttctgctcttaaggttgaaaagaaagtttgaaaaatcatatcatttaggttagaagtactttgtgttgttggtatccaaaattaggactctgagattcttgtgtattcagagaatttttagtaggaaacaaggacaaatttgcatatgaaatgaaaatagttattacatgacaaaatatgtagatctgatttctagaaactgaattagtccaaaacaagtaagagtgggaaaagcagtaaaaagttcttcttgaatattgctgttgtcatccaaagtattcttatttcttttaggtgaaaaatttccattactcttttgtgatattctcaaaagaaagtttaggattttacagtgttctgaaatactgaatcttaattcagtatttcaatagagtattattgatttgcttccttatcagtagatttttaaattatttatttctaggctatagatcttcctaaaatataatccaaagtaggtttaaatgcagatttctagacccaagtataaagatctcttttctggagcatgctatatttaacagttttttcctaagtttgtttttgtttttggaatcatgatatattt

SEQ ID NO: 231050 - DNA, 143 bp, Homo sapiens
tcagttgttcatgtcattgagaaatgtcaacagaaactacattttgatatccatcagccagaattaatagttgaagtattagccttgttttggtacaggtaatgggtacattatttaaagctgagagaaaagccttaattttg

SEQ ID NO: 231051 - DNA, 326 bp, Homo sapiens
atctttgaaaaaaatactaatgtatagtagggcattaggcaatacaggaatgtgctgatttcttatgcttttgccagtactgtgttgggtattttcctgttttatatttcctgattcacaagtcaataaatggtatctccttgtttttagatttctttgattattaaaggagttgaacatcttttcacgtttactgaccatttgtatttgttttgccttttcaggtccttttcccatttttttttctgctgtatttatcttgttcttaataatttccaagaactccttatgtatcaagtataataaacctgttttgtcatccaagt

SEQ ID NO: 231052 - DNA, 399 bp, Homo sapiens
gatagaaatcttaaaagaatgtatgggacataaagataagccaaaaatggggattgtggcaatcttgtgtgtaacatttctcatttcataactgtgccagtcgcaatgtaactcaaaggaaaaaagaaagcaccacaaccctttgctttctgggtagcacagacacctgtaatattttctatggtcgccaaggacgaattcctgacagagtgcaattagcacaggttcagaggcctcaagtccaaaggaaaggattctgtgagaagttaaaactgcaagatgaaaaattttcagtagaaatggcgctgatattgagtttcttcagatgtttttctttttgtatttataaaatatttccattgtaaagcattcaattaatgaagaatggtgtaaagtaaa

SEQ ID NO: 231053 - DNA, 428 bp, Homo sapiens
attaataacaaatggaaaaaatgattatcttgtatactggaaagtagtaagtgctgttgtgaagaagtatagcaaagtgagagggatcaggaatgtgggagatggaggtgggggggaagttgcaatgttaagtagagtggtaagaagagaattccattagagtttgggaagagccaggcgccgtggctcacgcctgtaatcccaacactttgggaggccgaggcgggtggatcacgaggtcaggagttcaagaccagcctggccaagatggtgaaaccccgtcttgactaaaaatacaaaaaactagccgggcgtggtggcgggtgcctgtaatcccagctacttgggaggctgaggcagagaatttcttgaacccagaaggcggaggttgcagtgagctgagaccgcgccactgaactccagcctgg

SEQ ID NO: 231054 - DNA, 410 bp, Homo sapiens
cagcaggattcctgaccccagaatcactatctcaagacctggggttctaatttgagaggcagaaagttacagcaactcaaatttatatgcatcttacaaaatagcttcaaaatacataaattgacaattgacttcaaaaaggctttctcaattatccataggtcaggcagataaaaatcagtaaagatagaaattttaaaaacaatgatcagcctaggcaacaaagtgagacctcatgtctacaaaaaaaagaaaaaattagccaggtgtagtggcacacatctgtcatcttagctattcaggaggctcaggcaggaggattgcttgagccccgaagttccaggctgcagtgagctatgattgcactgatgcagggcaagtaagctcccaaattgggacttagccctgga

SEQ ID NO: 231055 - DNA, 301 bp, Homo sapiens
tgagcccctcttccacaccatccccaggggaaagctcccttcatctatcagggacgtcatgggccagtccaaggcccccaggtttttggttctgatgtgaaggaactacttccaagctaagcaaaacccctacttcaagcaatcaaaccagatgccccctttggccccaaggcaaaatgtaattaagtaactacgtggtttgtttgctgttctttctgtgtgaaacacacttcccctaaatcttcccacggctggctcaacctccagcccttagtaacctaaaataatcgctgctgtttct

SEQ ID NO: 231056 - DNA, 356 bp, Homo sapiens
agtaaggttgttgttaatgttttggacatcatcagttatgagtagggattggggagtgaaaataattctgtcaagccaatgataataagagaaacatttaattgtttggaaaatagttttattcctcaggatcatgattcttattttactcatacatgaagacaaaatcagaaaatatacataaacttattttttgattgattgtaaatgcatttatatgtcttcaatcaagaaaataatcatattttaaacttattatacctataatcaattgttgacaatatgcttggtgaaattagttttgctgtatcttttagcagttctctgagtttctttcgctgggttctcctctggta

SEQ ID NO: 231057 - DNA, 420 bp, Homo sapiens
atataagcttggggtccatgggggtccctagaatagtggccttataatggctccaagagggtacactgggatttggcccagataatggagggacaccctggcgaaggggcagagtcctggcagttcagccagccccagctctgtctttttcttgaagctcaacagagtatggaaatcattggtctcacccagccccctcattcttctgagggggaaacaggctcagaacagggcagggactaaactcaggtcagcagtagagcccagaccagaacccaggctcagtccaagcatcttagttgtctccaatgatgataaataacagtaaaaacctttctgcagagcttcccaggggctggcctgggcttaggcaccctctggatggtcttgggcagacgtttttcacatctcgagccttag

SEQ ID NO: 231058 - DNA, 611 bp, Homo sapiens
aaaaaaataggggttatctgttactcgacatttttgtagaggatgcctataaaatcatctaggtctagtagaccttctcatatttatatagacattcagatggttttccagctcctactaaagtgtatatctaagaaatttcctgttttcaagtgtagtggaataaaaggatgtataatattcatatactcaaaaacaacttaaagagatatctctatgtgtggaataagaatctctataatatccatctgtgcctttcacaagatgtatgttgtcagaaattattgccttattagtctttcaaagaagtaggctttcattcaataaatatttattctgtacctatggtgaactaggcaccgttcaagggtctgcagattcatcagtaaacaaaatcggtaaaaatccctgatgttaagtagcttacattttagtagaacttaatgctaaattctttactttctttatttttatcatgaatttttgttcttatcattttctttcttctaccttgtctggttgtatgtctggttgttgattcccttggggtttcagcatagaagcaagaaagtagagagtaagttagaaaaccaaaaaacaaacaaacaaaa

SEQ ID NO: 231059 - DNA, 520 bp, Homo sapiens
gatgtttcagttccattttttaagttatctatcctctttcactctgggctagttgctttctaggcacattgtagctgatgctctgtgacttccttttgtggtcatctttggaattcccattactttccggttggaatctctgttttctggctttcgtgtcctcctcatgcttggctcactcccctcattagagcacatcttccaggacacacatctgtccatatcaaaatccattcatggctgggcacagtggctcacgcctctaatcccaggactttgggaggccgaggcgggtggatcacctgaggttaggagtttgagaccagcctggccaacatggcaaaatcccatctctactaaaaatgcaaaaattagccgggcatggcggcgggtgcctgtaatcccagctactcgtgaggctgaggcaagagaattgcttgaacccacaaggcagaggttgtggtgagccgagaatgcgccactgcactccagcctgggctagagagcaagggtccatctc

SEQ ID NO: 231060 - DNA, 337 bp, Homo sapiens
aagaaaacactgacacatggaaccaggtgtctttgttttggcaaggacagcaactgtattctgatactaaggtgggggatgggagttccgggcaaagacattaatagcactcatattgttcttttcgacacagatttgagagagctcttcaaatggcaaacacctagcatgtggggatctgaagcacctctttgtgggtttcactctcaacactcttggaaaatcaccgagtgtcatgagaggtgttattgatgcaggcctgtcatgcaggggactgacagagaggcctcctcagaaagactgagatggcccacagcagagggcagaaaaaaagaaa

SEQ ID NO: 231061 - DNA, 653 bp, Homo sapiens
aaaaaaaaaactgttctttacactctatttattaagaaagaaatagaggctcacattgtagaaagattgctacgtggtcaaactataaaaggggtttacctagttaacctgaaaagttcttgcccagaacatcctattcctaagcattctgactgtctgcatgctccatcaactctgtaagtaatgtataatatgaatagattccctgacaaaggaagctgctttgactccagcaaaaattagtaggtccaaggttatatatcatatgattccattcatatgaccttctggaaaaaaaacaaaactatagtgacagaacagggcaatgattgccaggggctaggaggtaggggagagtatgactacaaaggggcagcagagggagttttttggggtggtggaactattctgtatcctcattgtggtagtagttacaggaatcctcatcatgctaaaattcatcagctgtacaaagattaagcagttttactatatgttaacttaaattaattaattgattggctcaactcaagtgactgctttccttacctggataaagcaacccaaaggattagagtttggggagacagaaaagaagaatcagaaatatgaggagggtaggcaggaagagagaatgagaaacgtgcacactg

SEQ ID NO: 231062 - DNA, 600 bp, Homo sapiens
aaaaaaaaaactgttctttacactctatttattaagaaagaaatagaggctcacattgtagaaagattgctacgtggtcaaactataaaaggggtttacctagttaacctgaaaagttcttgcccagaacatcctattcctaagcattctgactgtctgcatgctccatcaactctgtaagtaatgtataatatgaatagattccctgacaaaggaagctgctttgactccagcaaaaattagtaggtccaaggttatatatcatatgattccattcatatgaccttctggaaaaaaaacaaaactatagtgacagaacagggcaatgattgccaggggctaggaggtaggggagagtatgactacaaaggggcagcagagggagttttttggggtggtggaactattctgtatcctcattgtggtagtagttacaggaatcctcatcatgctaaaattcatcagctgtacaaagattaagcagttttactatatgttaacttaaattaattaattgattggctcaactcaagtgactgctttccttacctggatatgaggagggtaggcaggaagagagaatgagaaacgtgcacactg

SEQ ID NO: 231063 - DNA, 595 bp, Homo sapiens
aaaaaaaaaactgttctttacactctatttattaagaaagaaatagaggctcacattgtagaaagattgctacgtggtcaaactataaaaggggtttacctagttaacctgaaaagttcttgcccagaacatcctattcctaagcattctgactgtctgcatgctccatcaactctgtaagtaatgtataatatgaatagattccctgacaaaggaagctgctttgactccagcaaaaattagtaggtccaaggttatatatcatatgattccattcatatgaccttctggaaaaaaagtatgactacaaaggggcagcagagggagttttttggggtggtggaactattctgtatcctcattgtggtagtagttacaggaatcctcatcatgctaaaattcatcagctgtacaaagattaagcagttttactatatgttaacttaaattaattaattgattggctcaactcaagtgactgctttccttacctggataaagcaacccaaaggattagagtttggggagacagaaaagaagaatcagaaatatgaggagggtaggcaggaagagagaatgagaaacgtgcacactg

SEQ ID NO: 231064 - DNA, 521 bp, Homo sapiens
cctagatgggccagggagatggctgcctgggaagccgtcaggcgaggggagagaaagacgcacacgcagaaacgtggacggcagtcacaagaccgctagcagatgaggcaggatctcagcatctggtgagaggtaggcagggaacggcacaggcggccacacttcctctgagccaggcactttgcatgtatggccacatgctcattccagtgagacagcggttgctcaagccatatttgtcacttgatatgtggcattgggcaagttacttaatttttctgagcaccgatttcctcactgttgaaatggcgatgagaacgcaaaggatgtggcgtctgaggtggacggagcttagggctgcttgggccacagtgggcacagagctgggtgccaggaggccttcaggacatatttcctggccaagtgcattcccaaatggcattccttatcctcttccatgttctctcccagaggtggtgctgaatgacctgaggctgttccagaataaaggtatacacaca

SEQ ID NO: 231065 - DNA, 667 bp, Homo sapiens
  misc_feature (361)..(361): n is a, c, g, or t
aatgagctctctgggaaaagctcttagcatctacccactatccaaatacctgctcaggtgttctcctttcacaaggtcaatgtgaagtgatgcctataagttacatcaggagcatttaatgaagaagctatttgtaaagctggaacttttgagacccagctgagcctatcgtagagtatgcctgcagaggattacatagaaccaagagacaagagtgtttaaattggagcttggatacgaaagaactcactggtccggtcaaagctaaaagctgtatggttgctggtcattctctactggaattcaacaagccagggacagtatggaaacaaggactttacacaacagctcacggcttcantaagaaggaatctgaccctcaccctaaaaagctattgggagattactgatacctccaactcactgattcattgaggccatgccattcaatgctatgttctcaagaaatgtctatgagtcctctcaaccattgctgttgataaaataggtgaatgtcaagtgggggttagcatttgataaggtgtatgtttgaaataatattttatcgtctcttgttcacaaatacaacatataattccaagaagaaaaaagaagtagaaattcagcatccttaagatgccagcaagaatgaggggaaaaggaaaaa

SEQ ID NO: 231066 - DNA, 508 bp, Homo sapiens
agaggtgctgtaatttatctaccttaatagctgatggagaatgagattttagtctcaggcagtctcatttttcccaacccactctttgttttagttaattgatctttgacatttatttacttggtgtatactatctttatacctttgcattatggcatataccagtgatttctggaactaggtcattattagaatcaccttggaaactttggtaaactataaatttctggctcaacccttaaaatatactaattcactagctctgggatgtagcttgtattttaaacattaatgtaaaagctccaagtgattttgatgaagctagaattgagtatgacatctaaacacattataaaaaatgcttttctttccaccaacgataaaaatgggctgggcactgtggctcatgcttgtaatcccagcactttgggagaacaaggtaggaggatcgcttgagcccaggagctcgaaaccagccctagcagcatagtgagactttgtttctaaa

SEQ ID NO: 231067 - DNA, 172 bp, Homo sapiens
ccaaccccaggtggcatttctactgtgggctatagttgacagtaaatatctaagctgaccacagcccagtctgagaaatcatctacaggggagggcaggggactccatgggcacagatgaaatagccttgattctctttctctgggtgcatcaccagcctcctttcttactc

SEQ ID NO: 231068 - DNA, 454 bp, Homo sapiens
tgcattccagcccggtcgacaaagctagactctgtctcaaaaagaaaaaaaaagaacatgcatttgcttttgtctttcagcattagttttctaaggataatgggtcatagtttcatccatgttgctgcaaaaaacatgatcttgttcttttttatggccacacagtattccatgatatttatatactatatttttctttttatataaatattctactttattttcttcttattttattattattattttttgagatggagtttcactcttgttgcccaagctggagtgcaatggcatgatctctgctcaccgcaacctctgcctcctgggttcaagtgattctcttgcctcagcctcctgagtagctgggcttacaggcatgcgccactatgcctggctaattttgtatttttagtagagacagggtttctccatgttggccaggctggtctcg

SEQ ID NO: 231069 - DNA, 176 bp, Homo sapiens
ggagcctggcacagtggcctcatttattatgctgctctgctgctcacaggggaagcccgtcccccaaagtcctcttcctcatcctggtgagtatcttgtccctggattgcttgtcagccttgtctgcctggagcactcagtagccagcaggttccccgcctttcctggagtccgag

SEQ ID NO: 231070 - DNA, 419 bp, Homo sapiens
gaacccaggcacgctcattggttcacgtgtgacctctggcatccgctacaacagcagagctacataattgagacggatggtacagcctgcaaagttgaaatatttactctctgactctttgtaaaagaagtttgccaggccaggtgcggtggctctcatctgtaatcccagcactctgggaggccgaggtgggtggatcacctgaggtaaggagttcaagaccaccagggccaacatggtgaaaccatgtctctactgaaaatacaaaaattagccaggcgtggtggtgtgcttttggttctagctacttgggaggctgaggcaggagaatcgcttgaacccaggaggtggaggttgcagtgagccgagattgtgccactgcactccagactgggcgacagagtgaaactccatctcaa

SEQ ID NO: 231071 - DNA, 440 bp, Homo sapiens
tgagatggtgttttgctcttgttgaccaggctggagtgcaatggcgtgatactttattttattttattttattttttgagacggagttttgctcgttgaccaggttggagtgcaatggtgcgatctcggctcactccaacctccgcctcctgggttcaagagattctcctgcctcagcctcctgagtagctgggattacaggcacctgccaccacacccggataattttttgtatttttagtagcagtgggatttcaccatgttggccaggctggtttcaaactcctggcatcaggtagtccacccgcctcggcctcccaaagtgctggaattacaggagtgagccactgcgtccagccatatgtaatactttagtaaataaaaagtaaaagggattgattggcattttcagtctttttttttatggctagagatgagtt

SEQ ID NO: 231072 - DNA, 191 bp, Homo sapiens
gaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattca

SEQ ID NO: 231073 - DNA, 376 bp, Homo sapiens
ggtagggggaaaggggagggagagccttaggacaaatacctaatgcatgtagagcttaaaacctagatgacggggtgacaggtgcagcaaaccaccacagcacatgtatacctatgtaacaaacctgcactttcagcacatgtatcctagaacttaaagtaaaataaaataaaaataaaatgaaaaaaatgatatgatgtctaggatttgcttcaaaataatgtgggagagaaaagcaggtgggcatttggatgaagcaaaactggctgtgaggtggtactgttgaagctgataatgggcacatgagggttcattatattatcctttctactttctattaatttgaaatcgaccatagtaaaaagttaaaaaatac

SEQ ID NO: 231074 - DNA, 774 bp, Homo sapiens
gctccaaaagtatcctgagactcttagctctagaagaaaagttttgaacttgctgggtcccttttcatttatatagtgctttcacacaatgcactatcaggactcttagttgcaaatgaaaaaaacccagtctgactggttttaagccaaaagagggtttattgagtcaagtctagtggcaaatggcttcaggcaaggctggatccaggagctcaggtgatgtctgtgtctgtgtgtggatgtctctctctctctcctctgtgtcagcattattctcaggcagtccctcccatgttgtggcaaagatggccaggtggccctcagctgacatctgtcagcttagcagctctggcagaaacagagcatcctttccccctgtggtttcagcaagcgtcccagggctgactctcattggcccagcttgggtcatgtgactatgccttacttaaccagtcactgtggcactgattggccaggtcacggtcacatatctgctcctgaagcctaaaagtgggatcagtgccaccacactacatgaaacgagttggggagggatggtcccatgaaggaaaatcaaaaagctggtagtttaaaaaaaaaacagagagagggatgctggacaggcaccttttggggggctaatagaaattgttggctgggtgtagtggcctatgcctgtaatcccagctactcacgagtttgaggtggaagaatcagttgaactcaagaggttgaggctacagtgagacttgattgaaccactgcactgcaagc

SEQ ID NO: 231075 - DNA, 650 bp, Homo sapiens
agacatggaatcaacctaaatgtccatcagtggaagactgggtaaagaaatataccatggaatactacttagacataaaaaagaatgaagtcatgtctctcgcagcaacatggctggtaccggaggccattatgctaagcaaaataactcagaaacagaaagtcgaataccacgttctcccttataagtgggggctaaacaatgggcatacacggacatacaaagagtaatcagacactggggactccaaaaggtgggaggtggaggggatgagggctgaaaaattactcactgggtacaatattcactactcaggtgatgagtacactaaaagcccagacttcactactacacaatatacgcacctaagaaacctgcacctgtacccccaaaatatatataagtaaacatttttaaaatgcagattctgattcagtagttctgggcatggcttaaaactcttattttataacaagctttcaggagatgctaatactggtggtctgtagatcgcattctgggcgcaagggctgagaagccattctgagcttcttgtctatctctgggccatgaatgcacctagtgaacatttgggcaatggatgggttaccttatgtgtaagagaaggacagtattttccctcataatga

SEQ ID NO: 231076 - DNA, 527 bp, Homo sapiens
agtcttagtttgctgagttttaaaaattactatgaatggatgttgaattttattaatgtttttactgcatctattgagatgatcatatagtttttctttaatctgtcgacatggtgaattactagtttttcaaatatcgaaccatctttgcccgacccacttggtcatcatatttttttaatatattgctggattcaatttactaataaattgggtccatgttcttgagggcgattgatctgtgtgatctgtggttactttatattgtctttgtctagttctgatgttctggtaatgcttgtaacattgaggtgagaaatgtgtcttgtccaccccttcaaccccaaagacacacacattgtgtaaattagccaggcgtgttggcgcatgcctgtaatcccagctactcgggaagccgaggcaggagaatcacgtgaacccgggaggcagaggttgcggtgagccaaggttgcaccattgcactccagcctgggcaagaagaatgaaactcgatctaaaaaaaaaaa

SEQ ID NO: 231077 - DNA, 479 bp, Homo sapiens
atacaaagcatatatcattttccttgagtggcaaagttgaggaattaattaaaaacaaatagtagtttgataatttagtgtataaatatcaactgtcaattagaaaacaaaacacaaaacaatcactgcatacagtttcaggtaagacttatagtttgctatgcctttattctcattggtagaaagcattttaatgatttactcatggtcacagaggaagtgtatccaagttacaattaaatttcaaaatattgaactagcttatatagagccaattttatcttgaatttaaaaacagttgtatagaatagagtcacataaagtatcaaagattgccttggttgtatatggaagataaaagccaggttcttacacttaaaagaaatgttgatttatgttgaatttcaaaagaaatgattagattatccctgttgcctagttagcacaattgtctcagtgctctgaccttggtttgttaa

SEQ ID NO: 231078 - DNA, 382 bp, Homo sapiens
cattaaacaaaaacataaaacattcctaaaactagatgtccttttcctacattatgtccccaaagtactgatgaagagttttatatttaaaaaattatgcagtagaataaaatgtatgcattttaaaaaatctgactgctaaacagagaaggcttatttacgttgggaattacattaaggaaaagtggtgacaatgattgacagatttaactacatagctcattacaaacagattaataagaaataaatgtcgaaaaattgttacttatacaaaatttgtagaccacagttgcttaatatataaagaagtatttgataatcaattaaaaaggtaaacatgacaaaaaatagatccagggaagaataaatatacatgaatcga

SEQ ID NO: 231079 - DNA, 313 bp, Homo sapiens
ttttttaaaaaagctcatcagctatcattgctgttagtgtattttatgtgtgatctagtgtctagatcatgggtgttcaatcttttggcttacctggaacatggtagatactcatgtttaatgaaacaatgaacacaaattatcaatctgctattgtattacatactacatatctgctcactgcagaagtgattctgtaagttttaaatatgacctaaacaatattttgacatttaatccttgccaagtcctgacagtagccaagttatattttccataccgtaaagcaaaacagatcttgcctttgaaaatg

SEQ ID NO: 231080 - DNA, 409 bp, Homo sapiens
agaagacacagagcagccagaggcccaagagagtcctttctggcctttgcaaagaatgtctgcacctccctccactcagaggcctggagggtttggatgaggggagatggcacgcttggcctgggtggtgggcttcttgtgatgagctgtcactgtgaagagacttgctgtgctgaaggcagtgtggatggcagggagaagaagaggaagaacagagcaaatgtgcacggtagcaagctggttggaagcacttgtgaagcaccgctgggggctcccaggggtaaactggggctctctgcttaggtcccaccactagacagatggaagctaccatgtcattagacattgatttacaggtatttgtgttcacatctgtattcattggaatataaagttggcttctttaaca

SEQ ID NO: 231081 - DNA, 328 bp, Homo sapiens
tgggtgttgataaatgggtattaaaagaatgagagcaatgagcagatagaagaggaaattaggagagtataataccatggagaccaagaaagatagactatcaggaaggagtggtaaaaataagttactagttctaagagagatgttaagagggaccggggaaagccttgtacaaatgagttagtagcattttacattatatacatctaattaagaaacaatgcgagagtctcaccattcctatagactcttacttgtacttgtctgaacacgaaaactggcttttgtttataaataagctaaaaattattttgctccaatttctcat

SEQ ID NO: 231082 - DNA, 500 bp, Homo sapiens
tgaggaaggagattccataccctgtctggaatgctctccttccacttctgtctgacagatactcactccccattccctgttctgcatccagctgtggcatatttgagaagccttctttcattgctatcctgcatcttccttgttcctggggtagcacacagcctctctttcatagaacatcacacaagacagctgctgggatggctgacttgtgtatctgtctctcccaccagactgtgggttctctcaacagggtgaacatgaaaaatagaagcctccagtttctcctgatagtgtatagatgggcagatctggcctcaatggcagaagatacttggggaactggagaaagtacagaaggtgatgtgaaatcaattgggtcatcaaaagaagacgggtgtaccacaatttgttcctccacctgctgcccatgaacatttggagggtttctagtttttggctattacaaataaagttgtcatgaacatttgcatacaaat

SEQ ID NO: 231083 - DNA, 470 bp, Homo sapiens
aactcatgtggttgatcctgtctaaccttcatgatgacctcatgatgtactgttatctctcttctaaggtgagaaaacaggctcagagaagtccattcacttgtccaagatcagacagctagaaaatgacagagccagggttccctcttcagcccaggcgatgtcttggacagcagaaggaacaggaatagggctgggaggctggagatccacatctcggtcccagttctaacactgccttaccctgggcctcagcaagtagcatccctcttcaggatacaaagagatagtatgtctgtcaggttgcagacggctgagggtgtggacttgggagctaggctccttggattctaatccttgggcaagctacttcaccatctgagcctcagtgtcctcatctgtaaaatggagatgacaacagtgtctccctcataggcttgtgaagataaaacgagtaacaagacttagaa

SEQ ID NO: 231084 - DNA, 251 bp, Homo sapiens
atcatttgagctcaggaatttgagaccatcctgggcaacatagtgagacctcatctctacctaaaaaaaaaaaaaaaaaaaaaaaaaaaaaaggtagtatgcaggaggctgaggtggatggatcccttgagcctgggagatctaggcagcagtgagcagtggttgtgccactgccatgagcagtgattgtgccactgtacttagccggtacaacagagcaagaccctgtttcaaaacaaaacaaaacaaat

SEQ ID NO: 231085 - DNA, 485 bp, Homo sapiens
gtgggtggatcacctgatgaggttgggagttcgagaccagcctgaccaacatggagaaaccccgtctctactaaaaatacaaaattagccgggcgtgctggcgcatgcctgtaaccccagctactcgagaggctgaggcaggagaatcgcttgaacccgggaggcggaggttgcagtgagccgagaccgcgccattgcactccaacctgggaaacaagagcgaaagtccgtctccaaaacaaaacaaaacacaaaatgagcactgatccgggggcgcccgtttcctcgacctcaggctgtggcgcctgccagtccccaacatcccgacagcccgacggcgtctccgcgttcctcctcctctcccggtaccagggtctctccccagaaacaaactcgcattcgtaaccggcatcttggccttgcgctgggggtgacccgcccaagccgccatgaagggacgctcgcacaaagtgaagcccaggtac

SEQ ID NO: 231086 - DNA, 349 bp, Homo sapiens
ggtcagacatctggcaaacaatccttgccatagggaaatagacatcaatgcaatatcaggaaataggtacttagaaatggatttaaacaatttcttgggacaagcatccctctgaaatcaccagaatcagagcccaggcaacaagaattacttttatctttggatcccgtctgtttatccagtgccatagttgggcactgtgctaggtattttgaatgtgttatctctactatacacaacaactctacatgagggatattcttattctcttttcacagatggagaatctgaggataagagaggttaaaatccaacatcacacaactggtaaatggtaaagttaggcttc

SEQ ID NO: 231087 - DNA, 316 bp, Homo sapiens
gaaaataggaagagcaagttggaaagttggcactaagagtttcagtttaagatattttaagtttgtgatgattattatctgtccagtttgagatgttgcgtaggcagttgaatacgtacacctggaacttggagcgattacagcctggtttatgtttggctgtctgtatgattggaatttacattcatggatctggatgtgaccaactagggaaggcaggcaggcccgagaactgactcatgggtcactccaccctgtagacctttgaaagagggaaagagggacaacaaaagagataaagaaggagcagccacta

SEQ ID NO: 231088 - DNA, 444 bp, Homo sapiens
gcctggcctcctgggttctttgctgaaattatagttgaatggctttctcacattggccaagcatgaggcctcttgccaaagatcagctgtccccctaaagccacagggatggggtatcttcagcaagagagagggcgttaaagatgtaaaatgctttgtccatggggaagtgcacagatatgtgggagaaccttacaaggctctaaaatgagatgtgatatggcttgaaatgggaggagacactttctgacagtggggggtctggaatggaattggtggggacaggcagcaagctgcacttttgaggggcctcatttaccccacctctgttaaaaacttgactactctcctctttaatagaaagtcaccatcatctgtagtgatggaggaagggggtcacttatataaagatgggacactttaataaagacaggatatcttcca

SEQ ID NO: 231089 - DNA, 466 bp, Homo sapiens
atcttaaactcccagcttcaagtgatcgtcttgcctcattctcccaaagtgttaggattacaggcatgagccaccatgcccaaccaatgtcaacattttaatgtatatattatttacaggaaattatgtaaataaataatggattggattctagaactcagggtcacaaaatttttagaggataagaaatacttctggtttagattatctaatcccttatttaatattacaattatctgaaaatagtaagtgatttggggaaaaatgctcatacaaaatattatgaatggacataaaatattatgaatggactccaggattatggtgtagaccagttcagtacctttcaagaacaccataatatcagctattatttaaaatgttaattcatactgtaggcttcttacagtgaattgaggttatttaatatacgttctttaactgtgaatagtaaggcacacccact

SEQ ID NO: 231090 - DNA, 782 bp, Homo sapiens
atcttggaagcagccaccaccatcttgggagctctgggagcaaggacccctgtaacacattcatccttgaatgacaaaatgtctggtccagcatggtattataacataaacatgaagaggaagagacatgagagatacgcacagtgaagagaccaagcggggacacagtacgaaggtggcatctgcacgccaagcagagggacctcagaagaaactgagccagccagcaccccaccttcgtctttgacctccagcctccagaactaaggatagagctcttcatctctgttagaaacgaccatcaaaaagatacatcaattcattagaatcaaaaggacatgagttatcagaattctttctcctgaaagaaagtggagatcaaaggtaaaacttctagagaatgagatgaaggcagatgaaagaagttaacaagacattacatgacttgataatattgcatgtatgcaaaaaccttatgaaatcaactgtgttctagcgaccacttgtttttctttttgtcataatactttttattctcttgcaatgatattgattcatctgcacctgacatcaactctgcatttgtagaaggtgataagaatacagggaaatggaataagtggctttgcctgcaatcccgcagcagcagaaatgtccatttcctctctcctgaataatactacattctccactgggttccacaagtttcgaggtaaaagcatgaacatacacgaagtcaccatcactaccctcaccaccaccaccattatttccaccatatt

SEQ ID NO: 231091 - DNA, 481 bp, Homo sapiens
atcttggaagcagccaccaccatcttgggagctctgggagcaaggacccctgtaacacattcatccttgaatgacaaaatgtctggtccagcatggtattataacataaacatgaagaggaagagacatgagagatacgcacagtgaagagaccaagcggggacacagtacgaaggtggcatctgcacgccaagcagagggacctcagaagaaactgagccagccagcaccccaccttcgtctttgacctccagcctccagaactatgagatatacctttctgttgtttaatccatccaggctgtgtcattttgttattgcagcctgagagaccattacagaatgtgtagttggatcacttacaaggatagaggatctgggtatcgtacagtttacagaatgtatggaccgctgtgttcctattgataatatgtattaattatcaaatactcatgtgtatggcagaatttgtcctgaggct

SEQ ID NO: 231092 - DNA, 536 bp, Homo sapiens
gctccttcccctgccaggccggggtaggacattcttcctgttactgctctaagagctcatgggagctcttccgtgctccttgcccacggactgagtgtggacagttggagacagggcacggaattttcatggggggtgatgtggaattggggatacagggtctgatggaaccctgtgagactggatagcaaatgcagtctgaggaagccagaccctcgtgggagccagcagtggactgatggcttcagtgggtgattcagagagggtaagggctggcccctccatggatgtggttttggggatgccatgtgtctacagggttatcctcatctgcacaagaagcagtgtggtcagtggaaaaatggcctccaaaagataggcatgtcctcatctctggatcgtgtgcatgttacctgatagtgcaaaaaaggttggggtggatctttgcagatgtgatcaaggaattcaggatgggtggattatcccggattacatgggtgggctatgtattagtccattctctcactgctattaga

SEQ ID NO: 231093 - DNA, 417 bp, Homo sapiens
tgataacttcatgcacagttttaccagagattacttaatttatgtattattatttcatggccattatgctgtcctgacttaatggttgataaatgtagcttataaatcagacaacactttgcaaacatagaagttgtttcgttaatgtagatatattacaacaagaaggtactctcccttgcccctactttttattaaaagtcatatggtaatgaacagtcaaatcatttgtctttttaatttgtttggaggaacttgaaaaataagaatctgaagtttaaaaagaatttatggcttgtaacactatatcctgtccaggaatttaacaccttacaatatcatgtagcattatcattacattcttaaattccttgttcaccagtccagctacattttaagagtttttgctttcactta

SEQ ID NO: 231094 - DNA, 415 bp, Homo sapiens
agagtaccgggggctagggtcagaccttatgggtcctgaggggataaggtgagagtggggcacaggtggcccagacagcccactccctccagccagatctcactcattagacacccaacctaggttcaaatcccctctcaggcacttactggctgagtgaccctgagaaaattgcttaacctttctggacctcggtttcctcatctgcaaaatggacactataataatagccacctcaggatatgattcagtgaattaatgaagcaatgtgtttagcccaggacctaactagagttagccttcagtatatgtaagctattgttaccaattaagttatttttataggttttaaatattgggtctgtggataaatttcatttggaggagaaaagtttgctactaaaacaaacaaaca

SEQ ID NO: 231095 - DNA, 455 bp, Homo sapiens
ggaatctggtgaaacaaagcaacagaaaaaaatgaattcaattcttccatactctgaatccatatgttttcatttactgcctccaccactaaagatgtatgcctgcacacatctgtacaaagacaagcaaccatcatcagggtagttaacacactgattgggagaggttatttatcttctgtaatttcaaaacgtgatttctgaagagcatatcatgcccaattcagagaactgaactatgtactttgactaaatttccaagaacttgcagaaaaagatgaattatgcatattatcttttgtcctcctcttttggcaaataattcttccatttttcaactcccaagtgtagaaaactaatgtacaaattccactgctgtgaaacaatttaccagaagtcttcatcttttcactgttttctattgagaaagaaactatattttagacaatcttaaa

SEQ ID NO: 231096 - DNA, 356 bp, Homo sapiens
ctggaaaagggaaattattgatctaagttggggtttttttgttgttaaaaaggaaagggaaaggagaagatataatctgtttctgcttgcttcttagtctttacaagtgttaaatttttttttttttttaacatttcactagggcagtttatattcacacctctttttgaacatgggtaagagacgaaacaaaaagtgatgtcagtaggatcaagctattaatcatactaagataatataaaatgttacaaatgttgctgaaggatcagaagatgacaataaaaataattaggctaatatttttactgaagaagtgaaaaacgtgtctgataaagctgacagctttgcaaagaaaa

SEQ ID NO: 231097 - DNA, 453 bp, Homo sapiens
gcctgacttggatccactgtctcagatataagaggagcgggtccttctacagggaagagaccacagttctccaggaagccacgatatttcctcggggtgcattgtacgaccctccaacggttgctatggcaggaaaaaacttgagctctggaaaccgtggctgaccccaggcaacagggaccagttcctccttgtgtggttaccaggacacccccaacaccaggtcctaaccccggatttgtagccccacagccagctttgagattctgtgaatccgtgactcttggatccggcatctaagggacaccaatccatgagggatttggtagtgaaaggcccaagggtccttaaccgactgtggttctttggattcccttacgtgtgtttgtatttgtgaagttcctgtgcatttgctattctgtctcccggtttaaatttattgccagttatcaa

SEQ ID NO: 231098 - DNA, 224 bp, Homo sapiens
aaaggcggggcccaaataggactcacacacacacaaatacacacacacacacacggtctgtgaggtcttgatcctcagaaacgaagtacaggctgggtatggtggcgtgcacctgtagtagcaggtacttgagaggctgagatgggaggatcacatgatcccagggaggtagagactgcaatgctgcactccagcctgaacaacagaataagaccctttcttta

SEQ ID NO: 231099 - DNA, 529 bp, Homo sapiens
gtttttgagtttcagtggaagactctgacgtttcaaataccaaggctctttacgttgttgggacccaatttgttctcctctacggtcactaaaaatataatggctctacaattaactacaaggaagtatgttgcaaggtagtccaagtgcacacactgcaaggcagagatacaaacatcacatccagcaagcaaataagagtgtatctgtgcctgaaacaaggatactaaggtcatccacaacagtggtgtctaatggggtaagctaatatgaaagagtgaagcagcatcaacagtgagtaaaacagagtgactgcaacatgttcttcatttttgtcactgctttttaatacattacttcagatttcaatgtaaagttttgaataaaaggaatcattatatacatgttttatttgtttttgaaacagatgttctctctttttgaagaataaatcacattttatttccctccagctttattgaaatataattgacaaacaaaattaaataaatctaaagtgtgtaatata

SEQ ID NO: 231100 - DNA, 448 bp, Homo sapiens
gatcctgccatgtggtgtccacttcttaatttagtgatccaagcatttaggttctgcccatggttgcattcttagttcatctgagcctcctcaagttacatgaccttcaacctgggggtccatggcaactaaaaaacaactcacagcttcgctatataaatggtgaaccataaagttgaaccagctaattaacacaggaacagaaaaccaaacactgcatattcttattagtgggagctaaacattgaatacacatggacacaaagatggaacaatagacaccaaagcctactggagggaggagggtgaggattgaaaaactacctatcaggtgctatgcttattacctaggtaatgaaataatctgtacaccaatcccctccttgacacacaacttacccacataacaaacctgcacatctaccccctgaacctaaaataaaaattg

SEQ ID NO: 231101 - DNA, 479 bp, Homo sapiens
tgatgaagaatttattttagtgttttgactgagccaaaataaaatcagtttcattgttgaagaaacacagtttaacataaacttgtagatagactattaaagagtgctgtatcagttaagtgagcactgtcttctaaaatttcatgtattcaaggatggagagggtcaaatgaatagttaaaaatacaaattaaggccaggcatggtggctcatgcctgtaatcccagccagcactttgggagtctgaggcaggcggatcacttgagctcaggagtttgacaccagtctgggcaacatgacaaaacactgtctctaccaaaaatacaaaaattaacctggcctggtggcgtgtgcctgtggtcccagctacttgggaggctgaggtgggaggattgctggagcccccgaggcggaggttgcagtgagccgagatcgcacctctgcattccagcctggttgacagagtgagaccccatct

SEQ ID NO: 231102 - DNA, 528 bp, Homo sapiens
aaaggaaacatggagcaatgagaaatccatagaggttttgaaaagctctgaaagtattcctggaaaaatagaggaccatgcacatacatagagcatgaacatgttcaggaaagacctaaaaagaccctaaggtctcacttctggctgatcttgagaatatgtgtgacagcaagtgaaggctaaggcagagttgttaattacctggctgagtgttgaaggcatacccctacaagtaaacagtggctctcagcaacacttagagatatattgactccatctatttaaatatgtctatgtccagtagttagctaaccactaaagacttcggtgatcaaacacaacaatgaatacagactgttcagaattagttcagaaaagtcactaaactaaacaaacaaaaaaaacaaacccagcaactacaataagcagcaattgcagaccctggggacagaagagggcaaagagagaatctgatatctactattgctacattatattatttaaacatcaagttttaaaaaaataaga

SEQ ID NO: 231103 - DNA, 422 bp, Homo sapiens
tagatgtccatctcctgataaatggatcatatctgataatctatgtaaaggaatattattcagctataaaaagggatgaagtaccgatacatgttacaatatggatgaaccttgaaaacatgctaaaggaagccagtcacaaaagtcacctattgtatgtttccatgtatatgaaatgtctagaatagaaaaatccagagacggaaagcacattagtggctgccagggacttgggggtgggggaagagggaatgactgccagtgggtaaggctttttggtgggggtaaaaatatcttcaaatcgattgtggtgatggttatacaactctgtgaatatattaaaaaaatggtacagtttaaatggatgaattatatgatacaatatggtatgtaattctatctcaataaagctgtttaaaaat

SEQ ID NO: 231104 - DNA, 440 bp, Homo sapiens
ccaatcaatcttatgacataagtttgccttctagtggagtcttagaacatgcttactggagatttccgttgtattgtatcatgaactgttacatttattcagataaaataatatattgttcttctgggcttacacttcaggttgatgaacttagtctgttactgagatgaaattccattcttgccgtggcaacaaaaataaaaacttagaagtctaagggttaggctcagctatgacaaactcatatggtaattccatattttgaagtcttttggctgacagcacagagtgccattaatcactctttccatcttatgtttatacattgtgaaggaggagactcatgttgaaaagagaatactaagctgaatgagctttaggtttaaaatgaatgacattctgatgttcttaaatgttaaaaagtaaatgacatggattaa

SEQ ID NO: 231105 - DNA, 497 bp, Homo sapiens
ccctcgaggcataaccccttactccagaaccttccatctcccacactgcttcccccaaggggagtgctaaaaagaccattgtctctccaacttgtgactgttttcagtgatgttgcagacattcagctggcccaccctggctaacagaaacctcggtggtttcttcccaagagcaatggcctcagtgctccggtgtccttgtagagggtggctctgtgcttgcttgccctctgaccactgtagaggatggctctgtgcttgcttgccctctgcccactactcctggctctccggggccccccaacgcatctgtcagataggccatgacatagaaggactgcgtgctctatgggtctttataagcttaattccggcttcctaccctaatgctgttttcaaatccccttggtcatctctcccagccttacagtgctgttaatgatgcccgataggattgtgaaggatttccacctgtccttaaacttcaccctctgctt

SEQ ID NO: 231106 - DNA, 182 bp, Homo sapiens
tagccaggataaattacaatttggccatacatctcaaaaagtaagagtcaatgagaatgatctgttttcttattggaatgtccacattaaaagcttaatagtattggtgggttgtgtatgtgtgggtatatgtaaacagaatcagttatgaggtaaacaaacaggtagtttttttttggggg

SEQ ID NO: 231107 - DNA, 380 bp, Homo sapiens
caggcagaccacctgaggtcaggagttcgagactagcctggccaacatggtgaaaccccgtctctactgaaaatacaaaaaattatctgggtgtgatggtgcgcacctatagtcccagctacttgggaggttgaggcatcagaatcgcttaaacccgggaggtagaggttgcagtgagccgagatcgtgccactgcactccagcctggatgacagagtgagactccatcaaataaataaataaataaataaataaataaataaatacagttcaaggtcctgctcccaccccgattctaccctggggactcattccttccctctctcgccctttcatttgagaaaccttcacttctaaatgaagttcagctgcttatgcca

SEQ ID NO: 231108 - DNA, 189 bp, Homo sapiens
aaacaaccattaaatagctgccactgatgtctacttcccatttcttctagtctatgccacacttgttgggaaagtttactcactcactgctccaacttccttcctgttcactgttgaagccgctctcatcaggcttggttgccgtcctctacttaggctctctctccatggtctcctgtaacctctgca

SEQ ID NO: 231109 - DNA, 313 bp, Homo sapiens
gactctgcccccccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaagttactacttccaaatgtgatttgctttctagtgctgtaattggaaaaaaaaaatactccttttttgaatgctggatatgatcatattaaaaaatgttagtcccaaca

SEQ ID NO: 231110 - DNA, 259 bp, Homo sapiens
ctctaaatagcaccgagtttgaggcaggaaaatttcctggttgtctccccctgaggaacaggtttttatctagtttatcctttcactgaaattatagtccttcgtatctctggctttcaggagttttctcctgtaagactgttatactgggcaggcactaggttttgtctcacactttcccatattccaggtggtcataaaaattgaagctcagggtactagggccaggactgtccttatggaagcctctggtttgggg

SEQ ID NO: 231111 - DNA, 193 bp, Homo sapiens
cattgccatctaaacaagacactcagctagtgaggaaatatgtgatctatatgatgtctccataatttcacctacttacaatgaggccaccttttaaaaaatctgaatttttgaagcctgttttgtttgttaaactttctacataagaaaattaatgttgacttggtggaatagggtggagtttttcaatgat

SEQ ID NO: 231112 - DNA, 496 bp, Homo sapiens
tgttataatacgtgagaatcaaacctcactttttttttaatctattttttcttatactagaaatacgtgtgtgtgtgtgtgtgtgtgtatgtgtgtgtctttaatctgaagtatagcaattatgggtagcatataaatgaaaattttaaatattcttcctgagacttcctagcggtactttctagaaatagctactattgatgtttcttctgaattcttccaggcgtttctctgcatagccagtcagtcgtgtaccatgtgcacatgtccctgatttacttattagtgaaaatgattcttctggtttttaagtgactgtatagtattccattatatgaaaagtccctctctggatcaattcagatggtacaaatgctcttgatgggcattttatttgttgccaggtgtttgctattagaaactgttctagtgatcattccatgtatatctttggataaatttttctaaatataattgccatactgacttttgtgtt

SEQ ID NO: 231113 - DNA, 471 bp, Homo sapiens
agtagagacacagaagatatgttattaaacttctagagatgaagttatgttattaaacaacatgtgagatgaaaagtgcactggttaggataaaccacagattcgatgctgcgggaagaaatgatttatgaccttggaggcagcatagaatctatccaaaaacgcagagaacatagactggaaaagagggtgtggtgacagagcatcagtgagttgtgataaaactttgggcagactaatacctacatagttagaatcttaggtaaaaaggtaggggagggaagaggggcagaaaataagattatttagcccatttaaaattatcacctcaaggtagatggtgacaagttaaaggtgtgcactataaatccaaaaacactactaaaaataattacagttaagaacccatcaaaggagaagaaaatgtaatcataaaaaatatccaattaatccaaatgaaggtagaaatac

SEQ ID NO: 231114 - DNA, 269 bp, Homo sapiens
actgaccccaaggggcatgcttttctgctacaaatgcaagaagcctagagctaagagtcaggagttattttgaagtttaaaggagaggatatctgccaaagctttgtccatgggaaagtttgccatataacagacactacgaggcagttggctaagggcaaagtgaggaggtcaaaccgtaggtgccaccggagttaaaagatccataaaagagagccctaatgtcagaggaagcctcttagaggaaatggatcttcaactggaccttg

SEQ ID NO: 231115 - DNA, 348 bp, Homo sapiens
tgtattagcttttaaaatagattctaattttaaaggtaacatagtgagaccccatcactacaaaaaaaaaaattaattttttttttaagttacctggccaggcatagtggttcatgcttgtaatcccaacaagacaggcagatcacttgaggccaggagtttaagaccagcctggccaacatggcaaaactccatctctactaaaaatacaaaaagactagccaggtgtggtggcaggcacctgtaatcccagctacttgggaggctgagtcacgagaatcatttgaatccaggaggtggaggttgcagtgagccgagatcacaccactctactccagcctgggtgac

SEQ ID NO: 231116 - DNA, 486 bp, Homo sapiens
aataccttgtctgtgacaagggaacttcttcaggttctccctaaactgcaaattcttcagctaacaaaataaacttaatgccctgcagtcctcactgtggcagagccatactgtgtttcataccacatctgccgtgtcactatcctggggccctcagaagacgtgcttgccctcaagcctaacaaagtattccacaaaaatgcctccttttaccagcacctgctcattttttaggactcaaaaaatgcatagcaactggggaacaaacactgttctgtttgctgcaccctctgtttttgacactccaggcccagcagagcacatttatctctgcctattaatgtgagcaaacagattcctttactggccccaccaatttaatcagatatactgtcaaacctaggctcaagcagagatccctatgatatgtttgttttagcttttttttttctttacagcgggaggaaacttaaatagctttcagta

SEQ ID NO: 231117 - DNA, 951 bp, Homo sapiens
ttccagccaacgacaaacaaaggcaagctcaatgtccccacatgggaaaacaatgaaatatttttatggaccacacaatggaattatattatgctcgtttactgattatgtggggaaatgctgatacaataatgttacatttaaaacagattacaggattgcacatagaatatgctcagctacttttgtaaaggcataggaaaaaaagactggcaggaaaccttccaaaatattaacagtgttacccatgaacactttcctcttctcctccttttctatgccttccatgtacttatgtatgctcctgtaatgcttttaaagggaaaattaaaattataaaaatccagaggtgggtggacagtcccacagaggtggtcaagactctgtgctaagagtgtcagtgcaagggttaaacatgtgaccccggaaagaaaactatttagcaaggcaactcccacagtgggagactacagtggactaggacagggtaggctcctgaaaagaatggaagcagtgaaggttcagaaatgaagttggttgaaaatcatttcctgagcacccactaatgttacacaccaagaagttacccatttccagagaaaagaaagaaaaagactttcaagagcataagaagtgagcctttggaatgtaaatctaccataattctcaactcctggaggtcttacagatgaggaacacgaggtgagagtgaagaatgcatgaagtgtctcggtctgagccctaacacaacacgactattcactgtccccagtcccttatgtgaaacccttaggaccagatgtgtttcaggagtcagaatttttcccatttcagaaaggtgacctggtgtaaatattttacataacgtatcatccccagtagggtttggagtggtgccctcaaatacactgttatttttgttgttgttttgttttgttttgagacggagtc

SEQ ID NO: 231118 - DNA, 766 bp, Homo sapiens
tgttcagaggatcccctctccacactggcaggaaaccttccaaaatattaacagtgttacccatgaacactttcctcttctcctccttttctatgccttccatgtacttatgtatgctcctgtaatgcttttaaagggaaaattaaaattataaaaatccagaggtgggtggacagtcccacagaggtggtcaagactctgtgctaagagtgtcagtgcaagggttaaacatgtgaccccggaaagaaaactatttagcaaggcaactcccacagtgggagactacagtggactaggacagggtaggctcctgaaaagaatggaagcagtgaaggttcagaaatgaagttggttgaaaatcatttcctgagcacccactaatgttacacaccaagaagttacccatttccagagaaaagaaagaaaaagactttcaagagcataagaagtgagcctttggaatgtaaatctaccataattctcaactcctggaggtcttacagatgaggaacacgaggtgagagtgaagaatgcatgaagtgtctcggtctgagccctaacacaacacgactattcactgtccccagtcccttatgtgaaacccttaggaccagatgtgtttcaggagtcagaatttttcccatttcagaaaggtgacctggtgtaaatattttacataacgtatcatccccagtagggtttggagtggtgccctcaaatacactgttatttttgttgttgttttgttttgttttgagacggagtc

SEQ ID NO: 231119 - DNA, 352 bp, Homo sapiens
aaaagatacacatagaacagtgtggccattggaaatgggcccggaacagtggtcatgctgccattactctcttccaaaaagatgttaaatctctaatttcacatttttttttcctttgagatttcacttaagcctgatactctcttcatagatcagagaatcagattcttactcattttataactttagacataaaacctagattaggattcaagaaactgatttaccaaacaatttgttttatggattttgtttaatggctaaactaacatggaattcctcctttgttccagaaaagtaaattcattttaaggtgaatattttttcatcctgtatttaatattacttgaat

SEQ ID NO: 231120 - DNA, 433 bp, Homo sapiens
cacatggcattcaaggctctgcaaggttcctgtggatggtgattagaggatcgtggagaaagtactataaaatgaggtttgcttgccatccatttttacttaattttttagctttctcttttcctgttcttgtgtatccttttgtcttcatcattatattttatctttatttttcaatagcttaaatattgaataactaaagtaacatcagcacatttcatcatcctcccaagtcttggatgtaaactctgaatcataatttgggaaacatggaaagttggaaaagagttcaaggagattcatattcttaaagagcgtgaaaatgacattttaaaaatttaaataattcatactttgaggaggaacaacttaaaagtgtccagtacctattgagtgggaatacagagtgaattattaaaggagaattaaaata

SEQ ID NO: 231121 - DNA, 405 bp, Homo sapiens
tggacaccctgatttcagcctggtgaccctgatctcggatgtgtggcctgcagagctgtgagaggatggctgggcgttgttgtgacccagccagcttgtggccactcgttacagcagctgcaggaaactgatgcagcgccacagacggagccagggctcagctcactggagttgctttctgttattctatttcttcctaaaacattgtgttaagccaaccactaacaaccactgactccgatgggcaggaatcgcagaggtttcttggtttgtttctttaatcccttttccaattttgaaataatattccttgttggtttttctgattataaatgtaatatctttctttgtattgagtttagaaacaagagaaaaagtaaaaagcagaaaccccagctgggcaag

SEQ ID NO: 231122 - DNA, 175 bp, Homo sapiens
aaccactgcattctttttatctcctggtattttctttgcggtaagaaaagcattattagttattttctttaaggaacatgaacaaatgagacttagactgcagagtatttgcctctgtgttaaaatactcactattaaactgtctctattttcagtacaatgtaaatagttactg

SEQ ID NO: 231123 - DNA, 370 bp, Homo sapiens
ctgatagtctttgaagaagttaaattcagattttatgcttgcaacactatgttttttgaaaggatgtgacaatctattttaataccacatttacatatagaaatcatctttgacattgctagactgattaatttcagtgctaaattaactttacaaccataacaattacactgttagtaactaattcttattcttctaaattgagccccttagatttctataactaatagagcttttaaacatatacattaaggccgggcgcggtggctcacgcctgtaatcccagcactttgggaggccgaggcaggtggatcacgaggtcaggagatggagactatcctggctaacacagtgaaaacccgtctctact

SEQ ID NO: 231124 - DNA, 409 bp, Homo sapiens
cagggtcagtcagcaccattgtaattcagagaatgacagaatgaggcttctactgagaatgcattttggtttgacaagaaaagtgagcccctgcaggccaccgtagtccaggaggcagggaggctcaggcaagtccttgggaagtggaggtaactatggtgcaggtgaaggatgttcctggcaggctctccacggagaggtgcatgtgaggagccacgcagccagagcagcggggccaggctgaagctctgcctttgcctgtgtgggtaggagaggctttatcccatgattaggacgtggaagctacttcggaggctgaggcaggaggatggcttgagcctgggaggttgaggctgcagtgagctatcactgtgccactgcactccagcctgagccagaccctgtctca

SEQ ID NO: 231125 - DNA, 672 bp, Homo sapiens
gagaagaagcaaagacaagagttccagaacgtagaagctggggtatcaaagggctggcccagatacaaagacaggaagacactgacctaggtccagataaccaatgtgctcagttataactgcaaatgcaaatttcacatattttataacagatgcatacaacagatgcatattctacatcctaattgaatggcagtgataatattctaatactttactgcatgctagtgtgagaggccgctaaccacacgtggctcttgagtgcttgaaatgtggctcatgccagttgtggaaatggtaacattctggatgtaccgggttaaataagatctattgttaaattaattgcacctgttccttctgccatctttaaatgtggctgttataatatttaggattgtatgtgcggttctgtttctactggaatatgctgtatgttgttttcaatcaaacaagaaagactgagaagcgggtgggggtggaaccgtgggctgatgttgaggagagcaagattaattctgttttaaatagaaattctcgaattgcggttccattcctcactttaatagttaaaaaataagcataaaggtaaacttaaaagctatttattggtacaattaaaaacagaatgtatatttttcaaaacagcaaataaaagtagaagagaaaaaa

SEQ ID NO: 231126 - DNA, 517 bp, Homo sapiens
cagttggatcctgaaaggtgaatagaaggtcaccaaaagaagggaagataaattaagtatttgtttgttgtttatctttgttactagactgactataagttccgtgtgggtagggactggatcttgctcaatgttgcatttttggtggtcagtgcttgaaaacacctcaagtgttctaaactatctgttgactaaccaactgaacagtatttcaggcaaagagaaccatatgcacaataacaaaataaataacagaatgatttttctaggctatggcttgtaatatcaacactgttcactcctggagaggaagagtatatcataagacagctaaaaagggcaggtattatagaaggaaccagaagatttgcattctagtcccatccctgttattaactaactacatgactttgaataaatgcttagcttataccacctgtagttttctcacttgtaaaatagctttggaagagtatattcttgtaagaaaaaaaattaaagaaagatcaagaatgta

SEQ ID NO: 231127 - DNA, 170 bp, Homo sapiens
ctaaaggatctggaaaggaatccttctctgcctcttccagctcctggtagctgtcagcattccttggcttctgtctgcatctctctctgctccatcttcacatcagcttctcttctctgtgtcttgtcttctcctcttctatctcaaatttcctcctgtctctctcttga

SEQ ID NO: 231128 - DNA, 361 bp, Homo sapiens
ctggaggcccacacacagttgggaaggcaggtaggggggaaggagtggacggaccctcttccgatattactttatcaccacatttttctcattgaccttggcatatttgctttaataagtctctgcatctatctgttcttactctccttcaaaagacaaaactagctaagtctaaatttatattaggataatatttactaagaatttccaatttggagaaaagaggtgactcaaatttgaaacaatacttaaataagaacaagtgactataataataatttttttaggatttatgtcactttgaataatctactttaggagaaaacaatgaaaaagttagggtcagaaattaatttgtatg

SEQ ID NO: 231129 - DNA, 253 bp, Homo sapiens
caaaacatttagaatcaatttagccagtaccctctaattacattttagatttttaaaaacacaaataaataagctaaaaacacacaagcaaacaaacaaccaaaccaaaccaaaccaacaaaacaacacaaatgtcccaaataaagaaataatagccaaagtcacagatgaaagctaatgctgtcataaaacattaagacttccccacttgggtttgggtcctagttcttcctgaggtcttaatgtctgtaac

SEQ ID NO: 231130 - DNA, 738 bp, Homo sapiens
gttaaactctgataagaacattaccaagataatgttttgtcctttccattactcatatcaggagacaagtaatatgagatgtatgcattattggagctgtaaagtttaattatttggttaggatgttgtctgttgggtacccttttcattttctaatatataagttgtctatggggtgattcaaatggtaaatatcctactgcttaaaaacttcacccggtggtttcagcattcattgatttttgctgtaatcacctatttcattgatgtttaaaaattgtggtatttttctcattctgtttttttctacatttatcagctagcattcttctgtagagaaatgctttgatctaccccctctactttccatctgcccacccccgccccctttttccagtaaactacttattggacaccagcacccagatgaaggaatagaaaattaccagtgctagtctggcatggtggctcacgcctgtaatcccagcactttgggaggccaaggtgggcgggtcacctgaggtcaggagttcaagaccagccttgccaacacagtgcaaccttgtctctattaaaaatacaaaaattagctgggcgtgggggtgtgcatctgtagtcccagccactgaggagcctgaggtagaagaatcacttgaacccgggaggcagaggttgcagtgagccgagatcgtgccactgcactccagcctgggcgacaaagtgagaccttgtctcgga

SEQ ID NO: 231131 - DNA, 635 bp, Homo sapiens
gtaatctcagcctcccaaagtgttgggaatataggcctgagctactgcgcctggacgatatttgttttcttactgaattttaaaaattctttggatattcaggatatttctcttgtcaattagatgtttcttttagactaatatgcatgtgtgtgtgtcttgtctttttatattcctaacagtgtctttcatagaacagacgttttaaatttctttcttttatgcatcatggatcatgcttttgatgtcatttttctttttttttttttaactaatattttttagagacaggttctcactttgtgtccagggtagggtgcagtggcacaaacatggctgactacagcctcaacctcctgggctcaaggaatccttccattttagcctcccaagttgctgggactacaaatgtatgccaccataccccagtttgttttaaaaattttttgtagaaatggggtcttgctatgttgcccaggttgctcctgaacttttgtcctcaggtgatgctcccaccttggcctcccaaagtgctaggattataggcatgagccaccacgtccagcctggtgtcatttttctaggaatattttggagttttagtttttacacttggctctgtgatccattttggt

SEQ ID NO: 231132 - DNA, 636 bp, Homo sapiens
gtaatctcagcctcccaaagtgttgggaatataggcctgagctactgcgcctggacgatatttgttttcttactgaattttaaaaattctttggatattcaggatatttctcttgtcaattagatgtttcttttagactaatatgcatgtgtgtgtgtcttgtctttttatattcctaacagtgtctttcatagaacagacgttttaaatttctttcttttatgcatcatggatcatgcttttgatgtcatttttctttttttttttttaactaatattttttagagacaggttctcactttgtgtccagggtagggtgcagtggcacaaacatggctgactacagcctcaacctcctgggctcaaggaatccttccattttagcctcccaagttgctgggactacaaatgtatgccaccataccccagtttgttttattttgtcctcaggtgatgctcccaccttggcctcccaaagtgctaggattataggcatgagccaccacgtccagcctggtgtcatttttctaggaaaacttttaggaaaccaaggtcacaaagattttttctgcaaacttttcttatacatattttggagttttagtttttacacttggctctgtgatccattttggt

SEQ ID NO: 231133 - DNA, 635 bp, Homo sapiens
gtaatctcagcctcccaaagtgttgggaatataggcctgagctactgcgcctggacgatatttgttttcttactgaattttaactaatatgcatgtgtgtgtgtcttgtctttttatattcctaacagtgtctttcatagaacagacgttttaaatttctttcttttatgcatcatggatcatgcttttgatgtcatttttctttttttttttttaactaatattttttagagacaggttctcactttgtgtccagggtagggtgcagtggcacaaacatggctgactacagcctcaacctcctgggctcaaggaatccttccattttagcctcccaagttgctgggactacaaatgtatgccaccataccccagtttgttttaaaaattttttgtagaaatggggtcttgctatgttgcccaggttgctcctgaacttttgtcctcaggtgatgctcccaccttggcctcccaaagtgctaggattataggcatgagccaccacgtccagcctggtgtcatttttctaggaaaacttttaggaaaccaaggtcacaaagattttttctgcaaacttttcttatacatattttggagttttagtttttacacttggctctgtgatccattttggt

SEQ ID NO: 231134 - DNA, 1082 bp, Homo sapiens
ggcaggaggatcacttgacagtttgagaccagcctgggcaatgtagtgagccccccaaaaccctctaaacaaacaaacaaatctgcagaatatttcagcatcactctacactttcctagaatatcaacatacctgataatgaagtagaaagagttccaaattgatgattgagtgttgggttctagttctatttctgccactaattagttctctgaacttaagtgtttcatgtcatattgaaactttctcatttgtaaaatgtggaggggatctcttaagtgctttctagtttcaaagtactttgatactgtgactttattttgtagaggttctggtgtcatttatttttaatagctacatgaataatgtagagatactatcttttgatttcaacttcacatacatggaaatgaaagtcttgttatttaacacaaaaggaaatttaatttgcattatttaatgcagttaatattacctaaaatgttgaacttaagcttttctactttaagtgcctttaaaagttttgtatttggaatctaaaatataaaggaaattcttatgtagctctatacagttgcttctttattatatagttttgagtgttttgtagcaacttttttttttttaaccttagattgcacagagcagcatattcatggattcttcactattccgctagtgaatccttgagaaatgtatgttaaagattagctcactgagcaggtaagtaagtgctctgtcttgggtgggcaacaaatcttcatacagagtaggataaagaactattcagatataccagtatttgtatttagatattcccatttagatggctggtgttctgagctagtaaatggttaatgttacagatcttaaatattgctttggtagcaaatagtttattccctgagttttcaggttggtaaatgtttctgtaaaagaccagatagtaaatattttgggcttcacaggccatatagtctgtccttactattttcctctgcaattgtagcacaaaagccaccatagacaatgtgtaatcaaatgaatgtgaatgtgttctaataaaagtttatttacacaaa

SEQ ID NO: 231135 - DNA, 371 bp, Homo sapiens
cctagctatagatacccaggaaaataagtatgtatcttcacagaaataattgtatgagaatattcatagttacttatgcacagtagttatcaagtaaacctgtctcccatcagaaaaatggatatcaaattgtgtgataatcatacaatcaataggatattacttggccaaaacaaaatgaaacaagggaaaaacacaatcaaacaaattagtggcatatatacccacttgagtaaagagaagtcggccgggcgcggtggctcacgcctgtaatcccagtactttgggaggccgaggcggcagatcacgaggtcaggagatcgagaccatcgtggctaacacagtgaaaccccgtctctactaaaaataca

SEQ ID NO: 231136 - DNA, 390 bp, Homo sapiens
aatcaaagacaaacctaatcaatgaattcagtacagataaaatttgtagaatatgatttttattaggactgttaagtcacagaagggttaaatagattggtagagcaaaatatgtcactgttatcataaatattcattgtaatgaaagggactctcagaactataaattagtacgcttcatttctacaccaagcaagctcacatattatttaataaaaggataatgtccctaaatttaagtaggtctaacctgttaaacaaagagaccacatagtgtacgaagagatgtcaggagattaaataagtgtgtggataaaggtaagccagtggaggtaatctgttttgatggtcaaaaatactttagcatttcattgcaaaaacaattgaaga

SEQ ID NO: 231137 - DNA, 393 bp, Homo sapiens
caaaacaggaaacataatcaaagcgctagtcagctagtctaaccactaggctttcttcacacatgcttatatcctttaataaccaattgccaaccacggctataagattatttcagaggtggggctgggaagtgccacttgctccttagagtctgtttgtcaaccaggcagagtccctttcttttctgctccccaccccaaccctgcccctatgtacaggaataagagcaaaggacccacaggctacagagaagaggatggggacagagtgtgggatggagaggacagaccatatactgcactgtgtttgcatgagcctctaccaccttcctctatctaccagatcattaaacctgctgtcaaagggccacaacagtagcagccaaaactaaa

SEQ ID NO: 231138 - DNA, 488 bp, Homo sapiens
tcggtctgtccctcggagacgctcttcttccctgtggtgacagggaggcctacataccccagcaagggcttgggcctcccttggtgacagtggggccagggtccggcagtatctgagagcagctgggatgtactggggcctggaggaggtgcttggttgtgggaagccccagatgacctctttggaaggacttggaacagcaccaagatccacaacccctccgtgtgacggggtcactaatccagaaggtcagctggagggggcccttagagatgtgttcacctgaggaaactgaggcccagaatgggaaggggtgacactccttccaccgctgggggccctgctgctgcctcccattttgtctttcctcgggcctcctgatctttgcaacctcattttcatgccttggtgttttggggcaaaggtggaccacttgtttcatgtttggaccacttgtttcttgggaaataaatagatttatggtctta

SEQ ID NO: 231139 - DNA, 341 bp, Homo sapiens
tgcccatcagcagcacacagacatgaaacatgcctccctgtcttggtcccacttccctctttagccaccacttcatgtttctgccctcttaatggtaaaactcctcaaaaacgcttgtgatactcacttcttcagccttctttcccatggggatgaaggcccagggttgaacatgaccgtgaatcccagtccttggtagcatcccatacttgatcctcccctccttgctcctaggatgtccgtggtccccctcctgccctgctggttcctcctcatcccccagctgccccctggattcattctctcaacctctcctctgcatcgtctgtacctactcctca

SEQ ID NO: 231140 - DNA, 139 bp, Homo sapiens
catcccaactcccttctattccccccacccttaacataaaaagagcctgaaatgtgtactgacttattttaggatgcaagtccaccatcttcttggtttactggctttccaaataaactggttgtttctcccaccaact

SEQ ID NO: 231141 - DNA, 255 bp, Homo sapiens
cagtgattatagatatcatacctttaccataattaaacattaaaatgatatagattttgcctccaattccaggcaaggatgggaaaggcaaaattacacaagtgagctgttctgcccaaaggggaataaaggtgaggagaggaggctagtaacaatcaacaagaaattgattaaatttccagtcacaataatatttatctgcaagggtattaccaagaatttagatgctcttggaaagaataatttttgcctaca

SEQ ID NO: 231142 - DNA, 353 bp, Homo sapiens
gtctcactgcaaaaataaatgttacgaatagtaagttctcccttcatcaatacgttcttggaaattgcaactttgcacttaaagtatattgagtatattgtattggtataacaacataccaatgtgaaaccaatttgacatagactaattgatataaacaagagttaagttcctatggcatatttctggtcacaaaaatatcaccaaacttctaaataaacacccatttaagaaagattaacaaaaacaagtaagataatcatttacccaattattccagtttaggagcatgtgtggctgcagcctgtcctggctgctcaggatacaaggagagaaccagccctggacaggat

SEQ ID NO: 231143 - DNA, 223 bp, Homo sapiens
tacatttatatccctgaatttaagtaactgtatatcaaaagaggagtggaataaacatcaccaaaagagggttccatggattttgtttttgtttggaaggtaagtacggtttaaagatgtgtgtggggtgctgagcaagttgcaatacataagcctttgtcagcataggcaatggttgaaaacaggaacagaaaatacagaaattagaacccaggcttgtcca

SEQ ID NO: 231144 - DNA, 279 bp, Homo sapiens
caggctgttctcgaactcctgagctcatgatccacccacctcggcctcccaaagtgctgggattacgggtgtgagccatcgtacctggccactttaattatttttaaatgtgcaattatttttttactacaggttattttatgattataataagtatatgagtataattataattcacacatttctaagtcatgaatgcttttaaaaaatgttccatatttatctttgaacatgtagcatctctttccgcaaataaatgcagactttggttttgattta

SEQ ID NO: 231145 - DNA, 1309 bp, Homo sapiens
aaaagctccctaaaacatccgttcggcgcgcgggcccagggggtggatgaacttggatgcgatatggtgataccttaggtagaatcctccgtggtcatgactagatgcattggactgctgctacacaactaaatataaaacgcctggaggacgactcggagacgtcctgaagcaagggcgctgatggcagtgctgaggtcatagggatactatacaacgatgtagtcctatacgtcagagctacgaaattcgtcatttagtcccactgctgtgacgtttattgcatggcttaagtgaagatttgggttcattttcctagtgtttgaattttaccaccattgttttttaaaaaataatttgcgttttcctctctgacttaaaataccaacttttagtaaaaggaatctctgtatatttatgtctatttctgggcttaatatttagttttagtttaatatctattactagacctattttacaacatattcagtggtctaaattttaatatttgtaaatatcaggcaggtcaaaaaaaacatcattttcacttttgaaaatattattttctagtatcagctgtttattcttccaggaaagtttataatcagtggaccttatttaaaaagacctgtagcagtgtttttagagttgcactgaattgcaataaatccaatggggagaaattggtagttataacagtactcaatgtcaatattcaatatcaatagtactcaataatactgatataagaacatgataagacttccattgctgaacttggcttcaggttttcctcagtcaagtattagtttgcttcctgcatttcctatgcatttcttacaaaacttaaggttgttatcttatattttctgaatctgatttttattcattgtattttcaggaatattggaaagatatcatttgaatatatttaattttttaactgaaaaaactattgctaagctatcttgttggtttcgttttgaataatagattcttgtgttttcgggtagatgatcctcatcatttgcaaataataacaataataatgggctaatattgggattcctttattctttatggctttaattgcacagcctctaggcatattcttaaacaataaattggctgttaatttaaaataggcatttaattatgtcaatgaattgtctttttgttcttttttagattgaaaatcaaaaaccaagaatagaaattgagttttgttaaatgtgtttgtagcttctattcagatgattgcatatttttctttgttgtgatttattaataaaatatacttttaatatta

SEQ ID NO: 231146 - DNA, 741 bp, Homo sapiens
cagcagctttggagtcatccagaaggtgtgagctcacgcagagccaaaaaggagagaaagaagagtgtttccttctagacaattcatagtcttttgttcatctgtagacgtttattgcatggcttaagtgaagatttgggttcattttcctagtgtttgaattttaccaccattgttttttaaaaaataatttgcgttttcctctctgacttaaaataccaacttttagtaaaaggaatctctgtatatttatgtctatttctgggcttaatatttagttttagtttaatatctattactagacctattttacaacatattcagtggtctaaattttaatatttgtaaatatcaggcaggtcaaaaaaaacatcattttcacttttgaaaatattattttctagtatcagctgtttattcttccaggaaagtttataatcagtggaccttatttaaaaagacctgtagcagtgtttttagagttgcactgaattgcaataaatccaatggggagaaattggtagttataacagtactcaatgtcaatattcaatatcaatagtactcaataatactgatataagaacatgataagacttccattgctgaacttggcttcaggttttcctcagtcaagtattagtttgcttcctgcatttcctatgcatttcttacaaaacttaaggttgttatcttatattttctgaatctgatttttattcattgtattttcaggaatat

SEQ ID NO: 231147 - DNA, 201 bp, Homo sapiens
ccaaaaaaaaaaaaaaaaaaaaaaaaaaaagcagaaggcagcaagcaaaccatgaggtaagaacaactaagataaaggaaaatctgaaactaaaggtcagagagaataaaagaataatccaaacaagctaaagtgatagaaaagagagtaaacaatgatttcaaagtccaggaggttaactagtcaatattgactaaatta

SEQ ID NO: 231148 - DNA, 437 bp, Homo sapiens
agattctcctgtttgaggaacgttgctggctagtgacatggaggagcactcaccaagagagaaggggttgattttatcactgaaagcccagctctgtggtacattctagaagctctcaacatctaatctgatggtgcgcaccagaagcttctccgtcctattgaatctaatgagaacatcacgtgggcaagcgttcagttaacacccaaaaagagctgcagccacagactggcactgcatcaggaaaggcagacgggaacacattctagtgaaatgcaggaagttagagacacgaggcaaaaaagatgttaaagagttttgtgtcagagatagcagaaactccttaattactttttggagtttggatttctaaatcacagctttctggaaaattcagattcttatcagtaaaagatcctgctttaggttatttaata

SEQ ID NO: 231149 - DNA, 475 bp, Homo sapiens
gagtcgaagaagctctaactagattttctggttaatgtaagagtctttgcttagtgcatggaaggccttatgtgtgttgttttaatcagtccttttgagttagcagtatgataattcacattttacagatgatgaagctgaggattaaagaagttagctgacttgcccaagttacaggattttagtaagtctgattcaaccctgtggtacactttctcctctggttaaaaaggtcttcaaaggttaaatgttccaaattctgtttttgagaataacacagccagtttaaaaatatatatatattcagtatttgacttgctcaattttcccagttaattgtaaaatcagaaatagccctgtgtgtagtattgttacatacaatgaagttatctttattgctgttacataaaccttatattttaaatccattatttcacttcttccccaataactaggcttttgtttctcaaggaat

SEQ ID NO: 231150 - DNA, 371 bp, Homo sapiens
caaccaaaccaaaccaataaatagccttaaataatgaaccagtgggaaaaaaagacaccagttgaattaaacatatgcctcggaaaagttagaacaagcacaaaaaagtaaagcagattgtatgattatatacctggaaaacccaagggaagcaattaaaaatatactatcataataggaaaatttagtaagtttcaaaattaagatatagaaatgagtagctttcctatatgggagtaaaaaccagttaaaagatataatgcaagggaagacctcatttataataacaacgaaagcacactgccaccaaagctcagactaagtgtaaagaaagtctgcatcacccacccacatgcaggaaataaatgtaa

SEQ ID NO: 231151 - DNA, 925 bp, Homo sapiens
ccagggaacaatcaatacctactcgaaaaaggactttcctgaagggcaaacaaaacaaaacaaaacaaaacaaaacaaacaaaacaaaaagtaacactggatgtttagaatttgttaacaacaacaacaacaaaaaaccattctggaaaaaaagattatcagaggagtgaagaaaaccgtgtctaacagattcatgccaaagcttggatggaagcccctcaaagtctaagtatcgtgttagcatcaactggtactcatttctctatatctaagactagaagattctctcacagctttactgtttcctggcaagtgttttcaacagcctttccagctgaagggacgaacccaggaaagtaacaaggcccaagaccccacatgggtcagataagcagcccctactagaagcttgctactcgttaactgaaaagtggaggccacgcactactttcactctctctagcaggtgaaaggggattttctgatggcaacagtcactccgtgtaaggtttaacttacagggcaataagttatcaaaaagttattgttaaaagcatatgattagtgtcataaacatatttatatttggaattacaccatttgatatctccattaagaatgcaaagctttgagaaaagcatactgtaaaatcatgttgctgcaaacagcaaggcatccagctgagtgtaagcagtctaatgtcatcaaactgaaatggaccctcgtgacgggcactatggaaccagctacctagacagagagaaaaaaggagaatggcagggaacggttccagatcaagaatctctcccttatcagttaagagttccatactgagtctatgaaaaaagcaaattaaaaagattttaagaaagggggaattcaattccaggtcagaatttatctaatgatttgatatgtttcccat

SEQ ID NO: 231152 - DNA, 1167 bp, Homo sapiens
aggaagaggaaagaggtgccctgctgatgatatatgtaatcatgacttagtgacatatcacaagcataggaagcttctggttcagtggtcctcaaatgcaactcacaaaatatcatctggggaagttctgaattaagtcgttgagagtgttacctgggcatcaggatatttaaaatgagaatctacagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatgttctgacttctggagcaacacagaaccaatctactaatctactccctcctgtacttgacagcctttcaccatactggaatgggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagaggtatgaagatggatacagcatcactatggacactcgtattcacttatttgcctcttcactgctgtaaacatttgattgtggccacacttttgt

SEQ ID NO: 231153 - DNA, 519 bp, Homo sapiens
aatatgccaacatctatagagccatgaactctgtcagcatccatgttctgattcttcttgaagaagtaagctttttgatagcagcagtacatctatgtgttcttttcctatgtcctaccgtggaaatgtgatacagaaaatatccaaggaataatcctctctaccaaaagcccgcctgaggccaggcacagtaacttacacctgtaacccttgcactttgagagaatgaggcgggagaatggttggagctcaggagtttgagaccagactgggcaatgtacagagaccagtcactgtaaaaaaaaataaaaataaaaataaaaataaaaaagtagccaggagtggtggcgcaacctatagtcctggctactcaggaggctgaagtggcagaatcgcttgagccagggaggtcgaggctgcagaggctggagtgaactttgatcatacctctgcactctagcctaggtgatagagcaacaccctgtcttaaaaaataaataaataaaaaataagaggaaa

SEQ ID NO: 231154 - DNA, 389 bp, Homo sapiens
ggaggggtgtgtgtacgaggccaggcctggggcagtctccgccccgaggacaggtttcactcaggaggtaatggtaattgtgctttgtaaaaggccactctggagaaggagggtggctgtgttgtggtggagaaggtgggtgcatggctgctctggacacagcatgggaccctcgaaagggctcgaaccctcctgggggttggaacagggccaggggcttttggacaagccctgcctgttgtcctgggcaaggtccccaacccagtgccctggtgcacccttcacttgctggtgcccccaaggccaccccgccccggagtcacaggtcacagtttccgcaggacacgcaggggtgaggtggcacctgacggcctcagggacccacagga

SEQ ID NO: 231155 - DNA, 457 bp, Homo sapiens
ctgacaatctaactggtgcagcccacacttctccaatgcgataggatccctttctctgtacttctgaagaaggactaataataataattcactgagctttttgcttttttaaagttccgggccatcattacttagatctgcatcataccatacccacagcctcactagcccattggctgctagggaggaaacagctcaggcagcagcagcaaaccctgagggagaaggggtggcctcacttccagcaggatgacaaagattgagtctgtgaacagtaacaatgaaaggccacaaccaggaattgcagggaacctctgggcagtttcttaactctgattttcccatgctgaatcattataaaactccctcaattattattggctatcgcaaaatcaagaaaactggactccctatcagagatgtaataataacaataataaaaagaactctcaaacca

SEQ ID NO: 231156 - DNA, 454 bp, Homo sapiens
tggccgccgcatggccataagcttttatggtggattgtagtgagttccaacttcagccctgctgcttttaaagatttcaatatacctgtgccctattctttccttgtgtttctttagagccttttcagctatttcctgtgaagcaaactgcacgaaggcctcccccgtactcctcccctggaagtccaccggcaatgttatcccatttggcacgatttccaaccctgagaagaactgaacaatttcttccttgctacatccaaagggaagtcctctaagccgtacaaagccatcattggccgtgtcaggactatttggaccagtatgcttcaacacccaatccatttcaacgttgtttgacttgaatacttcaacatatctgtgtcccatagtttctctgtcttttttcagggccaatttgacttcatcttctgattcaagttcaacaaaagcc

SEQ ID NO: 231157 - DNA, 457 bp, Homo sapiens
tttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagcaaactgcacgaaggcctcccccgtactcctcccctggaagtccaccggcaatgttatcccatttggcacgatttccaaccctgagaagaactgaacaatttcttccttgctacatccaaagggaagtcctctaagccgtacaaagccatcattggccgtgtcaggactatttggaccagtatgcttcaacacccaatccatttcaacgttgtttgacttgaatacttcaacatatctgtgtcccatagtttctctgtcttttttcagggccaatttgacttcatcttctgattcaagttcaacaaaagcc

SEQ ID NO: 231158 - DNA, 611 bp, Homo sapiens
  misc_feature (58)..(58): n is a, c, g, or t
gctcggtacccgccaaagttaacattttggaagttcttcatgtccacctttaagatgngcttaaattatttgaaggtctctaggaagaatacattaattcattggcaattgactacctactgaaatacctaagctactcaactttaacgtctattaaatcaccttgccataagctagccaaaactcactgctcagcaacaaacatgactacatacctgagaagaactgaacaatttcttccttgctacatccaaagggaagtcctctaagccgtacaaagccatcattggccgtgtcaggactatttggaccagtatgcttcaacacccaatccatttcaacgttgtttgacttgaatactgaaagaggtgcttagaattagtcacttttggaaaattagataacaaagttcagacttcctgggtctttagataagctaggaagagctgccacaaactcccttagatgacccatttccatgcagtcaaatacctaaaattcagaaggggtgagacctctattgtttaatgctttatttactgtaactagggcaatgtaaatcaaaccttctacatatctgtgtcccatagttctctgtcttttttttaggc

SEQ ID NO: 231159 - DNA, 352 bp, Homo sapiens
caaagaatgcaggtggcttccaggagctggaaaaggcatggaaacagattctcccctagagcctgcctcctcaaggaacacagcttggcaacctgttttggacttttgatgtccagaactgtaagataataaatttgtgctcttttaagccactaaagttatggtaattttcttgttttttgggagtttgttttttttttttttttttgagacggagtctcactctgtcacccaggcggagtccagtggtgtgatctcagctcacagcaacctctgcctcccaggtttaagtgaatctcctgtctcagcatcccgagtagctgggactacaggtgtgtgtcaccacgtctgg

SEQ ID NO: 231160 - DNA, 295 bp, Homo sapiens
tgtccaaaattatcacaggcaccagttaggcaggggcaccattgccctgtgcaacctgttcccatgagtatatcctagagaaagagagtggcctgggtacacttggtaggagaacatgtgttgttggtttatgccctggtctccagtgcgataccaaaggatggggtgaggatgtatcaggcttcatggaagcaaaggaagccccaggcaattcccatgtattgccaagaccctcaacactggaggccttgtcaggataagggagagaaagtctctgcaaggttcgttaccatta

SEQ ID NO: 231161 - DNA, 433 bp, Homo sapiens
tctttgaaaaaaataaagctcaaggttattttaactgacaaaaggaaaaaaattatcttcaaaagaaacgcatatacttcatataactgagtactggttacacttcctcagagaaatcaaacacttgatctaagccacaatctgctaatgaattgtcactgcttctcatcatttgagggctactgtaattctacattaaaacaacatctcaaatgagcaaaaggaggtgaatctatcattttgctcattttgtacacttgcccaccagaccctagaatacatatagatatgtttactgattcatgaattatttaagtatccacaaagacccctgtctataaaactgacaactcttatgcctatttttcctacatatgtagttacatgtaatattgtgtccatgtaaatacaaatatatataactggtaaagca

SEQ ID NO: 231162 - DNA, 455 bp, Homo sapiens
catgaaacatttatctcaagttttatcctcaagatacacaacattatcctcaaatcaacatcaattcaatgccaagaaaatctcctttgcagaataaatgaaccctatcctcatcacagaaggcatctgagttacatccaagccatattccctttggcaacttagtttatacccacaactactacaggcagcttcacagagaatgtgggacccagagagcctcacatagctttcttctcctacaggactttgtacaattcatgatccttctgagactgcatcttcacttgggcagcatagtaaaatctcaatcatttcaaactgcatcagaattccacaggctaaggctgggcttattttggcctggagcttatttttacatcattagtaaacaagctaagaaccaataagataagataagctgagctatttcaggaaaataaatggcttaaagg

SEQ ID NO: 231163 - DNA, 560 bp, Homo sapiens
tagtttgaagtggagcaccaagcaactctatgtccgggggcattattgaaaatagtcgcaatctctgtggcaaacaaatagggaaggtcaaccacatagctatcctaagcttgaggtcctagccagagcaagcaacaaagtggcaaactagctagaaaatgaacaagaagagtggggaatgagatgatattattgggacttgataagttcctctctgtctctggaaatttggaaggctgcacagatgcacatgtgtaggagaaaccagaaagggccctagccatccattcatccctgactgaatatgaaatcttgtgaatgcacagaagaaatgtgagaggtcctaaaagaaagcaaaagctgaaactgacttgtgaactgcctgaattttgaatatgttcccaaacatacagtcaagtcaatgcaaagagggtgaaaatattactgggtcaaggtagttgagcatgtttcctgaacaatcattggctaaccactaagctatgctgtcacaagggtgaacccctaagaggctaccgttaagaatgctaaaaagattattt

SEQ ID NO: 231164 - DNA, 156 bp, Homo sapiens
ttttttacaaaaccagtgccccgaaggtcatctctcattacacacaccacaatgatcaaaaagggaaaatattaacaccaatttgtctacccaacttaaataaactttcctcttacgttgcattattcctaaggtatgttcatttggccttttttg

SEQ ID NO: 231165 - DNA, 506 bp, Homo sapiens
gttcaagcaatcctcccacctatgcctctcaaagttctgggattacaggcatgggccaacatgcccagccaaaaatgactattttttaaagacacttctattaagctttttgccatcctttcccagagcctcattttgtataatctactaggaggtgaatcatatgggtctcctatattcaggttcatgggctcatagataccaaacctcaacaaaatgaggactagtatcccagagtaccattcaaatatccctgtggcatatctagaacagtgtcattaccctatttgctgtatataaaggtttcgaagaaaagtgattctatccctgctgccaacgaaggttaaaaagtatgcaaaacatatccggtgtgttacaacacatgcgattagcaaagatattcaaactcatgtaaactttctctgaaagctaacaggattaccatagatgtttaaactctcagatcatcactctcacttccctacacccttcaccactgccaaaaa

SEQ ID NO: 231166 - DNA, 723 bp, Homo sapiens
gctgaaggcgggagtccatggaaccccagaagctgctgataattggatttctgctatgctctctaacttgcctcttgttggagacagtagcttcctctcctttgcctttgtctgccttgggaatacaagaaaaaacaggatcgaaaccacgctcagggggtaatcacaggtcctggctgaacaacttcagggattacttatggcaacttatcaagagtgccttacctccagcagccattgttgcttttcttctcacctcagcactaatggggatcctctgctgcttcaccattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgctttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtg

SEQ ID NO: 231167 - DNA, 586 bp, Homo sapiens
aatgtctatgctctttctgcaggtaatcacaggtcctggctgaacaacttcagggattacttatggcaacttatcaagagtgccttacctccagcagccattgttgcttttcttctcacctcagcactaatggggatcctctgctgcttcaccattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgctttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtg

SEQ ID NO: 231168 - DNA, 501 bp, Homo sapiens
catgatggaaggagctgggatccctgaatcaccttgtggaggagaacttaacttacatcagaatgagcattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgctttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtg

SEQ ID NO: 231169 - DNA, 543 bp, Homo sapiens
acttcattttaaagaaaggaattcatttcagtcatcttattctcaatatttttaaatatgaaaaaatctagaactatcacagaaatccccaaggcttttatcccttgtgaaagcacatggaaccttgtggctggtaaacacttttcttactttgggagcccatgctggagacacttgatgttcttttctcaaagcagtcctcagaagagaccatctcacctatgagagatgtactaataacagatcctgaataggaagaggtcgtagactggtccactcttcattttcaagggtttcttgacctctgaacaagttcattcctgaagtaaccagctgttcacatcaagggaatatagtcatgtgccacataatgatgtttcagtcaacaatggaccatatatacactagtggccccataagataataattgagctgaaaaattattattgcctggtgatgtcttgatgatcctgaccttgtacaggccaggctaatgtgtatatttgcactttagtttttaatgaaaaggtttaaaagtaaaaa

SEQ ID NO: 231170 - DNA, 413 bp, Homo sapiens
attggatgaatgcgttaatgaaaagtttgttttcaaacctcactaaactgctacttaagatcacagttaatgtgagtcctgcttaatttggaaagcatttaaaaaatggaaaagtttcttagggaagtaaaaattttgcaactctgcctacaaggtacagtaattggctaggttcttttgaagagcagtgttgactagagttaaggaaaagtcagttgtgaaaaatggacatttttaatagcaaaatgatgtgctttactgtagaaacaggaggaagggtgcattatcctggggaaaatgaattcttcagttatgttttatgctgctctactttattgcaaaacgctaatattaaatgaatcaagaccacctccccttcccgctttatgaaaataaatagaagtatagaagat

SEQ ID NO: 231171 - DNA, 502 bp, Homo sapiens
atcatagctcactgcatccttggactcccgggctcaaggggtccttatgcctcagcctccggagtagttgggactacagatgctcatcaccaccactggctttgatttttttgttctatcatacttagcctatcagctaacggttaaccttcagattcatggaaatccaggttcagaatagtattattaatgtctgctgatgctaatatttaaataattagaattaaaaagagctttcaaattgtattttatataatttaacctgtaagttagaagttttgttggcattttatggtgcatcaagaaaatttactgagagaagatgtacttactttagatctgataaaatgttaaacatttgtttgatttgatttgacatctcttactttcaggcattgctttagcatctgtggtctgtatttacccccttaattgtggttgccttgaattaccaatgcagtagcagtgtgataaattaatttctttacctatgttttattac

SEQ ID NO: 231172 - DNA, 759 bp, Homo sapiens
ggtaactgcaaggaggagagcaaggaagtcggcagaggcggcgaccctggcgaggaaacttcccagtagctttgttcagcggtaaggaccggatccctgagagacaaaaatcatcttttctactgtagcagagtggggagaacgccaggaaaaatggagagacaccaagaaagaaggaaaatcatggggacccttaggccgaagcagccctatattaagtttaaagaagaaagcaggcggcttcctgtgatggtatattggttagtactctgcatcgcggccaagggtggaatcccagtcatggcagtgtccctcctggggcgtggcactcctcctttcctttagactccaacctctgcctaggctgcgcttttacctgcgactagagaggttacaacttaccagtgccttcggagctctgtgcagtggtgagaatagaaggaacccctaccttgcatgctggggtccagtcatcttgaaaggctgggcttttgccccctctctgagcaagtgcagcacccaaaaggtgaggtgctccctctcagtcagccttattggaatcctccactattaccacgatgtggccataaccgtttttctggttcagatatttcaatcatccgtggggccttttaaggccgaatcagaaacaagcgagaggacatgaggatagtttgcactccaactgggaattttaagtaaagcctaaagaatacaataaaatctaaacttaatgtcattccccaacaaaaaaaaaaa

SEQ ID NO: 231173 - DNA, 252 bp, Homo sapiens
gtgaagcgatgcccatgaaattgtccaagggaagatggctagtagtagtagaatgagctttagagttggctatcaacaaatttagtgaaaaacctagtgaagcttccaaatctccagtagtatctgaccaattgtttgttatatctataaatactctctcacctctacagaaagatatataataaatattcctcagtgatgtgatgtttggctccactacatcttgcagatggaatctgggtatagtctgtg

SEQ ID NO: 231174 - DNA, 400 bp, Homo sapiens
gcaaaacttggaaataaggcaaaacgattactgcatgccctttcaaaatcatgctagaacattcgacaagtccactgaaatgtcatgggagactctagggaaagagaactttatttgacataccatttactattgatcagggcccaaactctgtcaatttagatgttaacttggagtagattgatacattacaaatgacttttgtccagtagagatgggaataatttctgtcttacagaaaagaaatcctcaaaggggactgttctattgccccagggcattaaactcgtctgcatcaaacttctcaatctcttaaagcgttctttttccctgtgtatatgtatgcataaatatatatacatatgtgcgtatatatataaaacttctcataacctaattt

SEQ ID NO: 231175 - DNA, 511 bp, Homo sapiens
tgcagtgggtactagacattctaaatttaaattcacattgtggggtccccaagctaaaatgctaataggaccctttaccctttagaagctgtcaccaggtcctcatgggatgtaggatctgttctaccacatacacctatgacttcaaactttctggtctgtctggaattctgattagaatagtctcccctagtcacaacagctcaagggacacagcaaatcaaaaccagctcaccttcacatgacaacacagacacaaatgacaagtgttatcaccagtcgctgatgggcaagacttcagataaggacttatgccaaaggataaacatcagggcaagggaccaaaaggaaactactgattttgaacttctggttccacttgtaactacagctctgaattatctctcacatgtgtctaggtcataaaatggaagcgtctctctccatacgcttttctctacatctgctttgcaattcaaacatatatatatatacacacacacacacacac

SEQ ID NO: 231176 - DNA, 565 bp, Homo sapiens
cccacctcctggtattagaaacagcctttctgtgattatgcctatgggtgattgagtagtaacacaatgacttcatttccatttcccagcttcctgtgggaaggtttggatccagcctgcaagagccatgattgtaggagtataatgataactgatgtttatacagtactttacaattttcacaaggatttccatctattggcttctcactacaccattattaccattcccacttcacaggcaagtaaactgagtcacaggtaagcaaggctaacagagtttgcatagataatctcacagagctaacaccagaactcaggtctgtagtgcttcttctaccttccacttatgtggaatagtttgatgtttaatattttaagcaggtaagtatttgagtcctctctaccccttaccagcactgttacctggaatagctcctgaatcttcagcttcctcatgaaacagaggaaataatactatttatgagatttgaatggactaaattatgtaaagcactgagaacattgcttagcccatagtaagtactcaataaaatctagctgtc

SEQ ID NO: 231177 - DNA, 416 bp, Homo sapiens
ggaggggtaaaagaaccaagttgcctagctttagcagaatcaaaatacagtaatcaaaccgtttattcaaccagcaacatttgagaagtcggaaggaaagtattacattttaagatcagtttgctggccgggtgcggtggctcacgcctgtaatcccagcactttgggaggccgaggtaggctgatcacttgaggtcaggagctccagaccagcctggccaacatagtaaaaccccatctctactaaaaatacaaaaattagccaggcatggtggtacatgccggtagtcccagctactcaggaggctggggcaggagaatcgcttgaacccgggaggcgcaggttgcagtgagccaagatcgtggcactgcactgcagcctggcgacaaagtgagactccatctcaaaaacataa

SEQ ID NO: 231178 - DNA, 418 bp, Homo sapiens
cccaagaattcggcacgaggatattcactaacatataccagcagagcaaggtagttgaactgcatttcctcttccgatcagtgtagccagctctattctagatcttaagctcattcaaacagtattttcaataattcttttactgttaatcccttcatatttcaaaatgcgtttgaacataaaacttgtcataatccaagccatcatggtttcaataggttgatgcaaatacagccacttaggaaagtaaattgactttgcagtcatttagagttgcaacactgactctgtcatggatgtgttttcttatgagatggttgagaggtatcaaagttcacaaagctgtactggttgaatgcctcttatgtaatagcaagtgaataatgctttcataaataaaagtctttatagcaattta

SEQ ID NO: 231179 - DNA, 518 bp, Homo sapiens
ttcttttttatggctgtatagttggaatggatttttttatacaacgcagggtgggtatgaaacaattgtccctataccatttattgaaaagctaattatatatatgaatatatatatttatattcataaattaatatatatttctttttataaatgtctcttgattattctagtttttgaacttccatataaattttaaagtcattttgttaagatatagaacaaaaaattaggatttttaactcaacttatattgaatatatagatcactttgaatagaactgatatttttaaagcattgagtcttctaatccatgaacatagttattatttttagactatctttgatgtcttacagaaatgttttttttaatttcataaacgccttattccttttaaaaatttatttctatggagtttggatttttatactattattcacagtatctttaaaattatatttatttggggtataactttcatacaataaaattcattaactaccaccacaatcaaga

SEQ ID NO: 231180 - DNA, 358 bp, Homo sapiens
gttatgtttatactgtgccagaagtttcatagtgaacattgtggatggactatactaaaaaattgagaattgttataagaattatgaatggacttttctaactctccggctttaccacagaactgtttgtttgtttgtttttgttactttgttgagttggggaccagggctgccctgtctctgaggcagtttgagcatctccctatagttctcacccatttgaggtggaattttttctgctttattcagttgtatctcagtagctcattttaagctgtaagagtgttacaactggaaggtaccttagaggtctttttagagacctcacactttattgatgccagaaacaaaaagtgac

SEQ ID NO: 231181 - DNA, 549 bp, Homo sapiens
aacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttc

SEQ ID NO: 231182 - DNA, 413 bp, Homo sapiens
ctatacctgcccccaacaccaaatgcttgactgaaacattctattcctacccatgcctggagatataacattgttaagtctacttttctgcttcatttgtagagaaaaagagtatctcacaacccacagatctttagcacatgtcaaaatgaaacactggaagcttgttttcttggggacctatttggagcatattccaccactagaccccaaatatctcttgatctttcagagcctctgcaaaccagtgcccagaatcatgccctaagcacttttgctcacctacccagacgaatgcagtggcataaacaagtgatttcctagttcttttctagaaatagaacatttggtggccctaccatctgccagagctccttaaatcactggtttgaatgtctgatctcactgccttg

SEQ ID NO: 231183 - DNA, 311 bp, Homo sapiens
catacctgaaaccacagacacaggcacctgctcccacgcctcccacacctgagtgtctgcaacagtttgcattagtccttctagcatttttttcttgtaataaaatgtacataatacggatcttaacatggtaaccacttttatttttgagacggagtcttgctcttctcacccaggctagtgtaaaatggcctgatctcagttcactgcaatctcctcctccccagttcaagcaattctcctacctcagcctcctgagtagttgggattacaggcacccgtcatcaggcccagctaattttttgcatttt

SEQ ID NO: 231184 - DNA, 276 bp, Homo sapiens
gcccttggacaagcagcatagcctctcaattctcagtttcttcagccaaagaatggtttcatgacatcatgggagttatcttcagtattaaatgagatggcatgtttaaggagctcactccacaactggcacctaacagtgcttttaaacaagagttttcctttcctctcaactggatagggcaacaattattggtcccacttgtcagatgcgcaaacaggtgccaataggttgagtggcctatagctagaagaagggtgccatcccctaactcac

SEQ ID NO: 231185 - DNA, 673 bp, Homo sapiens
ctctcatttttatttttaaaaatgtaattagacacagactttactttggaaagctcatgatctatgagaagaggttaggcccagtgtttctagcagatctctgtgcctctcacctgcctaggcagcagtctcctgggttacatatccattaacaatcaccaaactgcttccagccaggcttagtgactgagcttagatcctttgagttcagacagtctagatcccaaagcagctgttctaatgcagaacctcaaaggcccttatcctggtattattgtgctgcagaattttctgagtgtctgacacatacacacacacacacacacacacacacacacacacacacttaatcattgaccttttgtgtgtccttggccacgttatttatgcttttgtgttttgatatctctgttgaaaagaaggatgtttgtacctgtcccacttagtattctgaggtttaaagaaacaagatgttaacaagacactgattaacatcattgtcacgaggctgctgtgatacactgaagatcctaagaacattttgataggaaggatagagtttctttactttccttttggaaacaaacttttctaataggttctggggattcttagtagcaagtaagaatgtaaatgatgagacaccaggtaagatgaagctttacaaattctt

SEQ ID NO: 231186 - DNA, 496 bp, Homo sapiens
caagttatatatgtgtgagctatgacgccaaattaggacactgccctattttatacatttagaattggaattttatcctattcatgagaaactcagaatatacaccaggattatggagcttaattcgtgagttattcaaaagacattcattgagtaacccattgttctataaactggagatagataaataagacatggtctctatcttagaggaatttaagataaagtggagaagacagtgcaaatgaatattacattttcacagtgttaggacatcactgttggtcactggtatattcctggtgtctaggattcctggatttttattaaaacttgaacagaaatggaattcagtggtggtattatgacacatggttttaaggggaacactaaaaagtaatctgatcagaaaattaaaacactaagaaaagtcatattttgttttcactcctcatatttttaatagaaaaataaagcagtgcatgtatatcctaaa

SEQ ID NO: 231187 - DNA, 495 bp, Homo sapiens
tgcaggaaatcagatatcctgatcagaagtgacacacacaatgatctaggttcatcacagagacatccaaagtgtcataaaggcaccacctaccaaagtgggttgttgtttgtttctaggataagctaagcacagtgatggggatgcctcctggatagagggaactgcatatgcaaacttccaaggaggaggccccagaacctcttggatctgctgggaagactgggctgtaggaagagggtgggaggaacagatggagagtcacctcacctgaactccactttctttcaagaatgcagcatagcggactgcaaaggatgtgggcttcaaagccacagaaatgggctcaggttctgattcctgctcacatctgtgtgaacctgggcaagacaacttctttgagcccagttttttcatgtcggaaatgacaggagtacgtacaacctcagaggttttataaacattaaataagataaagtatgttaaaaaaaaaaa

SEQ ID NO: 231188 - DNA, 2024 bp, Homo sapiens
  misc_feature (1069)..(1069): n is a, c, g, or t
gtttgcacattgatgaacacatttaaaattttcttaaatcagttatgctccgaaaaatcctgttcctacaacttaaagcacatgtgtgattttttttccttaggttatccttccagaaatagaactgttgagtaaggaatatgcatgttaaaatttctagtattggtccggcgaggtggcttacgcctgtaatcctagcactttgggaggccgaggcgggcggatcacctgaggtcagaagtttgagaccagcctggccaacatggtgaaacccagtatctactaaaagcacaaaaattagctgggcgtggtggctggtacctgtaatccctgctactcaggaggccaaggcaagagaatctcttgaacccggcaggtggaggttgcagtgagccgagattgcgccattgcactgcaacctgggggactaggttgagactgtctcaaaaaaaaaaagaattaaaaaaatattaataacatggtcaagtctccctccaaaaaaggccaacgtaggaggattattttttctcacattcttttttacactatcttgagtctttaaatgacagacaatatcttattttttttcatttggattttcttggatactgttaaaggtgttcgtttttatgaacatcttttaaattatcttttaggactttttcgtatcttgctctttgttctttttttgatgtagagtctcagtctcactcaggttggagtgcactggtgggatatcataaaatgtttcttgggagatattggtggagttaaaaggaatatgtagggattctgtgacacaggattttagaaatctgggataacaagtacagtcttaggcagctgaaatgagactggatagcaagttccaaagggagaaatacctggaaaaaaaatctggagaaagagactgggaccaggtattatatatgagtgtttggaacactggaaagttatctaactaaaattttagttatttccttgggattagtttacctaattacgcaagagtatacatgtgtaaaatgtgtaggctaatcttcagtgtatagacattttaatatggtantatcttaaaaatcggattttatcgggtttataaataaatctagttgaaaaagtcattttatctgaaggcttctcttaaaagtttttaaagaattacggggaaaattcccataaccgtgtacatttgtaatgtaacccacaactgcattaactcagtttctaacataacccgttgctgagctctagttaaccttgttggattatttgtgcatgtaatatgctgtgcaggctttagaaaataggttaacattattcgaaaacgatatgcgtaactgctgttgaattactcgcttgcattttctttattgggaatactgggacaaaatatagtgttaccttaaatggcatttgctgtatgttatattgctttatcaaaaagcaattaaccaaccatattgtggccaccagtcatgtaagagtatacatatttcatgactaacttttgggttttgggtactttttttaaccaacttctgataggattgcttaaatttgcattttatgattctaaaggaaatccttctagttaggaactagagtagaaactactgtttttggaagccacataaacctaccatccaaaaattccactgtgtcattctagtgtgtcaggcgagatgcgggttaagccagctgttgggccaaagtagtgaacaagccagacgaagtaaaaattaggccaggcgcagtggctcacgcctgtaatcccagcactttgggaggccgaggcgggcggatcacgaggtcaggagatggagactatcctggctaacacggtgaaaccccgcctctactaaaaaaaataacaaaaaattagccggtcgtagcggcgggcacctgtagtcccagctacttgggaggctgaggcagaagaatggcgtaaacccgggaggcagatcttgcagtgagcccagatcgcgccactgcacttcagcctgggcaacagagcgagactc

SEQ ID NO: 231189 - DNA, 693 bp, Homo sapiens
tttggtgtttgttttttctgaattctgtaatatagaaactggttctctttctccttgtttctcaatgacttttaattacaggtagttctcagacaaatgtaagatacttttctctgtccatttcatgcaaaattcatattcagtatcattcaacaaatctttgaatgacttctatgcatccctgttcatggaacccatgccattagaaaatggcagttgggatgtatgaagaaatgtaggatattctctcaaatcattccctaaattatcctttactgctgcaaatttagctgataaaactgcctttggtttatgcctcttggatcagatatttgacctatgtggaatagattatctctgtgcttccggtttaagacattacgccattttagtggatcatttaaattttttctattctgtttttttttgtttgtttgtttgtttgttttaaacagagtctcactcccgagtagctgggaccacaggcacgtgccatcatgcctggccaacgtggtgaaaccccatgtctaccaaaaatataaaaagatagccgggcgtggtggcgcgtgcctgtggtcccagctgctcgggaggctgaggcaggagaattgcttggacccggggggcagaggcttcagtgagccgagatggtgtgacttactccagcctgggtgacagagtaagtctctgtct

SEQ ID NO: 231190 - DNA, 947 bp, Homo sapiens
gttttcttttctctcttcttttcaatctgataggaagaaaccttattctactctagctggtttatgcattcaaagcctttggacatttcttttatgaaccataggcaatgagccttcattctccttggtgatgttttaagttccataaactgagagggaagatgatcttcttaaagtttgcacttccttcagtaggcaagcttgaagccatgttgatatggatatgttttctaaaagtaaccctggaagtgaatataataggaagtaagtgatttcatattgaatttatttgttggttctctttctccttgtttctcaatgacttttaattacaggtagttctcagacaaatgtaagatacttttctctgtccatttcatgcaaaattcatattcagtatcattcaacaaatctttgaatgacttctatgcatccctgttcatggaacccatgccattagaaaatggcagttgggatgtatgaagaaatgtaggatattctctcaaatcattccctaaattatcctttactgctgcaaatttagctgataaaactgcctttggtttatgcctcttggatcagatatttgacctatgtggaatagattatctctgtgcttccggtttaagacattacgccattttagtggatcatttaaattttttctattctgtttttttttgtttgtttgtttgtttgttttaaacagagtctcactcccgagtagctgggaccacaggcacgtgccatcatgcctggccaacgtggtgaaaccccatgtctaccaaaaatataaaaagatagccgggcgtggtggcgcgtgcctgtggtcccagctgctcgggaggctgaggcaggagaattgcttggacccggggggcagaggcttcagtgagccgagatggtgtgacttactccagcctgggtgacagagtaagtctctgtct

SEQ ID NO: 231191 - DNA, 506 bp, Homo sapiens
aaaggaattgccaaaactcacacatctggccaggacagtactggaaatgcggataactgctgtccctgaaagaggctggtaagtgatggagtttaataggaattgggtttgaaggacctctgttgccagaaagcatgagtatctctaaaggcgaagctgagtcagaggttactagaacagaggcatcagcaaaggatgggagaggtgacgagggcgatctctaagtgtacttggcccaggcctgaggagggcagctgattcccccagcaacagaatgctgtgcctgaggctaactagtcattcaagtctgtacataatctccaatgtcaaaactcaacaagcaaccttaagagagaccactaagtctactgcatgtctgcagggtttggcttccctggactgtgaggtcttccagggaagcgaccatattcatagatttatccccagtttctagcaaggcctggaatatagtaatattgtaactctaatatttttgttcagagcaa

SEQ ID NO: 231192 - DNA, 778 bp, Homo sapiens
gtacaggaaggagttgaggagggtgaagagcagcaggggcagctgggacagcagcgtcacccaattgttgaagttgaagcacacccctccacatgcactttgcctaccctactcccaatttacaaatctcctcttccatgaagcagaaggaactttctccctcccctggggacccactgcactctgctgcaagcctggaatgtcacgcatcatgttacattattaatagctctttggccccctcttgctctcaagcccaggggctgattcatctctgggtttccagggcccagcacagagccagtacccaagaagcatttgcaaagttgttgcagtgaatacagatgaataacccggtcccaaagacaatgcaaaccccacatttctgccttccctgaagagcctccctgctgtttcctcctgtgtccccagtgcctgctccacagtagatgcacattaaaagtttgttgaatgaggctgggcacggtggctcacgcctgtaatcccagcactttgggaggccgaggcgggaggatcacgaggtcaggagatcgagaccatcctggctaacacggtgaaaccccgtctctactaaaaatacaaaaaaaaatagccgcgcgtggcggcgggcgcctgtagtcccagctactcgggagggtgaggcaggagaatggcgtgaacccgggaggcggagcttgcagtgagccgagatggcgccactgcactccagcctgggcgaaagagccagactctgtctcaaaaaaaaaaaaaaaaaaaa

SEQ ID NO: 231193 - DNA, 803 bp, Homo sapiens
atcaggagccgtgctgagccacgtgggctttgtaaatttagccagatttttcaaatagagaaactgtttcccttcctcctccctaccttgtcttcagtctacaaggccaattctatagccggcttaataagtcttggcaaactcctgtttcacccattcctatagaaaccttctgtggttggggccgggcgcagtggctcacgcctgtaatctcagcactttgggaggctgaggcaggcagatcacgaggtcaggagatcgagaccatcctggctaacaaggtgaaaccccgtctctactaaaaatacaaaaattagccaggcgtggtggcgggcgcctatagtcccagctactctggaggttgaggaaggagaatggcgtgaaccctggaggcggagcttgcagtgagccgagattgcgccactgcactccagcctgggcaacagagcgggactccatctcaggaaaaagaaaaaaaaaaagaaagaaaaaaagaaaccttctgtggttgggagcagagccttcccgtcagcaagtggtctaagcaaaggcaaccccagcgtgtcccagagggccccaccaacttccgcccatttttctgataaattgagtgtttccattcccaggcaggcagtgtgcccacggcagtggctcagtcctggccgacaggatacaactaaaggaaatgtgctagcaatgggctttctccagggctctccagtgggggtggctggcatctggcctctggggtgggatgttcccatgcagcattgggtttggaggctttgctgagctgttgacag

SEQ ID NO: 231194 - DNA, 461 bp, Homo sapiens
catttatttaatgaaataaatttttaatttatttcattgtatatatgcgctataaattgtccattcacctgatgatggacactttggttgttcgaactttgggcaattacaaatgaaactgatatgaacatatatgtacaactctttctgtggacgtatgttttcattacttctgggtcttccttaatatatgtcagcagtggagtggtgtgcttaaggagagagagacttggaaaaatacagaccgagaacaaggccatgtggagatagaggcagagactgaagttgtaccaccaaaggcaaagaatatcaagtattatcagtaaccacaggaagctggaagaggccaggaaaggtttttcttagagaccttggaaggagcctgaccctggaacaccttgaattttagacttctgaccctcaaaattgtgaaagaataaatttctgttgttttaagcaaa

SEQ ID NO: 231195 - DNA, 1279 bp, Homo sapiens
gcagagccacgagggaaccgctagccagtcctgggtgaaactgacgctgccaggcaagtggcgcgcggggatcccggtttcccagcccccttccggcaggcagcagcccgggcgggggacacactccgtgatcccctcctggctggaggggtcaggcttggtggacccagcaagcagcctgatggagaaggtggcaccagacgcagacccctaccgtccaggaccgcaagccctcgccggctctgcgtgcttttaggttttgtctccacctctgcacacccacactcgcctcctgggccgcgacagcttccttctgtcaatcaggtgtggacgggaaggtctcgaagtttcctcgcctgagttgaaagctggaggtgggggcacctctgcccgttcctaactgccccgttataaggtccccctccccacaattggttctcacctcgccctcggagctcttgggagatccctccgtccctcctactgtgccctcgggcagatgagtctggtcccagcttctggactgcccactgtcggccacttgagagttggggacggtggggcattgtgacgctctccaaccttggaacacggtggcaaagtggccgatcaatatatgggacaagtgggggcgggggggcggactctaaggtggaaaaaacaatactacttgggatttaaggaagcaatctggattctgtctccccttggttcttcggagcttagaggtctaacggcgacattcctcctacagtaagggctcttctgggtccctcgtttccaaaggcatgaaagttctgacctgaaaatgggggccggggagggtgatgtcacaaccatataacgcagctccttcagccgactcccacccgcaagaactgagacctgacggataaaagcagagaggagtcagagtgagcgctgcgtttgggaaactgcattccagggcagcaagactggtgccaagacggagtcgtggcaaaagcatccggaggtcttccttaatatatgtcagcagtggagtggtgtgcttaaggagagagagacttggaaaaatacagaccgagaacaaggccatgtggagatagaggcagagactgaagttgtaccaccaaaggcaaagaatatcaagtattatcagtaaccacaggaagctggaagaggccaggaaaggtttttcttagagaccttggaaggagcctgaccctggaacaccttgaattttagacttctgaccctcaaaattgtgaaagaataaatttctgttgttttaagcaaa

SEQ ID NO: 231196 - DNA, 1102 bp, Homo sapiens
aagttcagctgagcttcgtgtagtgtctgtcccccaccctgacctggacccaccagccaagccgaggccagaggtgtgcggattttttttaagacccacatcttgtaaatgtgagatttttatcagtcagcacagatgacttaaagcgttccatttctccgcgatccaattttattaggatttactctcatttgtgctccgcttctctggggaaataatgctttgattaatgtaatcctggcccgggatccgccacatgcccctcgaccctctcccaagagaaggaccctatttgacaaacaataacagagcagtaactcttgcaatctgcccacacctttgggggtggctggggagagggtgatacacgttcacacaccgcttgctaaatgcagtggcgagaggagggagcagcgtctacatgaagcgaacttttcaagcgcagagccctgactcccaggcgcgggggctcaccgggaggggcccgggcgagagagcgcgtgggtgcgtgagtgcctgtgtgcgcccgccctttgcttgctcggggtgtccgcctttgtcccccgccgcgggcctccacggtgggatctgcgcgcggccggtgggcagccctcgacccggggcgcgtccacagcgcccacccgcggcccccaaacacctcgagagcagatcttaggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctgcgcctcgcccttgctgcgggctgagagcgggtacccccccttccagctcttcctcctcccgcgcagccgcggccccctccccgaaggaagaacagctcaattacgaagaggagccaaggaacgaaatcccaggctcagaggcgcccgccgttgctcctctgttcccggtccctgtagtgcagtccccacccccaccgtccccagctcggggagggcggggacgcggcggtgcgaggggtcctgccctgctccgccg

SEQ ID NO: 231197 - DNA, 393 bp, Homo sapiens
aattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaa

SEQ ID NO: 231198 - DNA, 161 bp, Homo sapiens
tctgagttgagttctggaagatggagaaaacaaatttccgtttttttgtttcccgtgggctaggagcaagttgtggccaataacctctctcttgacttttctttctcccgccccctgcatccctggctccttctcaccttcaggcctcagtaggaatcttc

SEQ ID NO: 231199 - DNA, 2189 bp, Homo sapiens
gggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattaatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagca

SEQ ID NO: 231200 - DNA, 2394 bp, Homo sapiens
gggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatat

SEQ ID NO: 231201 - DNA, 2080 bp, Homo sapiens
cggtacccctccataatgtgtgcccataatatagaattaaaaaaacaaaagacatggaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattaatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatat

SEQ ID NO: 231202 - DNA, 2485 bp, Homo sapiens
gggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattaatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatat

SEQ ID NO: 231203 - DNA, 446 bp, Homo sapiens
acaatacctaactaccagaactatcttgcatgaagcacaaaatttctgtagtggtttgactacagatctattactagggtgatagccaaacttgtagtattattattgcagctttgaggtgtataagatgtttctttaaaacctcaaggttttaaaacattcagaataaactatatcaacccacacattaacaaacatttaaatgtcaaataagcagaatatcctttaatttctaaccatccctttgcaaaacccattccaatgttggtttctataaaatatactggggccttgttagtttatacatacaggatatatgtatatgtatatatatatatatatatatgtaagcttagaattatgtagcaactgctgcacagattggaacagtctatgtatgtctttcgctataatttattaaaagaaatttcaattcaataagtaaa

SEQ ID NO: 231204 - DNA, 456 bp, Homo sapiens
catgccatatgagtttgtagcccaggagcaataggctacaccatctagcataggtgtgcagtaggctataccatataggtttgtgtaagtgcactctgtgatgtttgcatgatgaaatcaccatgtttctcagatgatatctccatcattatgtgatgcatgactgtaaatccttgcatgtatggtcaaatgatttttgacaagtgtcaagaccattcagtggggaaaaggacagacttttcaacaaatggtaccgggaaaattaaatgtctgcatccgaaagagtgcagttggacccttaccttacacagtatacagaaattaactcaaagtggatcaaatacttaagtattagagctaaaactatgaaactcttaggagaaaacagggataaagcttcacaacataggatttggcagtgatttcctagatacaacaccaaagacacagaaaaaa

SEQ ID NO: 231205 - DNA, 694 bp, Homo sapiens
caggtgagcctgtgggtagacacccatgttcccaagctgctctgacctcacggaggggaccacccacggcccctgggtggaagagtgcccaagtcctttctttggtggaaacacagcaggtcctgggggaggctcccaaggtggggcctcgccttggagctgggtggttcttggagtcacagggtgtctgggccaggtgcagggacggcccttctagggctcttgggtcaggctgtccatgtccagcaccttcacacaacaaagacggcttcctgcccccacttcaaggacttctagcctcctggggttgaggggggactcttgagtttttgcacagactcacccaaatgagaatctccctctgatccctttgtcctttccaactccaggaaggcccaagtcagccatccctaagtaacagtgctggcacctccatcacccacgcaggcgagctcaccgccaccccccgccctaccccaccccgccccacctggactcaagccctaccccaaactgcccagaaggcgccaccaaggacatgggggagacagcaattataggccctggaccggtcaggctgggcctcattcagtgactggctcagacaggtcaggcaagttgtctgcaggcacacagcatggctgggccgtgctaggacaagagagtggtctgaatccggggcctggcctggccc

SEQ ID NO: 231206 - DNA, 574 bp, Homo sapiens
gctgacatgtcctccctctgatgtttctgcagtgttacctctttgaggatggaggtgtgagctatgactaaactggcaaatcctgtccccacctgcaaatggaaccacagccaaagggtctccctcgtccctgactctcaggcacagagcttttccccatcgtggatctgaagagcactcggaccctttagctgtggaagggattcacagaaggccaagaaagggttgggctgcgacctgtgacctcagaccttcgctggcttcaggactgggcttggcttccctccccggcgcaccttccgatgatgtccctgaaggaaacctggccccggggtgcagtctggtgctgcggcattggtcttctctgtggtgtggatcctctggtggtgcaagagggcagggcgctcacggaaggcgcggccacactgcgtgcacacgaagggcttctcgcccgtgtgaatgcgccggtggctgagcagcacggcgcccttggcgaaacccttgccacagtccacgcagcggaagggccgctcgcccgtgtgcaggagctggtgctgggtgaggttggagctgc

SEQ ID NO: 231207 - DNA, 495 bp, Homo sapiens
agttgtcagtttatgggaatgcctctttctcagactgtgtgcttcttgaggctaaggaccctgtatttcatcttcataaccccatcacttagcacagtgatgatcataatatttggtagtgaaagaagatctgttggttgctgaacacattgtattataagacccatgagaacagtgactctattgaattcagttttctatcttgaacagctagtatatttcctggctaaaacaatgtggaatagaaaaaactataactttgtattttgtggaaaaatgttacagacatcacctgatttcaaccttccataagatggcttcatgcaatagtagataggggagtttattatcatcccattttacagatgaggagacaaaaatccagagtgatgaattaacttactaaaattcactttacttaacaaaacttgtaactatttagagatagaccgtgcaaggttggtcatctatgagttaggaaatgcccttaaaaat

SEQ ID NO: 231208 - DNA, 581 bp, Homo sapiens
catggcattatgttcttctgcaacaattgcaaggtgttcagattttgtaaatctaaatgtcataaaaactttaaaaagaagtgcaatcctcacaaggttaggtggacgaaagcattccagaaagcaactagtaaagagcttacagtggacaattcatttgaatttgaaaaacatagaaatgaacttatcaaatatcagcaagagctatggaataaaactattgatgcaatgaagagagttgaagagatcaaacagaaatggcaagctaaatttataatgaacggattgaagaaaaataaagagctacagaaagttcaggatatcaaagaagtcaagcaaaacatccatcttatcctagccccttttgcaggcaaagagaagcagttggaagagaaaatggtatagcatttacaacaggatgtggacatggaaggtgcttcttaaaaatctctgtaaccatttctttatgtacatttgaaaaagccccttggagaattagaactgctaaattcttagtttattttttacataaggtcactcaaatgaaaagtaattaaaatatatttttcctacattactgt

SEQ ID NO: 231209 - DNA, 273 bp, Homo sapiens
aatgacgcctcgtttttagaaagtactttgtagttcttttaaaaatccacttgaaatacatgaatagacagttcacgcaaaaatgtataaaaaatggctctcatacaaatgaaaaaaatttcaaagttactcataattaaataactacaaattaaagccacactgaaataccatttttcacctatcagggtggcaaaattatataaaatatgacaacatattctgttggtgaaactgtagataaaattagtatgtcccttctgtcgtcttctc

SEQ ID NO: 231210 - DNA, 340 bp, Homo sapiens
caatctcttactcttgaactactttatcactttcagacactatttacatatttatgactacttcctgaatccaggactcaaaagcttcttgaaggcatgagctttatacttcacctctttgtatactcagtaagtatctagcacagggctatgtgctcagaattctctgtaattgttcaatgattatgtttctcaaatgaaaaggctttattgtccattctgttctagggcctcttcctggagtgctttagtttgcttagtctttcccaccctacagtagttgttcccttcccttccgcccttcccttgcttctacttgcttcctgagacctgctattaa

SEQ ID NO: 231211 - DNA, 1138 bp, Homo sapiens
catgggaatgaaggaggatctactttgtttttatggaccttaatccttccccatcctaatccattaaagggacagatggaagcattgtctttaggaagagctgccgctagggagctgtatctgtgcctaacatttgttttttgcatctatggtcctgagcacaataacattaggatttgagttgttttacatccagatgaatgaacattccaatttacagaccatgatgaaagatactttctcccttgactcttcctcaagtttgctgtaccccattttgctgataacagtggtccttatctcttaggatggggctgcttttggcatctaggtgagaaataaagggtcttgctaaagatttctgctgttctctaaaccagtgtttctccatcttaacatgtacatgaattatttgggagcctgctaaaatgcatgttttgattcagcaggttcagggcaggacctgagattctgtatttctcactagctgccagggcaagccagggaccactttgaggagcaaggctttagtcctaaatagtcaagattacagaatggtctttatccagttttcatagccaccaccagatggcagcatgtccactttctctacctgatgttgctgctcagctctttccttgggaccaagaagcgcaagattggagcctttgtttttctcacagttgtttgtgatcttctctctgatttactagttcttggccttttcgagtcagcttacatcaggcctctgaatccttatctttctggtcctccagtggggagccagctgctttctgctgtgctcagcaccaggacagtgcctgttttcagtatatgcaggcatagggtattgacttaaaggatgtctgtcatacttcttcctttttataaaaccaatctttttatatacttagaaaatttatgaaatgtagaaaagaaactattaattatctgtaattgtacctgccagaaaaaaattaatgtgtttgtgatttggtcatttagtcttattccatgcatttttagttatatatttatattttcttttataaaatgtgatgagaatgtaaatttaaattgataaaaatgtatgtaataaaacctaacacttttgctttttaaaccttataaaaagatt

SEQ ID NO: 231212 - DNA, 443 bp, Homo sapiens
acttctgtgagcataagccgagaaaatggaggtaaactgcttagcccaatacttggattatcgtaaatattcagtaaaactagccaccgttgttattgtaattattattttgtattttattatacatttcatggaaacttaaaagttagtgataatcacctcattttcagttgccttgctttcttcctgtaaattttattctctcttatcttgctcactgtctttaagcattgccagtttagtataattattttcccctatcctctataaaatcatatacaggatggatttgttgatctcagacatgttcactgagttttaaaatattaggatgaaacctgaactaggtactcctggaacaaatatgaagaagtgctactttgtgtcaaaggtagcaaacaagaatgctgtcttctaaaaacaggaacttccactagtgttca

SEQ ID NO: 231213 - DNA, 210 bp, Homo sapiens
tgggaaaatgtcaagataagaatgtcctggaaagagaagagaggaaaaaatggaggaaaaaagagagaaaaaaagtgaagaaagaatggccatacacttcgcaattatggtgaaaacacatcaacttaccaatctgaaaagcacattataccacaagcaggttaagtacaacaataccattcctgggtatattaccacagtctaactact

SEQ ID NO: 231214 - DNA, 475 bp, Homo sapiens
ttcaaatttaagaaggcgcgatgcaaatagcatgttggcataaacaagtgctgcccgctcaatggagggagggagcctttcttctgagctaatttaagctaaatacatggcagctatttttcatctctacaattgtgcaactttctcctcagtttacaatacaggggagatattatcgggcagaagttggatgggggataagtgaagacgagaaggaaaagaagaggcagtggacaagaaggtactctcagccaccgagctggtgattagaggtatttcaagagctcaggagtagagctggtggtccactaggacctcaagatcttatctgggtggaaacttgattttgagccttccattcagggaagaaaccaaagagcaattggagtcaggctccttttcctgccctttatatgcagcaccccctgacttcccagaagcccagactgaacagcagaaattttacaaacctcct

SEQ ID NO: 231215 - DNA, 464 bp, Homo sapiens
ggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctgcgcctaccccgcgcgcaggctgcacggtccccgcgcgcccgcgctctgacccgctgtctgcgcgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctg

SEQ ID NO: 231216 - DNA, 343 bp, Homo sapiens
cttaatgcatatttcggcttgtgtatccatgcacctacctcagaaaacaagtattgtcaggtattctctccatagaacagcactaccctcctctctccccagatgtgactactgagatcaggtctgagtgtttaatttctgattttttcctctgcatttacacacacacctcacatgcacacacacacaccgagtaccagtataagtatctcccatctgcttttctccattgccacgtgtcctggtcaagcccccctcactctgtttcctgttcagcatgtactcccctcatccaattcccctgtatcagtcactgccagttaataaacctttgcaaacgttc

SEQ ID NO: 231217 - DNA, 251 bp, Homo sapiens
tcccctacaccaagacaaataataaccaaatattgaaaactagtaataaagaaaaactctgaaaggcagtcagagattaaaaaaaagacactacctacggagaaactaagataataaagaatgggccgggcgcggtggctcacgcctgtaatcccagcactttgggaggacaaggcgggcggatcacgaggtcaggagatcgagaccatcctggctaacacaatgaaaccccgcctctactaaaaatacaa

SEQ ID NO: 231218 - DNA, 323 bp, Homo sapiens
gtgcacacgcacacacacgcaagttccctcagtcagccgagaatcctgccatctcttttagataacaaaagctcttaggccttatgctttgggtaggatttgtcttccatggacaggtattcagttgggaacaagtatatagtcactgcctctatggtatggagatactccgatttagtccctctgcctcttggggaaaaaaaaaaaaaaattgtaaacatccccttcagcagcttctcaagtccctgtacagtggaggaacattacacgtgaacttcctggattcaatggattcttctttgcaagaaaaaaaacaaaacaaa

SEQ ID NO: 231219 - DNA, 403 bp, Homo sapiens
gcggctgtatttatttcccattccacatgtactcccgtgtgctgtccatgtgatctgtgaaaatttaccaccaccgcatggaccagtcccattagtccagaattcatttggaataatgagtcctaaaagttgaaaactttggctttttatattgttcttaacccttcagtcaccatcctttcttgccaaatgtgaacaactttagatgtctaaggaacctacttctccaagccacttctgccttcacatccacaatctctgcctcttatgtatccaagaaaatcagtgcatgggcatgggactcagagtagagataggtcacctttaaaccatgttttactcaataatgttctgccaactccttcatgcacctctagtctcctggaccttccaccccagctca

SEQ ID NO: 231220 - DNA, 199 bp, Homo sapiens
gccgctgctgtgggccggcttttccatcatgggggaaggggagagcccgcttgagaataaagcaataaagatataagcagagaggagagaaaggtggagagatttccgatgactttgagttctggggccaagcatgcctaaagccaattatactcttgaacatttgtttcatgaatcaatatacttcctttttggctta

SEQ ID NO: 231221 - DNA, 383 bp, Homo sapiens
ttttcttcctgtattctttcagtttattaaagtattttttagtttaccattttctcttctgttggtgtgttagctatatttctttgtatattttagtcatttatacactaaaaatacaccgttaacttatcacagcctaccgtgaattaatattataatgcttcctgtataaacagtgtaattatctgtgtaccttctatttatctttgtgctgtcatattcacacactttcagtcttcgtattttatgaattccacaatacattgttattactttggcttttaatagtcaactaacttttaaagaattcaagaaaaaaagaaaaattaccttccatcttattctgtagtttttcaataaatgtaataaataatcatttcctc

SEQ ID NO: 231222 - DNA, 403 bp, Homo sapiens
ccttctaggactttattttttcatttgacagccacagaagctgactttggctgaattaagcaatgaagaaattaactgcaaaggttattaggtatctgatagaattatctgaaatcatgttgcataacttgcccaatgagaaaactgtcactgttgctactatccctatgtaaccctagatgcaattgttgctagtcattgttccctaccaataccatttctgattcagaaatggaaccttaaaatcaataagaaatggctgttcctgccactagtgccaaaaaaaaaaaaaaaaggaagcttcaggcagaactggttttctcacattgctcttttctggttttctcacattgctcttttctggttggccaaaaatacggtatgtcccttctgtcgtcttctc

SEQ ID NO: 231223 - DNA, 456 bp, Homo sapiens
attgccacttcactaggccatcctccatttgaagaataggaagaaaagggagaaaatcttcccagagagaacactgcctctgtgacactgtttattcggcttggctgtaaaatgtggaaagtaatgcatgtttaaaagaaaagatgtgtaatttacagcttcttaattcataaagaattcagtgaatcatgttggccctgttggattctggagaagtctgaaaattggccagagtcagcaaaggtttttagaaagctatgcattttaatctacttgaaagttttggactctgaatgtcctttaactttgaaagtatacatatgaaataccagcatgtggaaatttccactctgtcccaaccagctgagactgtcctttgagcaaaagaaacctcaggcattgcctctatttctaaggcattgtttttcttaaataaataaaatgaagaagggcttt

SEQ ID NO: 231224 - DNA, 563 bp, Homo sapiens
gactagcagattcttatctgtgggggaggacacaggagcggatgacacagacccctgctcagggaccggctagagggcggaatgcctgggccccggccctgtctgcttcctgcttcttccccgaagttcatggcctgtccgtccacatgggcgggaggtgtcccgcgagcagccctcaccctgaccttggctgctttctccattccattccccacccctcctccctcctgacacccatggcattttttcagataagttaatacctttgattaggttccagccaaacctcaccctttctctttccccatgcctttgtgtctctcttcgtctgatgtcgagtctacaacctaatgctttgaagacagactgacttccccgtccttggtcagggggttgctgctgcgtggggggggcggtaaccataatcttgcccccgtgtctcatacacaagctgcaagcttagctcagaagctgtgcctgtcttggctgctttttcttgctgtcttccctatttttgcaggagttttgcacacggtcataaaagttcaggagaaacatgaaac

SEQ ID NO: 231225 - DNA, 460 bp, Homo sapiens
cctgcctcagccttccaagtagctggggttacaggcatgtgccaccatgcccgtctattgtattttttttagtagagacggggtttcaccatattggtcaggctggtctctatctcctgacctcaagtgatccacctgcctcggcctcccaaagtgctgggattacaagtgtgagccaacgtgcccagctggaaaaagatagatctaagcagcttgggtaactataaatggaagcagcagggggatttgagacccctgcttggggcctttctggcccaatataccagggcttagcaaactttttaaataaagagccagatagtaaatattttcagctttgcaggccatactgtcacaactactcaattctgcagttgcagtgcaaaagcagccatagacaatatgcagataagtgtggctgtttttaaataaaacttattcatgaacactgaaatatgaa

SEQ ID NO: 231226 - DNA, 273 bp, Homo sapiens
ggtgtgagctcaggctaagtcaagtgtaatttccttcaaagaatgacttacgctttgtgaaatggacatctctaactcatgacttctattaggcaaaggggggcattaaggaactacactttctgaatcaaaacttagagcacatgtttggataataaattagataattgaaagaagagctgacttagtcttagtatgtgaaagctttagttaccaagtgagacataaatggcattcattttctaatagaaaataaaatctttcagaagaaaa

SEQ ID NO: 231227 - DNA, 405 bp, Homo sapiens
tcaatctcctgacctcgtgatcctccctctttggcctccttaagtgctgggattacaggcgtgagccaccgcgcctggccaggttaacattttttgaacattttaaacttacataaaaattgataggaaaaaaggcagacaatccattagacaaatggcaatggatataagtaggcgattcacggaagaaaacattcggaagtggatgctgagcgtctgagtagatactgacccaaggcaatgatgagatgctgctctcaaccagcaagggatggggaagggcgaaagcacagctctgtgctggggaagtttcaggacgcttctgggctggcagacccggtgaatgggaagtgggaactgctagggtgtttttggaaagtaatctggcagtgttttcaaactgta

SEQ ID NO: 231228 - DNA, 479 bp, Homo sapiens
acttatctgtaacacaggtttaacatgtgtgttcttttctggcacaaacaccgagtcatttgttccttatggcaatgacaaatctaccccatgtagagtaagcaaagaggaaactaggttaaaggacaaggaataactgatatcttaggaggcaaagccctggtacaaatagtttgaatataaaggcaaactgttgggtaagaggctagtgtccctttaagtgggattaagatcaccatcttcatgattacagagtggcattcatttgcaattttagtgtaccatctgtgacacccaaccggagtcttaaatttgcctttttgttttttcggtttgttttttctcctttcaataccagctaaagtttccacagtgtacttgttgtttcaaaatctacaaactgttcactctgcagttgaattactttactttgctatctccctctcatttaacacactaatgcaagtatcttagattta

SEQ ID NO: 231229 - DNA, 570 bp, Homo sapiens
ttcatgatctcacaactgagaaggatccctccacattcttggaaatatacacccattggaacccgtaagcagaccatgtgtcaacgtatgcagagtttgtgcagacacacagaccctctggggagtatatgtttgaatctgatgaagatgagcagttatttgtgcacctggacaagaaggagatggtctggcatctgtgagagtttattcacactgtgtcaaactttctcagtcagaagttgacataaggaagtcaccagcttcggtctcctttaaatctccaggcctaactttcttttgaatctctgctcttcaaccacaatgacttatgtaccccaagacccctctacctcctggctgcctatgatcctcctgcacctagcactcagcaaagggtctgacatttagatagccctcaatcaatatgaagaatttaaagtgtagtgacaaggtggtgcccacactggatggtctgtatgctgtggtctcatcaggaacctttctctgcactgcatttttcctgagaaatcccagagttcaataaatacctgtgtatgtcagagctagaca

SEQ ID NO: 231230 - DNA, 440 bp, Homo sapiens
tgagatatgactgtttgacttctccttgctcctcagggaagaaaattttaactcagacatcttaagcctttccataataattgttcaatatgtcaataaatgtaagtaagcacccatcatatgaaaaacataggacctattgggcaagtgtcacagttgagtcaaaagaaatacagcttctaggtcgggcgcggtggctcacgcctgtaatcccagcactttgggaggctgaggcgggcagatcacaaggtcaggaaatcgagaccatcctggctaacacagtgaaaccctgtctctactaaaaagatacaaaaaatgagctgggcctggtggcgggcgcctgtagtcccagctactcgggaggctgaggcaggagaatggcgtgaacccaggaggcggagcttgcaagggagccgagatcacgccactgcactccagcc

SEQ ID NO: 231231 - DNA, 435 bp, Homo sapiens
ggagggagtccctggcagaatccagccagcctgcacactcaggtggagccttgggaagtttgcgccatttgcagcagggtggagcctgtcccctcctcttcctgtgtggaacctgggattcaaagggcgaggctggaagcactctagcagggaattccggccttgcagagagtacctgttttcccttttttccttctcaccaaataaaaccctgctttactcaccctttaaaccatctgcaagcctaaactttcatggcatgggacaaggatcccatctttaactgacctaagaaaaagtccggcaacaatgttgaagtctattatttaatctgtatgctggtcaaatatgtatactcatgttctgtggttttgttatgctatacacttttctctgttatatttaataaaatgttcaataagcagttaatatgac

SEQ ID NO: 231232 - DNA, 467 bp, Homo sapiens
cctcttttggcagatgactaccgattggattagtggttgtcacctgacttaagctgagccaatcagattcttttgctcgagaactttctttaatggagaggctaagaaagttgtcagttggtggagctcttaaggtcacaatcagatttagaaatatcagtggccaattcgaggtggtgggcaaagagacaagcaaacagggcagaagaatgaagctaatattcagggagaatcagaaatgagagctcaaatggctccttgagggctgggggggttatctcggctcccagtgcagttatcaattccagttaattgagtgttcattccattgagatcaacaggtatttattaattgctttctaagtatctgatcatggttctgcatgaatttcacttttacttcatgctcctatgggttttggagataaccttggacccatgtaataaatacttctttacttgtgcca

SEQ ID NO: 231233 - DNA, 651 bp, Homo sapiens
attaaaatgttaaactttgttcatcagaagaagccattagaaagggtgaaaaaaaaagccatgggatggggaaagatatttgtagtatgtatcactgaccaagggcttatatacaaattgtgaaaagaactcttatgctaaaaaggcagacaactctggcatttcacaaaagagggaggaagggagattccgtaaatatgtgacactagattcaccccagtagttataagggaaatgcaattcaaaccaccatgaaatattgtaagacatacaccaggttggtaataattttaaaaaccagtggtaataacttaaaaatccagcaataccaaatgttggtaaggaggtaaggatatggagcagcacaactctgatatactagcagtgatgtgaatttagtacagtcactctggaaagagtttagtattttctaataaagttgaagataaatgtgttcagtgacctagcaattccattcctacatatgtaccacctccattcctaagtctttaccatggagaaaagcatgcttatgtgcattaaggatattcacagcagcattgttcttaatagccaaaaaactgtccatcaagagtaaaatggataatgatgaatattataaacaatgaaaataaactttggttacacgta

SEQ ID NO: 231234 - DNA, 806 bp, Homo sapiens
gttcaccctctcctgaagctggcctctgtggtccttgaccccatcaggtcccacggtgccctgcatggactctgccatccttcaccagcttccccccatcaaacggggcttgctgtcagctcttcctgcaactcccagccctgccgcaccactcagccttcttccttcaggcttcagctccagtgtcttttcgccaaagaagcctttcctgatctctcagccataaatgttcctctccccagttgctttttccctctccctctactcagttgctttatttaactgtcatattgtctttggagcacttgccaccatcagaaattatcttgcattatgtatttatagtctgtcttccgcctactagatggtgggttgcttgaggcaggaactctgtcttgtttacatctctatctccagataacgtgtctggcacgtgatgggtactcagtaaatacttgtggaataaagaaatgtcattacaggttctctatgcattaaaattttttagaaatggggtgttgcagccgggcgcagtggctcacgcctgtaatcccagcactttgggagactgaggctggtgtatcacctgaggtcaggagttcaagaccagcttgggcaacatggtgaaaccccatctctactaaaaattcaaaaattagctgggcatggtggcacacacctgtaatctcagctacttgggaggctgacgcagaagaatcacttgaacctgggaggcagaggttgcagtgagctgagatcacacaactgcactccaccttgggtgatagagtaagactctgtttcaa

SEQ ID NO: 231235 - DNA, 473 bp, Homo sapiens
ttttgctaccctttccttctctacggacaaggggaaaacaccagcttgaggtgagataaacagtagttttaggagacattccctctgcagtgtgggtcggaaggatctcagacttaggtcactgttctgggcaagctctaggggcaaagcagacacaggagccgagaagccaggctctcttagcctttgcacaggcccctctgcctggcatgcctttccttttcagtctgacagactcccaccttagccttcaaagcccgaccaaatgtcacctcctcgggaagcgtgggctacctgccttgatgaggctccacttcctggagctactcttccatacagaccccatcctagcactggccacacacccctccctcccgctttcctgcatggagggctgctaaggggcagaaaggccaacatgccagcacttgtcaatcataaagagccagaaagacaaaaccggaagtcgacgg

SEQ ID NO: 231236 - DNA, 752 bp, Homo sapiens
ctgagttaggtgttcatgatacaaaaaaagctgctttgatttttttcatttaattttaatgattttggatgctggccttgacaaatgttcccatattgtttaaattttgtttcttaaaatagttctattgaaaatgttataaaggacattattgaatcaactggcaaaagtggaatatggatggtagattaagtgttgataaatttactgaaattgctaactactctggttatataacataatatccttgtcttaacaaatatgcaccctgttctcagtactcaggagaaaacatattgtatgtatatatttaaaatggaagggctaatgataaagccaatggggcaaaatattaatgacaagtaaatcttggtaaagggaatatggaaatactactcttattcatgaaagttttctttcaaagtattaatatttccaaataaattgtttaaaacaaaacataaattcactggccggttgccgtggctcatgcctgtaatcctagcactttgggaggctgaggtgggtgggtcacttgaggccaggagtttgagaccagcctggccaacatggtgaaaccctgtctctactaaaaatagaaaaaattagccacacatggtggcacatgcttgtaatcccagctgcttggcaggctgaggcacaagaatcgcttgaacacaggaggtggaggttgcagtgagctgagattgcaccactgcactccagcctgggtgacagagtaaggttctgtc

SEQ ID NO: 231237 - DNA, 805 bp, Homo sapiens
ccttcctttttgtccgataggaagtactattctgaatctaccagcaaggctggcatgtgctctcttataaaaggaaaagacttcaccatgcatagcctcttcaccctaactgctcagttgtttgctacccctggcaaggatgttctaattgtgcagtggagggtgtgaactcgttgctttaactgcagttccattagctaatcggagtcctgatgtcagtgtgacattgtggtgtaaatcatgaaggggtttttctgccacttcctgtggagagaaaacagttttgcaggatcacctgatgattggccattgtggggttgtcttcttgaaaaagaaaagttgttctgacctgggctgtgctcaggatgcctacattttgcctttgcaaagcgatgaaccccccagaaaggaagtgtatggggggcactgttggagtctgagtgctcccttccctcagcacttctggagaagcctggaaatactgtagacacagttttggagaagagaattcaaagggcttacaaaaggagagtacttttttgtccacttctctagaagaggcacagcaacttgttgagtttgtgttgtgttgtgttgtttttctgccaccaaattaggtgttcctattgtgtgggaggtgaaaaagagagcacaaatctattaataagtaaagcaactgaaacaaagggaaaaatgaatccccattttgcttttttgcaacattacatccagttaataaaagaggcttacaaatccaacagagatctgcttgcaggaactaactaggaagaagaagaagaagaag

SEQ ID NO: 231238 - DNA, 928 bp, Homo sapiens
  misc_feature (22)..(22): n is a, c, g, or t
  misc_feature (53)..(54): n is a, c, g, or t
  misc_feature (56)..(56): n is a, c, g, or t
  misc_feature (63)..(63): n is a, c, g, or t
  misc_feature (72)..(72): n is a, c, g, or t
  misc_feature (76)..(76): n is a, c, g, or t
  misc_feature (81)..(81): n is a, c, g, or t
  misc_feature (84)..(84): n is a, c, g, or t
  misc_feature (86)..(87): n is a, c, g, or t
attctgctacgaaggatggagnatgctgtctggcgtcataacttgtagaaggnncnattagantatataatngtgnagctncangnncagctgactgtgctataagaataatgatttaagatcgagccaagagttaactgcccatctcaccaaccagtggccttctccaggagctctggatgtcaatgctgttgccttggatacgttgctttaccgaagacacaatagacagtggtatgagaagagttatcacagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaa

SEQ ID NO: 231239 - DNA, 382 bp, Homo sapiens
tgatccatccatctcgacctcccaaagtgctgtgattgcaggcgtgagccaccacgcctggcctcggcatcccctttctaaaggacatctcaaagcacagcgcggcccctcagcacagacgctgctatcacagcagaccttactgaggagtcagagcctgtgggggcaccatcagcaggggcgctcagcccgtgccacactcagtctcgttagaggagaacgaagggagtgggctcccacagaccacattgcactgcgacaaggcaaaccgatggtgtgctcgggcattcgggtggacagactgcagatcccactgagaagggaggcctcggttatctgatttaacacgaagaaaccagtcacacacacaaacatgaaggca

SEQ ID NO: 231240 - DNA, 2230 bp, Homo sapiens
  misc_feature (779)..(779): n is a, c, g, or t
  misc_feature (897)..(897): n is a, c, g, or t
  misc_feature (1148)..(1148): n is a, c, g, or t
  misc_feature (1574)..(1574): n is a, c, g, or t
  misc_feature (2210)..(2210): n is a, c, g, or t
  misc_feature (2213)..(2214): n is a, c, g, or t
  misc_feature (2216)..(2216): n is a, c, g, or t
  misc_feature (2218)..(2221): n is a, c, g, or t
  misc_feature (2225)..(2225): n is a, c, g, or t
  misc_feature (2228)..(2229): n is a, c, g, or t
ctgactctgtctgggcattcttcctgggctagagatgctctgcctcccagcagaagacaagagccctagaaagactgtcattcatttactggagagagaaatggttcatctacacacacactcagagcctggctagctacaaagccgtggtccgtggtaggatgtacgtcttagtggaataagtaaccttgagcagacaatggatccagcagtaacaagcctgccctgatgccggcgtaaattccgaaggagctggagaacgattcttcccttcactttatctaaatcctctgaaggatgagtgggaggatggtttcttctcccttcctgaaggttgttttgttggtgccttatgctaagagaactcagcagatacaaatttattattttcttttagacagcattttccctgcagttagaagaaaacagcagctcacattgaaaaatatctaattcccaaaatacgtgattccaatagggagtttatagaatttgcttcttaccaaagcaaaatcttgaatacatgaaatctaaaatcttgccaatttaatgaatgcctaataatttttaaatagcatatatcattttaatacattaaatagttggaagattgttgagggataatttgtcaattttttattaaaaagaaaattcataaaaattaaatattctacatttattttatattattatcttggcaattttattttttatgacaaaattctgagtctgttatattatccaaatcctaaaaagatttaattgattacagaaaaatntattgggaaaaattgctttgcccctcttttttctctaagcaattcctgagttttaaaaatactccttaaaggaactaatttatttttcatggcccatcaccaatatccaagagagtanccaatttttaaattctgaaccctgtcttgtgtgactttcaaactaaatgaaatgaagaggcctcaggcagtctgtgtttacacagggtggcaaaattaaccttaagttacttggatcactgcactggggacacttcagagcctctactcaggctacttttgagcatactatgtatgtcgctgtgcagaagcctacctctttcactctagataaaacaagactttctgagcacttactctgagcaaagcacngtgccgcaagtacaaaggtggataagactcagtccttgatttgatggtctttgttggaataggttttcaaactgtaatgtcactgtgtctcccaggggccaaaagtttgctttcattgatgggtttcaaagtagggatgagtttacttataagtacacattgtgtcattagtatgcttgactctccatggtgcaaaatttctttctaatgctgatcaattgcaaacatgatagaacaatgaaatacttccaggacattctaaatcactctcctccttgtgagaaaatagggtagagagcctagcctggtacaggcagccatccatgtctgatgtgggtcatctctgagaatgacactcctcaaagggccagagggtgctctttcttcatttcccttacacatgggtgttattcaatacttatctanagccatgtgtcacttaacaactggaatatgttccaagaaatctgtcattaggctattttgttattgtgtgatcacagagtgtacttacacaaacctagggtggtatagttcactgtaccaccaaggccatatagtgtagcctaggctacaatatacctaggctatatagtatagcctgtagctcctaggctacaaacctggacagcatgttactgcactgagtactgtagcaattgttacacagtggtaactatttgtgtatctaaacatatctaaacatagaaaagatacagtaaaaatacagcagtataatcttatgggaccaccgttgtatatgtggtccatcgttgatggaaacattgttatgtggcacatgactgtatatgcttcgtatatagtgaacattcagcaaaggttttcatcaatgaatggataaattggcaacttttatgggcttaattgggctaaaatatatacggagtcactatttgacttaacacctagacattattttactgatatttttcaataattctgtttttgtaaagccttccttccatttgggtgcaatttccacttggggaaaatctcattccccatcctcttgtaattaaaaagcatggtttgtttgttttntanntnannnnaaantgnnc

SEQ ID NO: 231241 - DNA, 421 bp, Homo sapiens
aaaaacatactgagtgcctgctacatggcaggaactgtactgggactagaattaacagtggggagttttgaacacacatcccccacccttaaagcttacagcttagtaggagagtcagatattaaacacagtaatgacaagtaaagaaagaaagctgtgataaatgtggagagagaaaagcacaagtggacagtaaaggtataacacgaatacagtttaaactggggagtcaggggaggtccttcagggaagagatctttgagacctaagtgatgattaagagttagataggcaaggccaggtgtggtggctcacgcctgtaatcccagcactttgggaggctgaggtgggcggatcacaaggtcaggagattgataccatcctggctaacacggtgaaaccccgtctctactaaaaatac

SEQ ID NO: 231242 - DNA, 196 bp, Homo sapiens
cagatatccattgaattgggaattttataacatagtgactttctaaatgcctcgaaaacatcccctgagttcaggaaaagatcaagtttgcaggcttgaattttacttccactagactactgctgcatttatctgtctcctatttgggagggaggtatgatacttcacaggtaaaatgcatgctgctattaaaaga

SEQ ID NO: 231243 - DNA, 507 bp, Homo sapiens
tcagctctgaagatggacggagccacggaacaaggaaacggattctccctaagggagcacagccctgccgactccctgactgggcccatgcctccctccctcccttgattggcccagtgaaacccatttctgacttttgacctccagaaccataagacaataaatttgtgttattaggttggtgtaaatgtaattgcagtttttgccattactttgaaaatattttaggccgggcgctgtggctcacgcctgtaatcccagcactttgggaggccgaggagggcggatcacgaggtcaggagatcgagaccatcctcactaacatggtgaaaccccgtctctactaaaaatacaaaaaattagccaggagtggtggcgggcacctgtagctccagctactcgggaggatgaggcaggagaatggcgtgaacctgggactcggaggttgcagtgagccgacatgtgccactgcactccagcctgggtgacagagcaagactccatctc

SEQ ID NO: 231244 - DNA, 468 bp, Homo sapiens
tcttcctcatatgagtttctgtatgcccgaagccctgaaccatgctgtatttatggtatttattgtaaacacctgtttttgtatgattaagcccttgggctacactgtaccagtttgactggataagtttatcctagaaaagtgatttatgatgaatgcctggttttgctctgtggtgaagactggatggagtctgagtagctgaggtcattcatatgggcactgcatgcctatgtgactgacccccaacaaaaactcttgataccaaggcttcggtgagctttcctagcaacacttcacatgtgtagtcacacattcctcctggaacaattaaggacatccctatgtgactccactgggaagggttacttggaagtttgaacttgatttctcctggacttaatccatgtaactcctccctctgtcaactgtgatatatccttttgctgtaataaactgtaaccatga

SEQ ID NO: 231245 - DNA, 316 bp, Homo sapiens
taaaagtcccaaggctaagacctgggagcccctggctccccactctgcctactcttgaaggatccctgtgggtattgaccagagcattgctagaatcctgacaccttcccccaccccttctttcccagtggcttggtgtaatttctcccatctttgaatcccagggcatttattaccttctcttaatcacctacttcatctgacctcccatacagttgttttttaatcatttttattgtgaaaaatatcacatatacagaaaggtgcatgaaacataaatgtacaggttagtgaacttttaccaagcgagccagca

SEQ ID NO: 231246 - DNA, 440 bp, Homo sapiens
gtcaacagctcctgtgagttgggtccaagtacatgagtcacaatctcaacagcggaatgcatcctcatgtgagagccccaatcccttctgcaagttgtgtcctggtataagacatcatccagccacttgtccagggagcacatcccaatccagttcctgaccagacagggatctgccactctttccagctgggtgacctggtatatgttaaaaagttccagaaggaaggactcactcctgcctggaaaggacctcatactgttatcctcaccatgccaaaagctctgaaagtagacagcattcctgcttggattcatcaccctcacatcaagaagaccaacaaagcccagcaagaaacatgggtccccaagcctgggacaggccccttaaaactgtgtctaagtcgactgaagccattaaattaattctttacctctttt

SEQ ID NO: 231247 - DNA, 443 bp, Homo sapiens
ttgagttcccaaaatgcatgacttggttcctcatgtcacatccagacaggacaacacccactggaagaggaacgcttgctcaagtcttctccacacctccccaacccatcctcagcaaggaaacatttcctagcagcccaattggcccagaactggatcacaggccacacactattgggcttagactgataagaacctaaccctcagctaagtatgagctactgttttttagaccatgggtgttcaggggagggtggacacagagagagactggattgcgttgcttttttcaagaaagagtttgggaactcattggaatcaagaaaagtcagaacaaattatgtttgtattgtcccctttaaggttgttattctatggatataatgagagttgtgaaaaaataaaatatgaagaaagaaattgttattttcttcaaactctaa

SEQ ID NO: 231248 - DNA, 304 bp, Homo sapiens
ccttgggtaagtgcctctacctctctgtgcccaggtttcctgtctgtgcgatggggatggaggtgatagtgtctaccctcctgaggtcgttggggggactaaatgggatagtaagtgtaaatgggacagcagtgccaggcacagagtgagcacttcaataagtcaacctcttcaccatcattcccgacaccacagcaacagaaatgataatgctatcaacccccaacggttcaacccttgccccctgcccgtgtgcccaacatcctttatgctcaaccccaagaaagctgagatcgttccttcc

SEQ ID NO: 231249 - DNA, 534 bp, Homo sapiens
ctgctagtctaaagctccttatcaaaaacaatttgagaatcacttatctttacatgatcccgtaagcttctactaatgtgccttggcaagtgggcatggtttataaatatcatagcatgattcattcccacatctccaagtgtaataatgtggattttaaaataacatgtttttgcctttaagttaaaaatattggtgtgagagaaatcaatatctgtatgtacgtgtgtagatatgtgtgtatattaaatgcatgtatatacacatatatgtatacacacatacacatctatgcatatatgcgtgtgtgtgtgtatgtacgtatataaaagagccgtctcctagaagaaactgggatggtagaacaaatgagaagattttgtaagaaatgtactacctggattcattttgaaaaaataaattattataatcatatttatttgagtaaaaaatatttttcatgtcagtgactaaaaataactacaggaaacttttattcagattccagataactggaaaagtctaggagccaca

SEQ ID NO: 231250 - DNA, 189 bp, Homo sapiens
tgtgtgactgtatgatgaactttgagctcatgagaagtaagtaggaatgtattaagaccataaaaatctctttaattttgtaaaaaagtgaatgtgaactcttccctctccttttgctgctagctgcaatggagatgtgagggctggagaccatgccaccatattgaaccatgagtagaaagtcacata

SEQ ID NO: 231251 - DNA, 429 bp, Homo sapiens
tcccctctccaaattgccctctcccccagggcaggctcagcaatgagcccctgtagacagccctcctctctccacaaccccacagggacagcaccccctctaagctccttggtactggtaccattctcagtggttccctgattattccataggactaaggcttgtttttgcagccagaccaaaacttccacgatgggagtctgtctgtgatacaaggcacacaacacgtactcactaaatgctgaaaacaactacccctttatgcttcaaagtgctcaaatggttctctagtcctgagatttgaagaagtcttaaggaagatgacccagtatagatgtgcaaacaggcacagaaaaagacagcgcccagcagcgtgtgcgacaaggctgagcggggagcccggtcgcatcatctgaagctgcaggaata

SEQ ID NO: 231252 - DNA, 207 bp, Homo sapiens
ttttttggagcacatgtgtgatctgtcatcacgttgcttcccgagaagttaaatcaaagacttaggagggactctgctttgtccttaccaaggttctgctagaatttgggaatcactgattctaaaataacagtaagagagctggagtttttttttcttttcttttttctttctttctttttttttttttaactgattccttcttgg

SEQ ID NO: 231253 - DNA, 832 bp, Homo sapiens
ggagctctctgctcttgcagcctgtctctctgtctgcccaagatctctgtgccgttgctccagagctggaggctggggcagtggctcccttctcttggagtgacatccctgcagccttgggtggtgtagtagcttggcttgcctctgtcagggtggagcttttgccccacaggtgaactggggcaagagtgagtggggtcctggtgctcctggactgttgtgctaggctggagccttcacttacacatgggttctgggtggaggaaggaagctccagacctctcagctgctcttgcctggaatggagcttctgtacaaggagctgtgggaagagaaatgctggcagaagcctctcctgtggatatactgcagccctgaccaggggctgggggaaggaagtctgtgttcttacaaacccccttccccaagaggagcttccatcaggctgacctgcagcggggcacaggttatagctcaaatgtcaccaactctctcttccttaccaatatttaatagtgttcattgaatcaatgtgtcttcattttcttcacttgccatatgcccttaggacaatttccagaagtgttaatttttaaaataatttttaccagttacggttattttgctgtggagagggtctgtggcctctttatgccaccactgcagtgtcattctgatttgtagatacattctacagtgggatggagattcaactgtaattgttaagttttagctcttcttttgttagttatagaacagtgaacaaagtacttaatcttcctgaatcaaatctgtaaaataaaaaatttttaagttgaataaaatggtcctt

SEQ ID NO: 231254 - DNA, 426 bp, Homo sapiens
gagccactttgcctgggaaggacggaggaagggcaacctgcacaggctttgcccgagaagggttctcatcctccttgcaaattctaagaggacacccacccattggaaggtgagccaggagcctaccctggatgcagaggagagctggggagtgcccctttctgggacccctgtctccttccagaaagtacgagaccctcccagaagggggctacagcggtcagcactgcgcccgccaaacctaaagctcatctcaagatcttcccgtggctccgaccgactctgcaaatggagcgggccagtccaccgcctcttgggacggcatctctggacggccactgacagtaccagtctctgtcaccccctggggggttaggggcaatgtcatcggccagggtggcagaaatagaaaagtgcgtgagctca

SEQ ID NO: 231255 - DNA, 790 bp, Homo sapiens
gagccactttgcctgggaaggacggaggaagggcaacctgcacaggctttgcccgagaagggttctcatcctccttgcaaattctaagaggacacccacccattggaaggtgagccaggagcctaccctggatgcagaggagagctggggagtgcccctttctgggacccctgtctccttccagaaagtacgagaccctcccagaagggggctacagcggtcagcactgcgcccgccaaacctaaagctcatctcaagatcttcccgtggctccgaccgactctgcaaatggagcttaatgggtagcagggggaaggaattgctctcagccgaaaaacattaagctttgtcaattatcccccaaacccgctgggtttataaatatccctttttatttttagggttttccctcccgctcgcccccatcccgaactctctccacgccccgcttcttcccccacgcacacggcggctgcaccgtcacagaaagcaggtgaacgcggggccacggggcgctcgggtagaaatgccacgtcgcaccaccaagtcacaccgtccctgcccgtccctctccggccatcccactaactattgtattggggccatgcagccgctggaataatcagcgaagccacaggtctccccatcttggcaagtggaggtgtgcgctgccctcagacatctgtgaaccgctgttcaacgccaaccccgaaggcagaaggggaaaccaagtcacctcccagaaagacgtttgatgagcagagatagatttgcctccagactggtacca

SEQ ID NO: 231256 - DNA, 460 bp, Homo sapiens
caaagtttaaaattgaatatgaaaaccgtgtttaaagtaatgatgaaataaggatccaaatctttagaggcaaagaaaatttaaaaactgtagtagagatctgtacatcaacctaaaagaaaaatagcctaccacttttttggtgtttctccttatgggattttaaaacggtaaatagaggccaggcgcagtgctcacacctgtcattccaacactgtgggaggccaagacaggggaatcacttgaggctaagagttcgtgatcatcctgagcaacacaatgagaccccatctctacaaaaaaacaaaaaatattagtcaggcatggtggtgcacctatagacccagctatttaggaggctgaggatggaggatcacttgaactctgaggttcaagcctgctgtgagctgtgattgcgccgctacactccaacttgggtgacagagtaagaccctgtctc

SEQ ID NO: 231257 - DNA, 399 bp, Homo sapiens
agggctctccagagaaatagaaccaaggagaaagagatcgatttattgattgattgattgattttaagcaaattggcttctgggattctggagggtggcaagcccaaaacctgctgggtgggttgctggctggagacccaaggaagagctgcagtttgagtctgaagcagtctgctgtcaaaatttcctcttcctctgggaagtgagtcattgtttggtgaaggccatcaactgattagatgaggcccagccacactgtgggggtcttctgctttactccactgatttaagttttatttcacctaaaaagtactttcttagaaacatgtagaatagcatttgagcaaatatttgggtaccttagtctagccaaattaatacagaaaactgcccatcaca

SEQ ID NO: 231258 - DNA, 441 bp, Homo sapiens
tttatattaataataagcttaaaagtcagataatgtacatctttaatgttttctctatcagttagaattgttttgctattctcagtccattgccttcctgccttgcaagtttctgagactgtgaaaagtgttttgcttcttttgttacccaattgagatcatttaataatcttgaaagagtggttaggaggaatgtattttatcatagcaacaagacttttaagaaggaactgaattggcaattggttcattaaaaccttctgaggttttaatttctaaaaagttagtatggggctgggcgtgttggctcacgcctataatcctagcactttaggaggcagaggtgggaggatagcttgagcccagcagttcaaggcttcagtgaattatgattgtgtcgctgccactccagcctgggcatcagaaccagaccctgtgtca

SEQ ID NO: 231259 - DNA, 272 bp, Homo sapiens
agcaggatctggactgggtagaaaattgtctgatctgatgtgacaatgttttatgttgctaggctggtggtactaaccagcagtgtaaaattccatttgtattttgcatgtaggtggatatactaatatactatactgttcctgtcctaaacagtcacaaactttttaaaatcttattactcagaataattttttatttcattacaataataggagtcaattcagagctttacagcccagttcgccatattctacttcatcattccacccaa

SEQ ID NO: 231260 - DNA, 500 bp, Homo sapiens
gacgaaacttcagataaatgcaatggcatctcacccattcagtataggtttctcaccagcaatggtgatcttttttattaaaaagagtcttagatttggttctattacaaccaattttgtagttatttttataacattagctgatgtcaagaattgaacccatctgatacaaagaactgacaaatcttatcatagctttggtgtctaagcagcatataaggctgtatacttatttgaggattctaagtcattttttgaaaatcagcagcacctattgacaataaacagaagattataaaaatttcaagtcgaagagcatcattttttaaaagttttctaggggttggcaaatgtttgctaggaagggctagatagtatgtattttagattttgtgggtcaaacagtgtctgtctcaactactcaactctttcatcaaagtgcaaaagcagccatagataatgcaaaagtgaataggtatggctgtgtcccaataaaactt

SEQ ID NO: 231261 - DNA, 473 bp, Homo sapiens
tagaaatttaataatagcctagaattaaacttccagacggcctcagcgggggtggcagaggagacttgtgaaggcagctgaagtgcagtggcttccctgtcttgctctggaggaagaatcagacgctggccacacatgagtgctgggtaaacgtgggcttaaaaatgcaggaagtaaacctcagggcatcactagaaggatagaaatagaggaatgactttaaaccactggaggaataaaatgaaacaacaaaatcaaggaaagaaaaaatatcactaaagaatggttaatatgaaccaaaatggcaggaaacagtcaaaccgtaacagtaataaccacgcatgtaagtggcgagtctcatattgggataaaaacataacacaactagttcctgctattttccatccacaaaagactcacccgaaactagagggacgcataaccgctgaaaacggggacgtctacaccaggca

SEQ ID NO: 231262 - DNA, 365 bp, Homo sapiens
atttgagcatgttcttgattgatttaatttaggaaaggaagagtggaagaattgttgcctttttgggcagcctttttcattttcccaagtgtgttctgtggtgtggctctggctgtggaactggactttctggagtaggagacagttactttatgttctcatgcagcaccctcactgagaattgataatgttagcacacgtgcacaatgccacattttaagctgcactgccatgggcgatttatccagtcactatttatttatttattgaggctgcaatttcaaatacactttatttatttgttacatcctccatctctcctctgtcattttgtatttgtattttttattttttttttttatttc

SEQ ID NO: 231263 - DNA, 432 bp, Homo sapiens
aatgtccttgtaaaaatggagtatggaaatacattctttcttactgtgtggtcttagcccaatttacccttctccgtgcttctatcctcaccttcaaaaatatagtatttatcttatctggtagttctgagtattaaagataacagaaatacagatgtttggcacatatttattgttcaataaataatgtcctgtcttcttttgtcttgagctttttattgtgtaaacaaaattgacccaaaccgtaactatggtggttctttaacttctgaacttctaatcgtgaatgcattgacagggaggtgttgaacacttttctgtgtgcctgggtgttgtgacttacttgtaagagatggaagctaatgtgcttgcggccaaaatataacatttttttttcttagcgatcggcagaaatgttatatttcagaaaac

SEQ ID NO: 231264 - DNA, 411 bp, Homo sapiens
ctctcttttttcctttaggtaatagctcccccaaagtttagattggcatacagctaatcagctcaagtgtatatttctcagcctcccttaaggctatatgtggtatgtaagttagttttgactaataggatgaaagagaaagtggtatttgcaacatataggttatcccctccacattactccccttcccactagccagaacatggctgtgacagcagaacccgtgcatccatcttagacaacatctcagccccaaatattgtaaagccaccatattggtcttgtactgcttatgttcagactgttacatgagaaaaagtaagcttttatcttctttaagccactattatttcggcctttcttaacagccatactaaaatgataaccaaaataaacagtagctcttgtgta

SEQ ID NO: 231265 - DNA, 469 bp, Homo sapiens
gaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaa

SEQ ID NO: 231266 - DNA, 812 bp, Homo sapiens
gcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatg

SEQ ID NO: 231267 - DNA, 464 bp, Homo sapiens
ataggggaatagcctctggactttaaatctgttgcttagctactgatccacaatagctcccaattgacttgaactacagagtactagagaatttgaagatttgaaaaagatcatacctcaacagaaataaaaagtgaaaagttctatcaacagattgttctatacataaatcacttcatcactctcatcgaatagattcatgtattagtatattcattttttaaattttcatgacatcataaatacattgctaggtgatactgtattgtaaatatatattagaaaatacctgcataagctcttctcaatctttttcacgtatatatagagaggaaaattattaagtaaccttcatatttacttatcctcagttgtgacaacaaaagccatgtcaactgtcaggtgatatatattgtcatgcaccccaatctaccatattaaaaaattaaagtggaattcgtact

SEQ ID NO: 231268 - DNA, 672 bp, Homo sapiens
caacttagtgtttggattttaccctttagaagttggattcaagcttccttcttgaggtagcccctaagtgtcatgggctcaaacacccactaccaaaagagtctgctcttttcatggtagcttttggcagacctggaaggagattgtgtcacatggcctgtaaacaaaaccagtaattcactgggtgaagaccaaatgcctcatcaactgccaagcctctgtctgtctcccttagatcagtagcccatgatccctttacgaacctcagcctcggctctgcttttattgtttttcactgcatagcgctgcctttgctatgtcctttagttcaccatctatgaattggcaagaaaaattttcctgccaggcacagtggctcactcctgtgctcccagcactttgggaggctgaagtgggagcatcatgaggtcacggagatcaagaccatcctggtctaaccatgttgaaacgtccatctctacttaaaaatataacaaacattagctgggtgtggtggccggcacctgtagtcccagctagcttgggaggctgaggccggagactggtgtgcaccctgggaattggacgtttgcagtgcgcagaggtcgtgccactgcagctccagtctgggctgacagagcgagactcaggtctcaaacacaaaccacaaga

SEQ ID NO: 231269 - DNA, 493 bp, Homo sapiens
caacttagtgtttggattttaccctttagaagttggattcaagcttccttcttgaggtagcccctaagtgtcatgggctcaaacacccactaccaaaagagtctgctcttttcatggtagcttttggcagacctggaaggagattgtgtcacatggcctgtaaacaaaaccagtaattcactgggtgaagaccaaatgcctcatcaactgccaagcctctgtctgtctcccttagatcagtagcccatgatccctttacgaacctcagcctcggctctgcttttattgtttttcactgcatagcgctgcctttgctatgtcctttagttcaccatctatgaattggcaagaaaaattttcctgccaggcacagtggctcactcctgtgctcccagcactttgggaggctgaagtgggagcattgcttgagcccagaagtttgagaccagcctgggcaacatagagagaccccatctctacacaaaatttaaac

SEQ ID NO: 231270 - DNA, 339 bp, Homo sapiens
ttgggaggggtgagaagtctgaatcataagcctgagcctaagcaaggtgtgtgaagttgttgaggctgagaaaaataaaagtcagagatgacttatcttggcgtctgccagcccacagcaaggattgtcagctgggcaggttgtcagcgttgtggtcccattctgagaaattccctttctcagaaaccaggcatctgagagcatagggttgaactttggtgttttaggtgatgtggtgaagtgtttgtcaacttgctggctgagcctcctccacaccggtagtaactcttggtgcctgtgccaggaactgtgtcatccttgtgagtcacctgtcatgca

SEQ ID NO: 231271 - DNA, 426 bp, Homo sapiens
agagccttaattaggcaggaaaattaggatgttttaagaatatcaaactgaaagtgtatctatactttgtaatttctcagcctggagtaacttgaactttcaaaggaaaaaggaaagaattgagtggatattttttaaactattgcataataaggaggctgttgccatctactccaataagtctagagtgataaatgctccagtgggattattaatattattagcgatggtctattttcaaaagcatctgggaagtatcaatgcagccatattgagcatattttagtgtctaaatttaaaaaaaaaagaattataaatggaaaaggagaattctgccagctaaaaaagttaactcattccaaaaataaaaaagtcacatttttataatttgttccaaggatacctaaaggcagtaccatgatacag

SEQ ID NO: 231272 - DNA, 335 bp, Homo sapiens
tctcaaaataaacaaaacaaaaaacaaaataaactgtgcccttcataaactggactgtaatgaaattaaaacttgtgctcttcaaagcactgttcagataatgaaaaggccagccacagaagggaggaaatgggcagcccttgtgcctgagaaagggcctgtgtcaaaaccaccaagatctcttaggactcaatactaagagaagcaaccccagaacaaaggtgggcagacctggagagaaaagaagagacaggcacggccagtatctcaacagcagcggatgcaaattaaagccataaacacagaccacaaccccctgacagagcagctaggat

SEQ ID NO: 231273 - DNA, 748 bp, Homo sapiens
gcactctgggttgattagtgcattttattattgtgaaaagcatcttgcagagaaccacattctggtaccatttctggttttaaagggtggcctgtgtgggtatgtagaaaggacacggggccagcggtcccagacaggggcaccctgggagattgcaccagggctgggtgcgtgggcagttgtgtcagaggccgcgtgtgaatagtgactccgaagcctgccgcttcctgggaccatgtttatcccagtgtttatccctgttcacacacgtggttttgtttgaacacgtgactgttacgctttatgtggccttttgatttctccccacgcggttgtgcggtggatctggcggctcctcaggtggaggccggggccgtccattccctgctgctgggtggagatgttgtctccagttcctgcctttggcctccaggcacctggatttgagtgggtcagttctaggccacatcgtgcttgcatttgtgattcccgtggcccttatcaggttgctgcctcgaaagccttcctgccggccctgcagccacccctcatctcagccaacgccacatcagcgccatgggtgcaaagtcagagctcactgtcactcggatctgcatttctccacctctgcctggatttgctctttgggaattgtttctttgcatcctttgctggttttcggttgggtgagtcttttttttttttgagacggagttttgcttttgttgcccaggctccactcaatggc

SEQ ID NO: 231274 - DNA, 263 bp, Homo sapiens
taggagaggtagggatagaggggagtagtttccaagtgacccaatgcctaatccactgggacatcagtggatcttatgaactagaaatggggtgtagcagatgctgtctagagggctcccatgacccagttttgacttgggacttgtaaggggatatcttcaggcagtttcagggaaacactttcctccctaattaaagagatgcattgctgggattacaggtgtgagccactgcacctggccaataaattgtgtttgtaagc

SEQ ID NO: 231275 - DNA, 387 bp, Homo sapiens
ttttcaaacttgccttgcagttatctgtggtcatttgactgaaatctaagccaatggaatgggaatagagatatctgtgccacctacaccttcacacctggtcaatgaaaactgcctgcatgttctcccacctttcaactgatggcaacactagaactgtcttagcagcctacaggtggaaaatgtcagagttgccattgatctgagccccagaatttctgtgtagaaaagagccaccctaagctcttttcttttaagctggtgtcaacctaagcaccagccctagacagttattattgttcaacccactgaaattttagggactattctttactgcagcttaacatattgtaaccaacaacaacaaaaaaaaatttccatgttaca

SEQ ID NO: 231276 - DNA, 375 bp, Homo sapiens
agtggaggaattaagttttgctgctgcttgctgtgttcccagccaggagccagcccctgccttcaacgaactgaatggctgggagtatggggagtcctacaaaggtgaactgtgggatgctgtcaggacttacacgtggggattctttgtcctccacgaaaggcacaggaaaggccgatcaagcaggtcccaggaggcttccctgggggagctgcagggacaactgggccgggctggcgcccagacagcagcgcctgctcagactccggggatgggcaaggcagtggtgagggcggaggtggggaggcggctgccggccctggacctggactgctcccactccaatggaaggttcgcccccatgtctccctttta

SEQ ID NO: 231277 - DNA, 411 bp, Homo sapiens
agtggagagcaggagtcaaaaagagagaagaaaggggtacatgtcctttggaaaactgctgtggcttacatggccttgtttcaatggcccaggcagagaagaaagacacattcacaagcatagattcccatagcacagatggaccttgaaaatagaatgctacgtgaaaaaggccagacacaaaagaccatgtatatgattccatttatatgaaatgtccaggatggggaaatctatagagacagaaagtagatcagtgttgactttgggactaggggacctggggatgggcgagtgatagctaaagggtgtggggtttctctttatggctacaaaaatgttctaaaattgactacgatgatggttacacatatcgttgaatatactaaaacctattgaatcattcacttt

SEQ ID NO: 231278 - DNA, 519 bp, Homo sapiens
cttgattaagcacctgggcaggaaatgtcaaaacttctctttctcctctggaatgcgccttcattttacaggaaggctgcatcttccggtttgcaaactattcactagaataaagcctgtttcctccaaactccttttcagagaacttttgttcacagtaagttatgggaatcgtatggatgtttttgaaaagtacaagtttcaataaaggaggtatctaagcaattgcttattactagctattttaactggtaatcaggaaacaatatgtgaagcattttatgttctattatgactgtttattagttttcattgtttatctgtgctttatattttacaaaatcggttaggaatttttagcggacacataacacattataatgttttaccatttaaaataatggggccaggcacgtgtgtcacgcctgtaatcccagcacttcgggaggccaagacaggtggatcacttgaggtcaggagtttaagatcagcctggccaacacggcgaaaccctatctc

SEQ ID NO: 231279 - DNA, 948 bp, Homo sapiens
cttggccaaggtaacacaacctgcctgaccctctggccatgcacacgtgtggagtttgttcccgggccctgtgcctgttcaaagaatggctggacgtcggtattgcccttggtttctgccctgaagtccagtcagtcagcagttctgcttattctgaccctctctgtgcagtattacccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcgagaccagcctggacaacatggtgaaaccctgtctctgctaaaaatacaaaaattagccaggtgtggtggcaggcgcctgtaatcccagctactcaggaggctgaggcaggagaatcccttgagcctgggaggcagaggttgcagtgagccaagatcgtgccattgcactccagcctggggtatagagtgaggctct

SEQ ID NO: 231280 - DNA, 345 bp, Homo sapiens
ggatgaagaaaatgtgctacataaacaccataggataaaaaataatgaaatcatgtcctttgcagcaacgtggatgcagttggaggcctatcctaagtgaattaatgcaggaacagaaaacaaaataccacatgttctcacttataagtgggagctaaacactgagcacacatggacataaacgcaggaaagatagatactgcagactactacagggggaagggagggagggggcatgggttgaaaaactacctattgggtactgtgcttatgcctgggtccaatttacccatgaacaatcctacacatgtatcctcttaatgtaaaataaaagctgaaacttta

SEQ ID NO: 231281 - DNA, 392 bp, Homo sapiens
gagccagactttgttattaacatatatattaaaaatcacatgggaggagttacgaatgtaggtaaaatcccaaatttagcactgaaactaccctctcctagataagcaacttactatatgaatatgtggaatattaatgttgcattttgtatacactcagggttctatcttaataaaagatattaaatttaaatttgtcaactgatttgtaacaggtttaaagatcttcattatcatcaatggtgattaattttgggtcacaaaagaagcttactttaaaatttaaaaacatattgaaatacacttcttctataaaataattgaacatcattagtacgtagtgtacagttagcaaagtgggttcctccaaagcatgattcacaattagggga

SEQ ID NO: 231282 - DNA, 500 bp, Homo sapiens
ccgtggacagcacacctgcgtgaacccagccaagatcgacagggcccatcatgaccaccagataaccagccaggacgcagatgcacaggcaaaaagaactggcttttgtttcaggtttcggggtattttcttacgcagcaatagctaactgatacaccaagctccgacaattatgccgcctttgtacccattggaagaaagtatgtttggcagaagccagtgttagtatggaccagaagtcttcagggaaaagtgctgagacttatttcctgaggtgtctgagtgactgatcttctatgtgcatcttcagcactggggaagagtgaggggtctcaccgcaagagatgctatggaataccaatagcaataataataaaataataacaaatatttaacttattattattagaaaaaagataattattgtataattagatacattattactatttaacctaagtatttctgtgtttagtaataaaaggaaaggagcttataaa

SEQ ID NO: 231283 - DNA, 601 bp, Homo sapiens
ggctacagagcttgggttttcccttagtccactctgatacatggtagttagactttataggacttaaggatgagtaggtttttgtggcttggtttgctcacctaatcatcaacgtactgtgtttcttagttcttaaaaaaaatagtttaaggccataggattacctgtatttttaacttttgtgcccttagaattttatgttagaataaaatctgaaatatagtttcttgtgactataattcccaaatgttatgtcaggcattggcaagccatgttatttaaaactgccagaagtatgttgccttttaagtggaagtatttgtgaaacgtatgaatttcctagtatccctctaggctgctgtgtgttgaatggaattccttctataagacgtgagattaggcagtttgccttaagctagcagaggggactagctattcattttaggaatgaatggaggccagagagaagcataataagccaaaacttaaaattcagaagggaaatagcactacattgtttaggaggaaactaaatctgtggcataagtctgaaggtaagacttggtaaaaagaaggggaagtctttgaggaagaagaattg

SEQ ID NO: 231284 - DNA, 336 bp, Homo sapiens
tcatgagggaggatctctcatgacccaatcacctcctaaaggccccccctcttaatacgattgcattggagattaagtttcaacatgaatttggagggacacattcagaccatagcatcatgcatttgcagtgggggtaagattgcccccaagggagcaaaaattgatcccttaggggtgataaaaatcttagatattacaatagtttgtggccctccaaagttcatacctacctaatacaaccttctttcctcatgtttaatttctcctgttaaggatgccttaactttaaattttaattttaattcagtaattcttcctggaggaataataatg

SEQ ID NO: 231285 - DNA, 301 bp, Homo sapiens
cctagaagacatggatacattcctggaaaaatacaactctcctagcttaaatcaggaggaattaggtatcctgaacagaccaataacaagcagcaagattgaaatggtaattaaaaattaccaacaaaaaaagtccaggaccagatgattcacagcagaattctactagacattcaaagaagaattggtaccaacccttttgacgctattccacaagacagagaaagaaggaaccctccctaattcattctatgaagccagcatcactctaataccaaaaccaagaaaggacataaccaaa

SEQ ID NO: 231286 - DNA, 452 bp, Homo sapiens
gctttatactgtttgttaaattctaacagatggagggacagatgtcagagcaatataatttggctccctgtctgattttcatcgttgatcacaatatgtgactgcctttcggcaaaactgagcacaggtgtacactttagactgcaacaaagaataatgtagaaaaggaaatttatcaaacttaatgacaagggagaaggagatatagaagacaaagttgaaactggttttctcccccagtgggaagtattgtattggaattagccttttaaagaattattgtatattctaaatgatgaaataattttactagtgttcaaggatgctgccaaatagcataaccttcaaatgtcagaatgttgtttaccatttatttggcaactctagactacaaccctgtgcattttccatttcttgtctaattaaacattaactctaattgtgaggaatcg

SEQ ID NO: 231287 - DNA, 458 bp, Homo sapiens
cgctcagggtttagtcagatgtcttgttttcacattgtgaggctggttgtcagacacataaaagtttttttttctccgtctgccaccctagttgatttgatgcagtcgagtccttgccaacacacttcatatcactgcacttaattggaaaaagagtgcttgcagtggcataaaacaaagggaggtctgaaagtttggctccaggagttttgctacgttcagatattctttggccatttttctttgaggctaagattgagattttggctaacataaaggggattaaaggatggaacggctggtgtgggctgtttttaccatggcctcaatagcagttcaacctatatatatatatataaaattttatatataaaatgtatatatataaaattttatatatatacatataatatatataagtattatatatattttttagagggagtctcgctctgtca

SEQ ID NO: 231288 - DNA, 1127 bp, Homo sapiens
tatgtccaactgcctactagacaattccctttggatatcttgtaggagtctgaaatttatactattaaaccaaagttaccattttcctaaaattgaattattttcttttggttagcaaaactagtttatccactcactgaaactgatagaatttccaagtcaaagaatatagagttttaaatggctttaaatgaccagcttttcaaattattgtgtagaagtgtagcccagtagagcgtaagagtgaccattttcccacacctcccgccaacaggagatattaagagcttttgaatatacactgcacaggcaaacaatgggtttgatctgttgaccatttgtattcttttatgagttgcctattatgtttatatgcctgttatgaggtgttttcatatttatttgtgagggtacacatacttgtgatattgaagtaccacactgtgttgtaatcattggcttaaacctctcttctaacagagtgcaagctctttaaaggctcattcacactgctttcccagcacctcacctaatttcttgttcttcgcacatcacttaatgcatgtttgttgaattgaaacttcagtgtacaggagattgaatcccggaggatttagatttgtagtatttgaattattattgttctattggggatttttattgggggagccaggcttctgttacatcagacattcacaggtcattgaatttcagtagcagttctcatgaatacaagaataggttgaacaacaccaggttatgttgtaatttagtagttgctgttcatctagtgttatctgcagttgtctgggcattatggcctacctgcttagcatcataacttagtaaacttatatgtatgaaaatggaatagttaccctctgagtatctagtaacaaatctttgaattgaatgtcacatgtaaggttgtttatgctaagtcttgttgagaagataggaatcgatagtcttttctgtttgccataatgacattgaactttgaagagagaatttctactgtgttacactccaccatcaaaaatgcataactgcgtcagtcaaccctgaaaaagtttatacggacaacttttgggatattagcaatcagtgactaacggtagtagaga

SEQ ID NO: 231289 - DNA, 489 bp, Homo sapiens
gagacagggtattgctctgtcactcaggctggagtgcagtgtcaggatcacggcttactgcagccttgatctcctaggctaaagggatcctcccacctcagcctcccaaatagctgggactacaggcacaccatgcctggctaagtttttgtattttttgtagagacagggtttcaacatgttgcccaggtggtctcgaactcctagactcaagcaatctacccaccttggcctcctaaagtgctgggattacaggtgtgagtctgtgcctggcctggagtgctttttaattactacttctcaggcctcacttaaaaccttctgactcagagtctcagaggcaagacatggaaatctgtattagcctttatttgaaaagaggtgattcttaagggcatctaggttcgcagactactggcctcgacaaactaaatgttgatttgaattggcctgttatcatcttgatcacattgtagttaagagcaagac

SEQ ID NO: 231290 - DNA, 277 bp, Homo sapiens
tctagctagatgtcattcttttggcctttttttaaaaaaactcagttttgttgattttttaaaaatattatttttctaatctctattttgtttatttatgttctattattattattatttccttcccgctgctaactttggtgttagtttgttcttctttttctagttttattgagagaaaatttaaattgtttatttaagatccttcttattttttaatgttgccatttaccactataaacttccctcttaatactgcttttgctacatcctgtaa

SEQ ID NO: 231291 - DNA, 414 bp, Homo sapiens
ccccctccgggctggggcccagcacctccgggctcagcgagcagatctgcacggtgtcgaaatggaggaggaagtcccgcagctccatcctgcacggtggcccagtcagaccctgcccggccccacctcgagggggtcccaagatcccggaaatgactcccagatcccaaagcccctcacatttcttaaatattgtcaaatacccttcaggctccagaaatgaaccccaaatgcctgggcctctagctctgccaaattcctccaagtcctcagacatgccccacaaatcgccaagattcacaagctgcccccaaatatcgttaaattgccaccaacccccaaatagcaagaccctcagactctaaattaccaacaagtacccttcagcccctcaacattgccaaatctcaagaa

SEQ ID NO: 231292 - DNA, 976 bp, Homo sapiens
gggggtaatcactgggttacaaaggtgctgctaagagcggaggagaaaaacccaattcccagccatgtgtctggtatgacatttcaccaacccatttaagtgtgcaggcctccaaatatctacctaaagattatgatagattaggcattttacactaaaaatctgtggcttcgtgtccactaaagcctgactggccagtgcctaaaagaaacagacgataacctgatccctcaggaacagatggtgttctagctttgtggaagtgaatttcaaggtatggagcacttgaggggtctttgaaacctgccaggtctcacatctctgcttttggtgaaaagctcatcaactaacagtagtcaggaatgtgcctttacttcctggggctggtctgttgaaattttgtgtgtggacaatggaaacatccaggagcatttctgctttcctatagcctcttaataattgatgccctaaagtcctatatcctttgattcctggatggtaccagatttcatgctgttaaatctaatctgcaaaaacctgagcgttaatctccatgaatagaagaacttgttgtttcttatttaaatgctcttttttctcttgtcttagattctgagcaggatttccaatacggtgttgaaagaagtagtgagagtgggcatctttttcttataataaatcttaaaaataattccaaaatttcaccattgacaataatgttaaccatgggattgtcctatagcttataaagaacatatctctttattttgaggtatattctttctatacctaatttgttatagattttatttggaatggattttaaattttgtcaaaataattttaggcatgcataaaaaagtcatgatttttaatctttttgttgtgtaaataaggagtatggcatttattgatttccacatattaaaatattattgcatcccaggaataaatccaacttgatcataataaatga

SEQ ID NO: 231293 - DNA, 616 bp, Homo sapiens
  misc_feature (519)..(519): n is a, c, g, or t
atctccccattctttcctctttcacggttgtataatcacatatatgctgtaaaacccacatcttgttaatgtgtatgttttaatgttttttgagtccaggtctgctggaaacaaattctttcccttcttgatatgtcccaaaagtctttattttgccattatttttgaaggctatttctgctggccatagaaatctaggttaacaggttgtttttttttttttctttcagctctttatggatgtcatcccattgtatttaacattctattttttcttttcttttctttctttgtttttgagactgagtctcgctctgtcgacaggctggagtgcagtggcgtgtgatctcagctcactgcaacctccacctcctgggttcaagtgattctcctgcctcagcctcccgagtagctgggactacagggatgtgcaccaccacacccggctaatttttgtatttttagtagagacagcggtttctaccatgttggccaggatggtctcaaactcccacgctnaggtgatccgcctgcctcggcctcccaaaagtgctgggattacaggcataagctactgcgcccagcctacaacaaatggagggaggaaggaaggggt

SEQ ID NO: 231294 - DNA, 1117 bp, Homo sapiens
atctccccattctttcctctttcacggttgtataatcacatatatgctgtaaaacccacatcttgttaatgtgtatgttttaatgttttttgagtccaggtctgctggaaacaaattctttcccttcttgatatgtcccaaaagtctttattttgccattatttttgaaggctatttctgctggccatagaaatctaggttaacaggttgtttttttttttttctttcagctctttatggatgtcatcccattgtatttaacattctattttttcttttcttttctttctttgtttttgagactgagtctcgctctgtcgacaggctggagtgcagtggcgtgtgatctcagctcactgcaacctccacctcctgggttcaagtgattctcctgcctcagcctcccgagtagctgggactacagggatgtgcaccaccacacccggctaatttttgtatttttagtagagacagcggtttctaccatgttggccaggatggtctcgacctcttgaccttgtgatctgcccacctcccaaagttctgagattacaggtgtgagccaccatgcctggacttcttttcttttttaaatagagatggggtctcactactttacccaggctggactcgaactcctgggttcaagtatgtgccaccatgctcagctaagactccatttttttctggtctgaaaacatggattagccataacccatgttgccattctcacataactaatgtgcctttattctcctgttgctctcctgttgcttgtaagatctcttccatcttcaattttcagcagtttgattatgatatgcctatatatgggatttttaaatttgttggcttatttttgttttgtatttaacttgcttgggatttgctgaacttcttccatttgtgaattgatgacctcatcaattttagaagttcctgagcattgtctcttcaaatatgtcttctgccacattctcttctctccttctgaaactccaattacatatatgttagaccatctgatattatcccacagatctgtcttcatattcactgattctttcttctgctatgtccataaactgttaagcccatgtaatgaattcatttctgc

SEQ ID NO: 231295 - DNA, 450 bp, Homo sapiens
tcagagcctcttatttgaagcctttcctacttttgttcactgccttattccacttggctgtaaaatatgacatacgtgttaatttaagtttgtggcttggtgtccattggctgtcttcctcaattagagtacagtcctctggggaggccgacttctattctatctcaaacccagccggtcctgcaccgagtgagggcccctgagcagtgactcgcttccttctcctggggaggagagggtgggggctgccggccgagctctctggctcttcagcagatcagtgattctgaggaggggcaagacttactcaagataagatcactgttcagaatgaagtacaacctcattgttctgttctaattagggattggtgtgtctgcataaaagaagcctgaattacggaagattttagaaggaggttgctttaattatttcctaatagtcattgta

SEQ ID NO: 231296 - DNA, 518 bp, Homo sapiens
tactcctgtttgctacaggtaaaatggatggaacatcagacagctcattatagagacaagtaagctccagttccaaagttggttgacagaacaagtcatgaccttgtgtggaggaaaatgagatcccgagtgaagtctacaatgtcattgactctgaagaaggactcagagacccattggtgtttaatgacccttactggcctatgcaatggaaactggtatgatcttcagaaatagatggttctttggcagtgttaagaaatattatttttgtcatgttctaatgcagtagataggcacttttatgcactgcctgcttttatctattggttttgcagagagagacttagcaaacttttgatgaaatattactgccatcttattaatgaacactaatccttttaatttgattacatccttagggtttgatttaatctataaaagacaccagtaaaaaccccaagatatttaaatttggtgtgtgtaaacagactcattacatagaaatgttgttgcca

SEQ ID NO: 231297 - DNA, 529 bp, Homo sapiens
tactcctgtttgctacaggtaaaatggatggaacatcagacagctcattatagagacaagtaagctccagttccaaagttggttgacagaacaagtcatgaccttgtgtggaggaaaatgagatcccgagtgaagtctacaatgtcattgactctgaagaaggactcagagacccattggtgtttaatgacccttactggcctatgcaatggaaactgatatcaagataactgcacattttaacctataaagaagccctataatctgtcggggagccacatggagagccttcacaacccagaaaatctaccttaaaagggttcttttatttggagcattggaaggctacatgatacttcacaaatgtgcttgttaagctaaattacaaaaaatattattcagtgagctaatgatggaattctaaaatatattgtgggttgcatttgatgacttattggagtccccaaaatattattgtaaagataaatattatatacattgagcctcagcttcttgataataaatcacc

SEQ ID NO: 231298 - DNA, 581 bp, Homo sapiens
cttccttccttccttccctctttctttcttttcctttcctttcccttctttcttcaaatagcatctggactggatctaaactaaactcacagcacatttattttgagtgtctgctttgaggatcagtgagactcaagtgaagtcttccccatatgtagacatgttactactttgagttactctcagttatacagttaatactctgagagtaactgtcaatcaacctaagcagtacaatctgtcagcaggctagcaggctaagagcggtctgtcagttactttttactaactttgtagttcttcatccatagtcatctttacgatttcactggaaataataaaaatacattcattcatccactcaataatgtgggatttgatggttaattgtttgtgtcaacttgactggatccggatgccaggtatttagctaaacattactttggggtgtgtctgtgagggtgtttccagatgagattagaatttgaattcatgggttcaataaagcagattgtcctctatggttgttagatgtttcaaagaatcatatttctgactggtattgaatcagatgagcacag

SEQ ID NO: 231299 - DNA, 366 bp, Homo sapiens
ctgtaggcgagagtgagccttaggaagggcgttggacgtggccaggatcacaacaccatgcttgcactcaccctgtgatctgcctgcctcggcctcccaaagtgctgggattacaggtgtgagccaccgcacctggccaagggtgacatttctaaaccttatctctaaattctgtgtccattattcagtattcctttaacttgtagagcatggctattacgtgtttaagcaacatatatctctaaaaagattcgaggccgcttataagagaaagtatattatgtgtaagcacagattcattaaaataagagtttaaaaatctggggtcaaatttagggggtagaggggatgagggataaaaaggtg

SEQ ID NO: 231300 - DNA, 608 bp, Homo sapiens
catgttataattccagttgaatcttggtatttttatgtcatctttgcagttctctagtgatgcgcaatgtgtcttcctttatgagctatagcgtgcattatcaagttggaaacgttactcactttagtacctggatggttataagcatcaaaaccaaacttctaagtctaatcacaaagcctattactttccctgatttaaaacagtaaaatgtagagaagatgatgatttttacatatcctaagaagcacttggcagagcaattagtttcataacaagtgattgttttttaaagctctctctagaataagaatgagtatcttgatgctagtgtcacttttaaatagctatggctccaggaatgtgtctgttcatgttattatcttaaatacacaccttatctatccatattgctatacttcagatgtgaaagtgaaaataaaggtgtgaagtgcctagcagacttgtatggatttatgtaaatcagaaaacacacaaacaatccattagtctcagtgctgaagccctgatatattaaaatcaaatatggattatttcctaaaaatttcacgtacacacataccatcatatccagtgatttacttgcc

SEQ ID NO: 231301 - DNA, 352 bp, Homo sapiens
ataattttttgagaaaatttataattagattttatcaaattcaagttgttaagtattgttcttttcttactgacattgtgcataaatggcttgagatcagagtttgcattatttttcattttgtgaaaattatcttgttatattggtaatatcatttaaaaatcttttttattcacagtagttctctaatctctttaaaaatatattatttctttttataagaactcatctgtgattatgggagttaaaaactttaagcttttaaaaaatgcccttgtttgttcagagcccttctgtttcttactcagaatttgacttctatataataaagagaaaactaaaattttactcc

SEQ ID NO: 231302 - DNA, 500 bp, Homo sapiens
caaggggctgaaagctggaagttgtatgaaggtgttcttttctcacaccccagctactccgccccagtcgaagaggctaattccgggcctcttataaaaataagaaagaaaaggtaaagaaaaagaaaatctaattatgtggcatgtttcagccaggtgttcctggttccaatgactcagaccctattggagccccgaggatctggataattgggcctgcctagacagagatgaaggatgccatttctaaaaggaggaaggggagaggaaagtccatctcttggggtcttgtagaaaatgccaaagaccaaccaagctaaattattgtgtccctgtagatctatttgcctatttacgtacagcaggctgtgggggtggggggtgagggaaggccgggaataaacgaccaggatggagcgggctggcaggagagaaaatgcgccccccactctttgcgggaacagccaacgggcctcctcagctcgcagctcaagcggccg

SEQ ID NO: 231303 - DNA, 473 bp, Homo sapiens
aatagtgataatagatctccattaatgcaatattgagcatatcttcttttgtttttcaaaccacttacaacaatgctcttattctggccctgtaataatccacgtagcagggaaggtattgctctttccatttacaggtgaattagcaatgaaaatgataagctaatacacacctcccaatagccagatgcttgagaagtccctagcacagtgcccagtcaagcaatgaaacaagtttctatccttccttactagagtgagttgccaattcagcatttaactggagagtcccatttcattgtagatgttcatttctagaacattcagtcctttaaagcaatgtttctagtttgggaaaagtagaatcacaaattaaaatgggtttctgctgtaggccaggtagatggcaggtgtattacattcattatctcaatccttataacaatatacaaagaagatatcttcattttcca

SEQ ID NO: 231304 - DNA, 475 bp, Homo sapiens
atattttaagataatttcagacttctggaaaagttccaagaatagtcaaagaatttccattttcttaaaccagattccaaatatcaacattttatcacatttgctttatcatttctttgctagcatactttattctctaaattatttgagactaagaacaaatgtgatgttcctttactcctaaatgtcttaatacgtatttcctaaaacatggacatcctcttacataaccacagtgcagctatcaaaatcaggaagttaatactgaagttattttccaatctaaagaccctactcagattttgccacttatctcagtagtgctttttatcacaaagaaaatcttagatcacatattgcatataggactgggggttgtggttcacacctgtaatcccagcactttggcctcccaaagtactgggattacaggcatgagccaccacacccagcctgacctgactttatcaaaaaa

SEQ ID NO: 231305 - DNA, 693 bp, Homo sapiens
gggttctctgttcattccccatcatagcccaggacagagttaatttagttcttagctaaatagagtcagtgcccagaagtatccaaatgagaatgaaatatattgataattctgttatccaaatgagagtgaaagataatgataattctggagcaaactggactaacatctttcagaaaaaacaatatatatatgtgtatgtgtatgtctgcaattatcaggataattcaaggaaaacaaatactattgctcgaattgatcatataattatggaaaatataagaagatgtgaaaacaaaggccctcttataaaatacaaagacctgaccgggtcaccaggctctgctgaaactgttcaatgacttcccagggttcttaggccagaaccctcagcctcctctcaaggcctgcctagtctgtctgtgctcttctctgcagcatcactggcaccacacccctccttgccctggcaagccagctcctctgcccttctttcagctcttgcaagacttcctcttgtttttgccactgagcctttgcacatgctgcccttgcttttacttaccctagctacttattctatagttttctactcaaatcccactttgggaggtaaaccttcttttacctcccagaacataatattttcatagtatttggctctaataaaaccaattttcttcccagaagcac

SEQ ID NO: 231306 - DNA, 397 bp, Homo sapiens
cgggctgaggaattcggcacgagggggtatggggtttcttcttggcgtgatgaaactgttctaaaattgtgatgatggttgcacaagtctgaatatgccagaaaccattaaatgagtgaattgcatgatatgtgaactgtttctcagtaaagctatgtacagaaagagaagcagacaaagaaagatgaaatatttttgcagtagagaagttgtagcagcaatgtgggatgctttgggcttcctggaagccactgagattgggtttctattggaaaaggaagagaaaggaggttgattccccttctctgtgatcatctattcagataagggttatgacctctgacttagatgataataatggcaggaattatctagatgtaacagtggggggcctccc

SEQ ID NO: 231307 - DNA, 372 bp, Homo sapiens
gctgggagagggcgcaggagtgatgttagtggtaatctattttattttcaggtgtgtttaggaactgggctcctggagacaaccaagaaattgggaactggaagtggtttgactgaaggagtaatgggagagacttcatcccaacggcgaatccctactgaggcctgaaaaacctaccattagaaattcattagcatcaatagagtggagagacagccaatggaatgggaggatatatttgcaaattgtacatctgataagggattaatatccaaaacatataaaaaactcaactcaaagtgagaaaacaactcagttaaaaaatgggcaaagagcctgggcaacatagtgagaccctggtctctacttaaa

SEQ ID NO: 231308 - DNA, 393 bp, Homo sapiens
catttggatattttcctgcttttttaatgtagagagatgtaataagctgggctattaaaataaatatagttcctgtatgaactttatttcaaggtaactaaataatagataagagaaattgatccctggtggaattccaattaataaaacagaaagaaagataaaatttgtataccaccattttgcaattcataatggaaaaattgatctagattgtgatcatcagtgactgctaaaatcattaggtgaaaactgatggacactttatacttaatgaaatagaccaacacctgaacccatgaccagcctgatcaataccaagagggagactttatgttcatcttgatgtaatagagaaggaaagagagagcatcccttttcagtattcttgaa

SEQ ID NO: 231309 - DNA, 141 bp, Homo sapiens
cctgccgcacgcccccatcacctacttgcggacattactccaacagttcttttctttctgtcctgtattatcaaatttctgttcttactggattttcatgctctttcatcattatgaaagcatgcagtaatttcttcatta

SEQ ID NO: 231310 - DNA, 678 bp, Homo sapiens
attagcaactcccaaaacacacatggtcccagagaataagaggaccacagctgagttgcttttcagacatcagacagctgtccttgtggatgaaagaaactcctttccaactttgaagaaaatgtccagggatcggggagcaggcatgtgatattcttcaaggtgccaccagcctttctcaataaaacatctccagtgggaaaacatggaacccagaaagggctggtgtgggaaaaatatgacaaggatggccggcaaagtaaacccatggtgaattcaaccctgagaaagcagatttcctggagtgtgcaagctttgcttaggcttagttttaataaataataaagagacacaattaaacaaactaaaggtgatcttgccccggatggctccttaggatctttagaacatggcaattcaatttaaacgcggagcccctactctgctggactgacaggaaattgaactgtccaggtcatgactcccgtgtatgaagtgcagctgtccaggtcacccctggaacatctttcacaaccttgctgagggccctgctaggaaccaggcatcttaagaagcactaggtcatctggaggcccttcccatcagtagttcacatgagcacgtcccagtctgcatggtctccttggggttacccctctgctattaaatattttctag

SEQ ID NO: 231311 - DNA, 162 bp, Homo sapiens
gttaatgacaaagttctccagttaaaggaaggcaaatagtgttattaggaatagattactatatgatgattaaaggctcagttcaacaggaagatgattgatagaactttcctacatttgtaacacagtcttagaagatattaaagcaaacattcaagaaga

SEQ ID NO: 231312 - DNA, 432 bp, Homo sapiens
gaacttctgcaactctggggtcgggcaaaggccccgccgagctccagctgctgaagtcgaggcgggagccccggactcctcgagcccgcggtctgcctgcgccgcccgggccgggccaagcccgcagccctgagagtccagcctgagacggccccgagactacgacctccacagccaccacctccaacgcccctaagccgaggagcgagaggggccccgcccgacggccaccgtccgcacccagtccctggccgcgttggccccgcagccgcccgcctcacctgcgtgtccgccgccatcctgccggggctgactccggaaccgcttccggaacgcttccgggtcacagcgtggcccacgcggcagggcgaggccgggagccagcgggggcagggccccgggcttggtgcccccgggcaggacggcggccgc

SEQ ID NO: 231313 - DNA, 583 bp, Homo sapiens
gcagtggctcatgcccgtaatcccagcactttgggaggctgaggtgggcggatcatgaggtcaggagattgagaccatcctggctaacacggtgaaaccctgtctctactaaaaatacaaaaaaatagccgggcttggtggcaggcgcctgtagtcccagctactcgggatgctgaggcaggagaatggcgtgaacccgggaggcggagcttgcagtaagccgagatcgcaccactgcactccagcctgggcgacagagcgagactccgtctcaaaaaaaaaaaaaaaagaaaagaatattaaaaatcacgtttgaaattaggtgagtggatcttgtgtgaatttaattttaatcagtgctatgcttctatgtccttaacttggaaaccaacccacaaatcaagatgcatttacattaatcatcaacaattctaaagatatcatgcaagtcattattcactcattcacccagtgtggtccctactctccccacaaggggttatggggagaggataaaatttgagaaaataaaaaaaaaaatccatgaaatacagtcatataataatagttaacatatattgag

SEQ ID NO: 231314 - DNA, 371 bp, Homo sapiens
gcagattaaagaaaaaatgaatacagaatagcaagatgtagccagggggagttgatttgcacggaaaacaattgaaaggggaacaggaggttggcaccagattccgtggaaagaaaaggaaatgaagaaaggggacaagtaaagatgttctttgttactcttcctgatattgaaacttaaaaggtactttttctgagaacatttattaagggcacaataatagatgtcataaacaaaatcctccacttccctaaacaactgaggtcctaacagctaatagtatttggctggaagtgaagctctagagtctgggacactgtgatgctggaagccagccccagcccctgtgcagctggacttgacccgaggat

SEQ ID NO: 231315 - DNA, 386 bp, Homo sapiens
aggaaggctgtgtttcgattgagtaagagggcaatctttgactatctgaaggattgtccttagtagagggatggacttgttttatcctttggaacaaaattagtcttgaaaatcaaaagaatgatgctaaacatgataaaatttcccagacatacaaatagtccaaggatggttcaggatacttccaaaggcagctcctcatcactaaacaaacagataaaatcaagataatgcttttaaaaattcattcaatgaattgcattacttacaatatgaagctagctaacctctctgaactcctgttgaattttatgaatctttgattgcacggaatagactagtgataccatcaataatgtctcaaggtcatgaggtgtttacatcac

SEQ ID NO: 231316 - DNA, 355 bp, Homo sapiens
tgtgttctgtgacttgcaaattattctgtgagaatacgatgatgggggaggcacagaactaggtttctgtggtcagctaagttgtggaaatgcagtaagatcatctgtcttttggaatcttgatctacatgaacataggaaaggctctgagaagctcttcattcacagacacacacacacacacaaatagacaaatcggacttcaacaaaattaaaaacatttgtgcctcaaaggaaaatattgagaaagtgaaaagacaacccacagattaggaaaaaaaatttgcaaatcttatatctgataagggtctagtatgtggaaaatataaaaaacttctacaatttaacaatgaca

SEQ ID NO: 231317 - DNA, 378 bp, Homo sapiens
gttgaaacttccttccccaacctcattcccctcgctcaccagaggtaacaacaatctaatctaatttggtgtttataattctcagatctgttttataataatgctatatatggatgaaaccataactatcccaagagatcttagaatttacattttccttttgacttatttcgacataatttcaggaagttttaagaataagaatacccacctgcccttcacccacattcctcaaatgttaactgttcccacacttactttttcgtgtctttctctctctcctcctctttcccccaccccactgtctttatcccctgaatacttcagaaatgtttcctaccaaggacatttacgtatataaccacaatctttatcagg

SEQ ID NO: 231318 - DNA, 724 bp, Homo sapiens
cagttgctaacatatctggttgtttccccattaataatgctaagattgacacctggatttagggggccatcatatttatttaaaattccttcaataattcaagcttattcaagctgcgagacttgcttaaagataagtgaaatatctaatcacaagggaagtctgttttcaaactatataaacaataacaggagtcataacagttgttttcttagaactgaatacctaacaattctgcagctctttcctcggtattttattataagcagattatatcttaattgttcccctttgttttcaaaggtttttctcttctttgcgtgaatcagtttatataaaaacatatatattcttattttcagaggtattctgctctgaagaacggttttactttataaggcatcagttccctctaatattagaaccttacaaagccacagcactttatatgttgcaaagcaccctctccatgaaaattagttctagttgatgcaacagacaaaacccgcaaatcacagtggcttaacactacagagagttatttcttgctcatgctagatttgatgtagctctcctgttggcatcactcttttctgagtagtgactcctggtcatgggctgtttctattatgtagctacactgattgctacacggggcttccatgccatgatgaagtgagaaaagagagcctcaggattcattagggtgttttcaggcttacat

SEQ ID NO: 231319 - DNA, 449 bp, Homo sapiens
ataaaagaatcttcccacagcaaataccccaggtccagatacctttaccagtgaattttactaaatattttaggacaaaatatgtaattttacgtaaactttaccagaaagtagaaaaataagagacaatgtcacccatttgtgaggacaacataaacttgatgccaaaatctgacaaggacattataaagaagaaaaattgcaagcagatctcacaaatgtagatataaaaatactactcacagagtgaattaacaacatggaaacagcaaatataaaaagaagatacactaccaagtgggacttattccaggaatacgagattggtttaacacgtgattatccatcattattcatcacatgaacagaatgttctgaatttatcaacttggcactcccactcctgtgtaagccttgaaaataaattttctggaatcctgtgttcagca

SEQ ID NO: 231320 - DNA, 554 bp, Homo sapiens
catagccatttctcattgactagagcaggccctagcgagcccagcccttagtctctgtcccctccaggctaccctccatggtagcaaccaggcggcccttttggaaacacacatatgaatatgttactcagggacttccaaaggctggctagcctttgcttcagaatgagatcagctcttcagcatggcagcggcagacagctcctaccgctggccccagcttcctctcaagctggccctggcgctctggactcctcacacttctgcctggcaaacacctacttggtcttcaagccttcattcttcatagaggctacttgggttctgccccacacctgtcacctgaattgtcattatgtgtgagctccttgagaaaaaatatatgacttggtcatctttataccctcagtacctagcataacacctggcatgtagtcagcacttagtaaaaacatttaaaaaatttttactgtctccattttgcagatgaaaataagaaactttaaatgaataaaatgtttgactcttggggtcaaggccataataattagaaa

SEQ ID NO: 231321 - DNA, 1463 bp, Homo sapiens
tacattataaagtgttgaacaaatggttttttatttaaaaaaaaaactttattaaagagatagtttggggcattttttctttacattattttaaaatgacaatatccttctatgttagaaatacaacaattttggaaatcatttctaaatatatttagcaccccactattcttaatgtcatgttacatgaaatttacataactagtttagaatcagcattactgggaaaaagacaatgttcctatataaattctactacatataatatatatatgctactgtttatgagaagggtcaataggataaagaaactttcaaaaaattatatacacatacacaaatacacaagaacattttatattcattattcaataatccttagaatgatgacaatgcttatatgtaaaaaataatttcactctagagcagattacaagtaaatttatctgccacatacgagaatctatttacttatgttatagcaacatctcttttctaaaataaaaacatggcaaatactcagcttgatcatctgcactatacaacagaatttactcggaatgaccttttgatcatttgcaaaaaattcaatttaatgttaatggatgaagatattatatcactgttggcaatatttataaaaatgtgcttatggctctggaagcaattcctaaaaagaggtagtaaatgttctgagacttcagaattgttagaaaaagttaagcttcagttggcgtttactgcatataagtatgttgacatatgttttcctgagcaaatggcttattctagatatatacgttggtatattcattgaaaattagatttattatgttataaaatgtgactaaaagcccatttaaagggcacatatctctcatcttttggttctaacgtgaagccaaatgaggacaggcgcatgattcagtttatacaataagaaaattgccccaaagtggatgaagcacacacatcagcagctcagccccactccgtacaatccaagtgcattcaacaagtgatatggtttggctgtgtccccacccaaatctcatcttgaattgtaactcccatgattcccacatgtctgtgggaggaacccggtgggaggtgatttaattatgggggtgggtctttcctgtgctgttctcctaatagtgaatgagtctcatgagatctgatggttttaaaaatgggggtttctctgcagaagctctctttttgcctcctgccatccacatacgatgtgacttgctcctctttgtcttccgctatgattgtgaggcctcctcagccatgtggaattgtaagttcaataaacctctttgttttgtaaattgcccagtcttgggtatgtcttcatcagcagcatgaaaatggactaatacaacaagtaaatcactgaacatttaatcccagcagttctcttttttcaaacttctcccgttgattttgtgtcagcc

SEQ ID NO: 231322 - DNA, 442 bp, Homo sapiens
gaagaatgtaaactccatcctatcttctcctcggccaatcctttgcctttctgaataagccaagaggttgccccacacctcaagctaagacacatatttggaactcactctgcccctcttcaccttcaaggaaaactggtttgttgctacctctgcccatacctgaaacccccgggctctccagcgttggaactgtggctgctccgagagggggagggcagacgacatgtagcaggttaagaccggggcaaacctgcacctcacacaagcatgcaatgtcctggggtcaatggggtaaagttccaagcgagtggaaggtaaatcacgactgtggcaccggagccggaacacccccgcgagcaggccttgctgggtagttccgtgcggggcggaccgcacagccctatcagcttcctggccacagaaacgccgcacgcggccg

SEQ ID NO: 231323 - DNA, 187 bp, Homo sapiens
acacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcc

SEQ ID NO: 231324 - DNA, 445 bp, Homo sapiens
ttatgaaattaaaaacagctttcatggttatcttcaaaaacaaccaatcagctcaaacaaaagcttgatttatacttttcacagagacatttccttaggtcaataaagctgaatccctgggtcacggggatgaacttgcgtctttaaaatcacttgcgttgagcaagagaaaagggcagcatcaacgcacgctttagccctgatcaaagcctctaaaggtcaccaaaggcagggtctggcgaagccggtagaatcggctcccggagaacaactgaaagccttttgcagagcccacgagtcacaggccggcccgaccgctttgcgtgtctgtacattctccccgaaaccccaggctgctcatctttgtgttgagctttacaaatggaagttttggagagaatatcaaagttcaaagttttctagctctgacgaaactaggttaaaa

SEQ ID NO: 231325 - DNA, 614 bp, Homo sapiens
aactcgcacccgagctgacacacgatggaaatagaactgaataataattaacactattttccagtagggtaggacaattgttatttaaaacatagtccctatagctttatttaaacgtatctagttaaggttaatttggcatttaaagtagtaaatcaggaacattctcctaacttggattttcttgggaaatgcactaaacaggacaattattcctgaaaacctagtgaccttcacaggaacatggcgggacctgtgacactaagtaagcttcagtgaaaactgttcacggtcgtaaccgtagaagtgttgccaaatctgtttccatactctctttgatcatcatcaaacattctcaaatgtaggcaatgctaacactaattatagaaattaagaaaatgtgggctcctgtttgtaactaaacggacgtggggaggtgcacctcctgtcactgaggggtgcctttcatggacagtgatgctttgctttgaatggagagggcgaggaaccttgacttacagtgactatctaaggttgtgataaatatggcatttcaggttttttttcttggatttcccattaaaaatagtcttgtatcttgcaaatttttaata

SEQ ID NO: 231326 - DNA, 428 bp, Homo sapiens
gtgttgattttagctagaaacccaggtgaatctccattttcctgtgaatctccattttaccataacagagaagctgctttttaaaccagtaatttcttcaccttcccacccccacttctatttattaaattttaaaaatgtagcctgatttgggtgtattcttaaagaagtcaagtgtcctttctccatttggtacacagttactggttttttgagtgatatatgtacaagtcacttaaacttcttagagcataaagagagaaagtgaaaacttaatttggagggcatactcgtagaccttgcctgactgtgctcatgtccaggcaggggggacagtgtatgcaagaataatttggagttcctgccagctctaaccagcttcatcagtggctggataaattgcaggactctaaacatttccctgaaga

SEQ ID NO: 231327 - DNA, 113 bp, Homo sapiens
caggtaaattccttttactcctcatgatgtttctttaaaaaattttccaaaatgcaatctgtttactaaaaacaatataagtattcaaaacaatccacaattgagcattttgt

SEQ ID NO: 231328 - DNA, 395 bp, Homo sapiens
tcagctgtaagatggaatgaacagtcccatccttgtcacgaggatttggtgagataaatcctggtgtctggcacacaggaagcgctcaacagatgctcatccccttctcctgtgtggggtccatggagatactaggcccaggcctcccttagaggcatctagctctgtgctgtccgctatggtagtcatgagccacacggaccattgagcactgaaaatgtggctgtccaaaattgagatgtgctttaagtataaaatgcacacaccagattctggtggcttggtatggaaaaaggaacgtaaaatatctcagtaataatgctttatattgattatgtgttgaaatgataatatttttgatatattgggtgacataaaacagattatgaaagtta

SEQ ID NO: 231329 - DNA, 333 bp, Homo sapiens
gcgaaagggttttttggaaataactgattaactgtatttctttgtcccaggttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaagtgagtacattcttgatgatttcttacctaatcttgttgcctgtttttgcttttagacctagagttgaagttatggggcaaggcaggggttggcaatgtgaagagaactgcataggtggcctgtgtaagactgac

SEQ ID NO: 231330 - DNA, 175 bp, Homo sapiens
gcgctcctggcagtttctaggacacaataggtattcaacaagctcttgttcatatttacctttaaaaatttccctcagtggtattaggtatatttttgctttcctacttttattttttcactttgaagtactttggaggcaggataacggactaaatagctcttatccctcacgc

SEQ ID NO: 231331 - DNA, 511 bp, Homo sapiens
agacatagcttggatagggtagtgtgaattggagggtgagaggaaaaaagaagctagagataagatgatacctggtgcatagagaagaaggaaactaggatagactgcatgctagcctacccacagttctcactcccttcaatcttccttttgttatgagcaggtgaccagttatatctatgtcccatgcaggcctttaccaccatggaaatgagaatcaggcacaaccatgaacaacactgagccctgaatgctcatgttaatggagcaataagttatctatttcaaaaatcccactttgtaagatccttcaactccttaatttatatttcatcaactctgtgaaattctaccttttcacaaagaatattctatgggaagtttatagatgtacaacaacaacaaaaaagtcggaatattctggagatagggttatggctgtacaacaacgtcaatgtacttaatgccacctaactgtacacttaaaaataaagtgataaatgttgaaaaa

SEQ ID NO: 231332 - DNA, 523 bp, Homo sapiens
agttagctgggtgtgatgatgcatgcctgtagtcccagctactcaggaggctaaagaaggagaattgcttgagctcaggagtttgaggctgcagtgacctatgatcgtaccactgcactccagcctgggagacagagtgagaccctgtctctttaaaaaaaaaaaaaagaaaaagaaaaagaacttggcatttgtccccccatccttccctaaagccccaggggtaaacctaaaccttcagagtatttattcattcaaagcactttttttttcttttttcctttttttgagacaggatgtctctttgttgctcaggctggagtgcggtgatgtgaacacagcttactgcagcctcagattttggggcctaagcgatccttccacctcagcctccccagaagctgggactacaggcatgcggcaccacgcctggctaatttttgtatttttactagacatagagtcacttgagcccaggagtttgagaccagactaggaaacatactgagacccccatttctgg

SEQ ID NO: 231333 - DNA, 479 bp, Homo sapiens
ttgatgctgtgtcctccagaggagagaaatgctgtgatctcacctggtggatggcacaaggcccaactgtcactgaggaggggaagacccaggaagaaaggtcaaaagtcaagcaaattgcctcactatcctctcaagtccttcagagcctcaggatcccctgtggaccctggaagttttcccccatcttactcaggtcactcctttctccgagaccttctaaactttgaggaaactaagagacctggccctaagcatagatgggacaggatggtgtaaatgtgcaacacaaaccagcaagacacaggtactctcctctaccttccctgcagagcaaacagtgttgacagcagtgaagatgatgataatgatgacaactgcagtgttttggagagcaaatacctagggccagctattttacagatatccttatgttactatccaaagaaactttataaagagacgatggaaaatcaaag

SEQ ID NO: 231334 - DNA, 648 bp, Homo sapiens
gtggggaccccatctgtcttgttcacggccatttccagcacaatgcctgacacatagtaagtcctcagtaagtaataactgaatgactgaatgagcaacccattttaaagacaaatacataatcagatcaatctgtaagaatttaataagatcccatgaaatgtgatttcaaaccattttttttcctaatagtaacttcacattgcagaaacttggtaggcctattttggccttatgatcaaaattaatatcaccaataataagacatactggtaccatgtacccattggtgaggtgtgcccagaagacatcatcgcttcagtggtattcttgccaaaaatccacaatctcaatctaatcataagaaaacaccagacaaacccaaactgagggacattccacaaaataactagtctggactctccaaaagtgtcaaggtcattaaagacaaagaaaacctgaagaaatgtctcagtgtggagaagacgaaggagacataatcactacatgcaaagtggaatcctggattggatcctggaccagtaaaacaacagagagtagtgggaaaactgcaggaatttgaataatgtctgcaaattatttaataatagtttaccaatgctgatttgctgggtttggtaatagtat

SEQ ID NO: 231335 - DNA, 932 bp, Homo sapiens
atgtgggaaagtgatcgatttttttttaacaccattgtcaacataaaacaactcacagagcagaaaaactctgtgagtgtaaaatatgtagggaagccttcagtcattttggtaacttaaaagtacatgaggctgggcacagtggctcacgcctgtaatcccagcacttagggtgggcaaattgcttgacctcaggaatttgaggcctgcctgggcaaaatggtgaaaccatgtctctacaaaaaatagaaaaagtagcaggtgtggtggtatgcccctgtggtcccagctacttgggaggctgaggtgggaagatctcttgagcccaaggggtgggggttgcagtgagccaagatgcactgcaccccagcctgggcgacagagccagaccctgtctcaaaaaaaaaaaaaaagtacatgaaaggattcactctggagagaagtcatatgaatgtaagaaatgtagaaaagcattgagttctctcaggtccttgcatagacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacaaaattacccggatgtgatggcacatgcctgtaatcccagctactcaggaggctgaggcaggataatcacttgaatccgggaggcggaggttgcggtgagccaagatcgcgccactgcactccagcctgggcagcaagagcaaaacaacctctgtcacacacaca

SEQ ID NO: 231336 - DNA, 457 bp, Homo sapiens
ctaaatagccttaatgagttgatagcatgcatagccagcttacaacaagatgcataagcaagttgcagagaagcagggttccccgaaaagcagtgctgggccaggagtcctagacagccactaatcctgtgtcttttggcaagcattcccaggccccaggctgcttgtgtgaacaatgcgggtgtgaggctgggtgattccactgatccctgcttctataaaatggctggagcaggtgtgtgagggagggagagatgctaccatgtgggcaacttcctaatgttgttggcactgggcactggggttgggggaggggacaccaaaatgaataaaaagactgcgttcctgtccttcaggaagttacaattgaattggcagataactaggcacatacatgtttgacagacacatgcatttgaccttttaagatattttctcttccaatcatagttcgcaa

SEQ ID NO: 231337 - DNA, 453 bp, Homo sapiens
gtaggattggtatcagctcttctttatacatcagtagcaatcagctgtggacccatctggtccagggctctttggggttggtatgtttttttattactgatttaatcttggaactttttattggtctgttcaggatttcagtttcttccttgttcaaccttgggaggttgtatgtttccaggaatttatccatttactctaggttttctagtttgtgtgcataggagtgtttattatagtctctgagggtttttaaaaattttttgtggggttggtggtaatgttccctttgtcatttctgactatgtttatttctattttttattagcctacctagttgtctctcaatcttatttattcttttaagggaccaacttttggtttcgctgatcttttcatggatctgtttcattttgttgttcatgtgtctgtttcattccgttaagctctgat

SEQ ID NO: 231338 - DNA, 911 bp, Homo sapiens
ataaatacaaaattagccaggcatggtggcgcatgcctgtaatcccagctactcgggaggctgaggcaggagaatggcttgaacccaggaggcagaggttgcagtgagctgagatcacaccattgcactccagcctgggcaacaagagtgaaactccatctcaaaataataataataatataataataataataggcactgttttagtggatggacaggtgagaaatacctacatttttcagtaaatagtgtgtttaccctggtgtagtgtgaagaatgtgaaaaaacttagtcttttgattttcactcagacatctagccgtgtcatgtttcaaccaaatgacctagaacaagtctcattttgtttttttttttttgagactccgtgtcaaaaaatatatatatgtatatatagtcatgtcagaaacatcaattatgaaatactcttgtttgcagaattatacttccacaagtcttcccgaaaggaagaaattcagaacttttagtgaagcaagacatggagctgagcatgatcaataactatgtcagtgattcttttgaggtgtccactgtgtgggccttttttctggcacacccttggttaatcagtgcttctaactactaccctctttccctggcagtttggcttgctgtatcctttctctgctttctgctctaaaatcagtccgtgggtttctgctcttgtcaggtatcctgggagagagattggctccaaggctactctgccattgtggcctcttttctatcagcaggacaccttctaaagcagtctgattggagccaggggctggtgcttctgggcaggagatgtcatttgagttctttgtgccacccccatagcaggtgcctctcctacattttttcccccaatgttttattatgtatactta

SEQ ID NO: 231339 - DNA, 304 bp, Homo sapiens
gcgcctgtagtcccagctactggggtggctgaggcaggagaatcgcttgaacctgggaggtggagattgcagtgagccgagattgtgccattgcacttcagcctgggcgacagagtgagactccgtgtcaaaaaatatatatatgtatatatagtcatgtcagaaacatcaattatgaaatactcttgtttgcagaattatacttccacaagtcttcccgaaaggaagaaattcagaacttttagtgaagcaagacatggagctgagcatgatcaataactatgtcagtgattcttttgaggtg

SEQ ID NO: 231340 - DNA, 639 bp, Homo sapiens
ctgggaaagcactgtgataatgaaactgaaaccctggagaagaagagtggtcttggcaatcgggatagaaggcatagagggattcaaaggtaaaacagctgtttgtcttgaaatgagtatccgtcggagggctgttttcaccccctcatgtcagcataatcgctcacaaacaaggtttcagaattaaagactactgtttatacggggaggacaggctctgacttccatttgagataaagtgattctgtgggaagcgtcatgagtgccatgctgggttcaccagttataaaacaggtgaatttcacattgcctcgtatcacctcttttggtggaattttcagttagtaaagagttccttttgagattgcagttgacagaaatttcttatgttaccctcttggccagataaatataaacatgaaaatcattccacctgggtggtggtgaatgtgttaacgtgattgtgaccatcactacacagtgtctgcgtggatcaaatcagcacactgtacacctggcacgtgtgcagtctctatttgtcagttaaatgttttacatgtttttaagaagatttgaaaccaaaaaataaagaatttagaatggtacattcctggctgaataaacaactgattctactca

SEQ ID NO: 231341 - DNA, 516 bp, Homo sapiens
gaaaaggaagactttttttttcaacaaaatttgttgttctgttaattacatttctattgttaaaaataacagaaatcagttcaagaatgtttaagaaaaagtgagcatttttggaaggatagtggagctcatgaaatctagaagttgaacaatccagctctacaagggcatgtggcagctgcagtatgtggacacaccctccagaatagcactgttgagactgactcactcccagctcccaatcctgtctcaggtcaatgcttgagagagataataggtctgattcaacttgaatcagatattcactcctgctccaaccagttgtggctgtggagttagagtcacatagcaggaacacagttgctgataagccatttttgtggacagagtgggtatctttaagagttacctatgatcaattcttggtcacattgtgaggcagttgaagtttcttttgtgtcctttatatccccctaacaacagggaagttttatcagtaaatgcctacaaaaaaaa

SEQ ID NO: 231342 - DNA, 920 bp, Homo sapiens
gagaattcactggcatgcccgaacagtgggctcgattactacagacctcccatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaa

SEQ ID NO: 231343 - DNA, 662 bp, Homo sapiens
cctttctcctcctttgccaaagaagacgacccactcacctcaccgaattgttcctcatgtgggttcatgggagacaaaatgtttttagcaggagatgaggcatttgcttgacaagaacatttctgagctgaggcttctggttttaactttgtcaaccagcaggcagcatttctctgactgtaaatctgagttaatttacagacatgctcctaaggaaggaaaaactgaatcagtacccttgctcctgacacagagagaaagtcaccaccaggagaaaaagaaaaaaaagatctcaggtttcaatgagataatgaacttgtaaccacctgaatatatcaacgagtacaaacaggagcactccttccttccttatagcctgcaaagagatggtgtcattgagaagagattactgtttggaggaggggtcaggagaccttttctggaaagggccagacagtttcattagtatttacctaatgtcatcttcctgtttgaggaccccatctgggataccacagcacatttggtcatgtctcctgaggctcctcttggctgaattcaggaaagaacttgagttctacttttgcagtgaagaacagagaacacctgcagaagctgagaatgaaatgagcccaccaggacttagcaaccgtcttgctgag

SEQ ID NO: 231344 - DNA, 444 bp, Homo sapiens
taagtcaagacaacaacaaaaaaaatagtgccctgcttgaaccaaggagaagatgctctgtgttcccaagagggaggatacagaagagaggaaaggaaagattaagaaaagagattggaggaattagcagatgaaataaagctgagatccacatgcaatgaagcaaccattagaaattccaccatataagactagggatgcctgatgtggaatttgaaaatcttcttgctgctgtgatatgacactcgcttttgtccctaaccacctcaacccatcctcagtaaagtctatcacacttatgaatgctttgtgtgaaagttttgttttgttttttaggaattcaggaaagaacttgagttctacttttgcagtgaagaacagagaacacctgcagaagctgagaatgaaatgagcccaccaggacttagcaaccgtcttgctgag

SEQ ID NO: 231345 - DNA, 571 bp, Homo sapiens
gagagccagttccttaaagtaaatttatctctctgtttctctctcttattacacacatgcatatacatgcacatacacaacctgttggttttgtttatgttttctggagaacccagactaatacagggagtgaccccggaccttagccttccagcctgcaactcaacggttcaggggaatcatgcttcctgacatgtgatcatctcaaccaggaagaagaccctgtattaataaatgtattaactaaatatcttgcctgtaaattattttatgctctcctttgacctttttgagaataatgaacactatcatccctggacttccttttcagaaatgcccaagcttggaactgacagatgtattcaacataacaaccaaggtctgcattcaccagagtgatctcatgggtgggaagctgggcacaatacactcttgggactgtacaaatctcaggctagtcacagtacgtgtcactgctccatcctttgaaaatatttttggtagataaaagcttgaaaaaaatgaacattataggtggtcctaagatggggggaaattaaccaagaataaa

SEQ ID NO: 231346 - DNA, 816 bp, Homo sapiens
taagagacagggtctcactctgttgcccaggctggagtgcagtggcgcaatcatagcagcctcaaatcctgggctcaattgatcctcctaccccagcctccagagcagccgggagaaggggatgggcagctttccccactatttcactttactcatgcaggatttctgagggccccatgaaactagctttctgtctcacagagggacatgaatcctggataaatcagccaatgtttggttcagaaattctcctagagtgtgatcatctgatatgttgaatgttctaacaaaatagaaaaaggaggtggttgcggtggcttatgcctgtaattccagcactttgggagaccaaggcaggaggatcacttgaggccaaaatttcgagaccagcctggacattttaagcaattcccacaccaaagaaatccaccagccaaacaagtctttatgcccaaaagtaaaagtagcttctcagattttcagtcatgaaacaagacaccattaagaagcccaaattctaaaatatagtgagacatcctctctataaaataataataataattagccgggcgtggtggggcgtgccttggttccagctacttgggaggttgaggtaggaggatcacttgagcctgggaggtcaagactgcagtgagccatgtttgtgtcaccgatctccagccaggtgatagagactttgtataaaaaaaaaaaagaagagtgtatatgcatcttaattgtatgattaaagacaactattaccctggcttgtgaattctacttctaaaaacaaggaattgtttttaaaattttttt

SEQ ID NO: 231347 - DNA, 320 bp, Homo sapiens
ctatacttcaccctgccctcggtctcctaagataagccagacaacatttgcaaaagcttttcaaatatatgaagaattttggggaagccaaggctggaggatcgcttgagcccaggagttagagaccagcctaggcaacatggtgagacccccgtctctacaaaaaattaaaaattagctgggtatggtggcacgtacctgtggtcccagctaataggctgaactagaaggatcgcttggacctggaaggtcaaggctgcagtgaaccgtgattgtgtcagtgcactcaagcctgggtgacaaagcaaggccctatctcc

SEQ ID NO: 231348 - DNA, 452 bp, Homo sapiens
agctagaaggataagaaatgatggtcaggggtttcagaggtagcatggtttctgttggtgataagtacctggaagagggtggctgagttcaggaggcatttaaagaactgagaagccaggttctgggagagcatcatgccttcactgaagacacccagggtgatagcaggggctggggcagaaaggaaggagcagagtttagaatcttcctgaatgtcagagacagtgaagagagagtcaggatggtaaagccagctgccataagcaggggctcagaagggtagaagaataaggcctgaaagttgcaaggcagcctcttactgactaaattttaaacttagtctctttgagcttgatgtcttcctctgataaatggtggtaagcatgtgcacgttatcacagagttcaaatttggtgagtcagtgtacccactgcattgcccagtaatacta

SEQ ID NO: 231349 - DNA, 553 bp, Homo sapiens
atgccactccacgcccctgcagggccccctgcccccggcaccctacaccgacaccggcgtgtcacccatattgtgacatcatcgtaatttctaatccactcagcccacaggtcgcgggcgtggcccttccctcactgtgtgcgttcttgccagcatcctcaggttcccgagccggtgaccagggacctgtgcgggaaagcgtggggctctggaatttgatcgcctttggtctaacaaagccactcagcttaaatgcagactccatctgttcttccaagccttctgcggatgataggggaggaagagcaatagccgttctagactacacagattgcagttaagtgttgcttttgttctcagagcacgtgctccccagagcagcactgggttctttttaaaaatcgaaaaaggagccacaaggtcactgttctccctgacctggatagctcagaacctcagcaaaggcacaaaggaaattggtctgaccgtgccttagaataactggccctttctctcacaaaaaggggaaaaaaataaatgaaatgaacatgga

SEQ ID NO: 231350 - DNA, 409 bp, Homo sapiens
ccgaagtgtcacaggatgaatctatgctatttggagagggagtatacatttaacttgaagcaatccctggaagaaaaattctactagcagagatgctctgagcagagagaaagcctgtctatatagtgaaagaatgaaaccaatacattgaaaaaaactgagaagagaaagaggtagagacttcatctgatacaagcatgcttgaaacaagagacacctgtatgattccatcttcccaggagctagcaggcagttcttgttgagttcaagccagttgagaccatcaacccttcaactgagcctgcatggccctgttttcagggaggtggatttgcgatttgttctccttctccttgctcagcagcctggtaagcaatctcacaaaataaaatcttttcttttttgcaaa

SEQ ID NO: 231351 - DNA, 509 bp, Homo sapiens
tgaaaaatttataatcagctaaatcgaaaatttggatatttgagagatgaagtttgtgagctataataaatgctttctttaaatcataatgaagcaaactcagtaattcacaaatgcttattaatatgttaattacaaggaatttttttccttaaaatgatttaatcagcccatttttactttctcatttttctgtatatttgaaaacaataaaactacgttgtttaaaatatatttctaagatggatcactaactaaaattgactttattttaactgagttctgtggtacatttgaattttttttaaagataaattattgttgggctgttcacattattaaaaatggttctctgatttcagaaagatgtatttttttagaacaaatgtttttatagagtgaactcttccaatgcatgtaaaatgtaatttcatttagaaaataaattttattacaatgccttgctttaagattgtcaaataaaatgtgaaataccacacagactgata

SEQ ID NO: 231352 - DNA, 435 bp, Homo sapiens
agaaagagattatctggaaagaagaaaataagtagttgattaaaagcaacagtggaagccagaaagatagtaaataatatcttcaaagtcctgggagaaaatagtgatagcctagaattgtgtacccagaaaatccgtctttcaagaatgaggggccaggcgcagtggctcacgtctgtattcccagcactttgggaggccaaggcaggtggatcacctgaggtcaggagttcaagaccagcctgatcaacatggtgaaaccctgtctctactaaaaatataaaaattagctgggtgtggtggcatattcctgtagtcccggctgctcgggaggctgaggcaggagaatcacttgagcccaggaggcagaggttgcagtgagccaagattgtgccattgcactccagcctgggcaatagaatgagactctgtctc

SEQ ID NO: 231353 - DNA, 404 bp, Homo sapiens
tgccatccttctctctttgaggttgattttgtttagctacaagcttggggatgtggagttgtgaggaaaccttctagaagattggcgtggtctggtactagaaaaaaaaaatagccaagttgcccaacagtctgaaggctttcttaccctcaggtccatcctccatgctgcagctggaaaggtctttctaaaacagttgtcatcatgtgtgacttctttctaaaatcgtctgtttccagattcctccctgtcattggttccagattccagggtgtatgtaaactgaaactgattgtcctcatctatacgaaaattagaaaaataatgactgtactttgtgagtttctcataaataatgactaaaagtttctgagtttcccacacaataaaacatgtaaccttat

SEQ ID NO: 231354 - DNA, 422 bp, Homo sapiens
gtggtggctcatgcctgcaatcccagcactttgggaggccgaggcaggcagatcagctgaggtcagaagttcgagaccagcctggccaacgtggtgaaaccctgtctctactaaaagaaaaaagagacaatacaaaaattagctgagagtgctggcgcgcgcctgtagctgcagctacttgggcggctgaggcaggagaatcgcttgaactcaggaagtagaggttgcagtgagctgagatcacaccactgtactccagcctgggtgacaaagcaagactccatctcggggggaaaaaaaaaaattaaagcataaaaatctcaactgtgtaataaaatgggacataactaaacaccaaattcatttgcctagaatataaacgtttcccagaaagtaaagcaaaaaaacccaaaaatatagtt

SEQ ID NO: 231355 - DNA, 363 bp, Homo sapiens
tcggctatgttaattagcttgattgaatcattttacaatgtatgcatatatcaaaacaccatgttgtacgctgtaaatatatacaatctttgtcaactatgcttcaggctgggggaagctggggtttaacagacaaaaagctccgaggaaaagagaaaagtgttggtgaagttgtggagacattggaacccttgcatactgtttgtgggaatgcaaaatggtgctgttgctatggaaaatagtatggcagttcttcaaaaagtgaagaacaacactgctatataataaaatcaatcccacttctgggtctatatccaaaggaaagtaaataagtatcttgaagaaatatctgtatccccatgg

SEQ ID NO: 231356 - DNA, 435 bp, Homo sapiens
aggtacagaaatttattttaaggaaagaagtggacaaatttgcaaatatgtatgtaatgaatgtgcaaagatgctaattacagtgtggtttataacatcgaaatattgacaaatcagaaaaaataaccatccaacaacaattagttatagtataaccacataatagactaccatgtagcattaaaaataagtacctagagctggaaatacgttcaggttactttttttttttttttttttgagacggagtctcactctgtcacccaggctggagtgcagtggcacaatctcggctaactgcaacctccacctcctggtttcaagcgattctcctgcctcagcctcctgagtagctgggactacaggctcgtgccaccacgcccagctaatttttgtattttgagtagagacgaggtttcaccatgttggcctggc

SEQ ID NO: 231357 - DNA, 394 bp, Homo sapiens
tgcacttcaggctccggagaagctggcactataggtgcataccaccatgcctggctaattttgttatttttaaaatttttttgtagagacagggtctttctatgttgcccatactggtctcgaacttctgggctcaagcaatcctgcctcagcctcccaaagtgctgggattataggcgtgagccactgcacccagccagatttttatttctgttcggggagagtggcttcctttcgtttctcctgtccagggtgtcattgcctatgccagcctgagtgtgtgggcctcctgtgggaatcgccacactgtcctgttagagcaaagcttgcagccaactcttgcccccagtgctgcgtcgacgcggccgcgaatttagtagtagtaggcggccgc

SEQ ID NO: 231358 - DNA, 370 bp, Homo sapiens
ttgcagctacaaatcatgaaaacaggtcataaaaccaccttgggtaagtaggtgggatggaaccagtggcctcagagctgctgctggggatcaggaagcccccagtccgtttctttctccctctctccctgcctcccctcagcctccctctctccctttctcttaggaaaaaattccagccaccacctcccagctgggctccctcaggagccacagcagctctggcctacactgtgcccatttcgctgactggggcctcaagcctggggtctgaggaggctttaggcctagtgacctctccctgaggctgcccaggggacagtagttgccttggtgacagtgggtggctggtgaccatcactgcccatta

SEQ ID NO: 231359 - DNA, 534 bp, Homo sapiens
gagaataagccaatcaacgctcctgagaaagagctctggaaagacttcccctattggttgcattgccgagagcagcttggctatcctgagttgaactagctgttggtcatcctaagggcaggcggtctcctgaagttggaccgaaccattaggacgtgccacagtaacagctacgctgctcagaaggcccgaagggtcttcctcagcgacctagcgtgggcacgcgccactgcggccaaaagacagaaatctttttaccggaagagatgaaatagaaagcaggagccagaggctgacttacagagccagtgtgcggatcagagttccttaggagcggctgctggcgcttgacgggcggaatccttgctgaagagaacgtcaaggcccgggcttcgccctgcatcgaacttactgcctaagaataagacccaaatgctgagcgccccgccccaacttgccagtttaagtgcaaaaatacatagattaaaatgtcagcctaataaagcagtggcactgagccagaaaaaaatagtc

SEQ ID NO: 231360 - DNA, 454 bp, Homo sapiens
aattatgaggagatggtatcgcattgtgttttaacttatatgcccttcaatcagactccctatgttttggtcctgccttctttcttctactggatgtgtagaagttactgaagtaccttaatatcaatcgcttttataacccttgaattatatcgacataccaaaacaaacatgctgggtgcagtggctcacacctgtaatcccagcattttgggaggccaaggcaggaggattgcttgaggccagaagtttgagaccagcctgggcaacatcgaaaaccctgtctctataaaaaaaagtttttaaattagcaaggcacaatgtcaagcacatgtagtcctgcctactcaggaggctggggcaggaagatggcttgagcccaggagttcggggttacatgattgtgccactgtacttcatcctgggtgagagagcaaggcattatctctttaag

SEQ ID NO: 231361 - DNA, 513 bp, Homo sapiens
tttgaaattaactcagatttctttactggaggatatcaccatcatatgatatcattaccactcagtaaaaaatgggtgcaagtaaacatgtcctaattaatgtcatgttattactcaactagaagtcagaagacctaggttctaatctggtctcaccctttacacgtgaagtgactaaacctctcagagattcagtttccctgtctttaaaatggaaataattatacctgccctatctatctcaggttgtgagggtcaaatgagattatataatacactatacaactccaaagaaaaatgatacatatttattttttaacagatggggtgtcactatattgcccaggctggaatgtagtggctattcactggcatgatcatagtgcgccgtaccctctaactgctttctgctgttttctgatatgagcttgaatcagtgtggtcaattggagaggggccttcaggttgggctgtgggtgagtcactgagtggaaataaatcctgatggtggca

SEQ ID NO: 231362 - DNA, 233 bp, Homo sapiens
ggagcgtgcagggcccaggcccgtgagggtgtgcaggaggctgagccagaagggcaggctggcagggagagctgggtggaaaaggccttgaaggtctggaaaaggtctctggggacctgtggccctggggaggcatggagggcagttggcagggtaggaatgtggctgcacagagctggcctgaggcccacccaggccctgtgagggacaggcacggactctcttagatcccc

SEQ ID NO: 231363 - DNA, 377 bp, Homo sapiens
acaatctcggctcactgcaacctccacttcccaggttcaagcgattctcctgcctcggcctcctgagtagctgggattacaggtgcccgtcaccacgcccacctaatttttgtatttttagtagagatgaggtttcaccatgttggccaggttggttgcaaactcctgacctcaagtgatccacccacctcggcctcacaaagtgctggagttacaggcgtgagccaccgcaccagtcatttcttagatgaatcttaattgttcgtgtgcatgtgagtcagtacttcttgattggtagcgtggattcaaattgtctatttcttgaaggtaaggagtaatccttttataagctttaaaaatcctctattggccaggca

SEQ ID NO: 231364 - DNA, 440 bp, Homo sapiens
caatatgtgtgataaaatgggaagtacacctgaagttttcctcctgcattctgaaatacaagttgcctcaagaaaaagcacttgtgcagtttttgaggtggctcaactaattgcttttctcatgggacactatttttacttgaaagaacgaatgacaaactatggttatttagaagtatttaccattttcttgaaaatgaatgaaaaaatgaatgaaacaagcctgttattttaaataagataacttagtactacttattgccaataaaaaagtttgagaattcaggtgaaaattagtattttggaaaacttgtatctgtcactgtgagcttgacagcttcccacatgctcaaattcttctgacagatcattggtgatattaatgaaatgtgatttttttacattgtataataaatgagtcaacgtttggaagatctgca

SEQ ID NO: 231365 - DNA, 413 bp, Homo sapiens
aattaagataaaaagaaagtacaaattctcaatatcaagaaaaagggcaaaacaaaactatggttatatcaaattaagggataagaaaagcatataattgcaactttatgccaataaatttgaaaacaggtagacaatttcttagaaaaatgtaatgtattaaactgattcaagaacaaaaagaaaacctgaagaatctcataattctcaaataaattaagtagtaagtttttaaaaaatcttctcacaaagattacaacaaggtctgttgattttgcaagtgtgaattctacaaacttttgagaaatacctcatcctaatataaacagacttccagacattagaataaggaatgacataccagttaattccttgagacgggtataaactttaaaacaaaaccagacattatg

SEQ ID NO: 231366 - DNA, 1027 bp, Homo sapiens
tttccccagcacctaaggaagtatttctagtaagttccagtggtatagcatcggtgactctcctgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctatgtacacttttcctgttcaaatgactgtgtggcttctctttcctaatcggactctgaccaatacgctatcatttgccaacaactcccaaagttttatcagtgactcagacctctaacctgaactccagctgcctccatgagatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatagttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaaatggtggtatcagggacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcct

SEQ ID NO: 231367 - DNA, 798 bp, Homo sapiens
tggctcagtattttttgaatgcatcctcatttgacaacaattttgtaatattttctagagagaatagtagggtaattcagtattttctatggatacattcggcaatatttaattattatttataatccctaacaattcccccatcattttaaaattcaagtatattttataatttttttcaaatgagagaaaattgctagaaatattttcaacatatgagatggaggattgcagagcacttccaggttccttctgcagtagctaatcttacacatgctttaaattgacaacagtcattggccaatttgtactgatgtcctggtttcagaggtgtgagttttatgttgtctttgttcatatcagtatttcacattacatcagcaaaaaatttttttttccaacacgtttatatgactcagtccacttcattaatgggattataacacaatacaaaagccttttaattacttgtgttcaacatgtatctcttctcttacgtaagttactgctttggtgtaacttgaagtcatttttcattacaattagcatcttcatgtcagaattatttcaacttattactttaattttgcattccatcaattttagcttcattttcgctcaggtctttactaaataaatttaatattcacatgtagttttaattcaggaatttgcagtttcttaatttattgaaacttttcaaaatgtatttttcctcaaattgtagttttccagtctatcttctttcccatgatgcctaagtccaatctattaaattctaaacaaggaaaagtacag

SEQ ID NO: 231368 - DNA, 130 bp, Homo sapiens
ttgtccttttcttttttcttcggactatttttctctctcttggaatatctttccccctctttatttatcgaaatcactctccctgtttttctcccaacttctccatggatcctctccctttctctttctc

SEQ ID NO: 231369 - DNA, 489 bp, Homo sapiens
aatctaagggcattattaaaatgtttgttcttccttatctcagaattgaagtatgtcagaagcaagacttttctttccattttgttatagtagaaatgcatacattaacaggtacgttttagacattacacgtgctcatctgacccaaaagctctaatgagctgccttaccctggaatgtttttcttagcttggatttgcttttttggagggattaagaaaagacttggctgggcgtggtgactcatgcctgtaatcccagcagtttgggaagccgaggcgggtggatcatgaggtcaggagatggagaccatcctggctaatacggtgaaaccccgtctctactaaaaatacaaaaaattagctgggcgtggtggcgggctgaggcaggagaatggcgtaaacccaggaggcggaggttgcagtgagccgagatctcgccactgcactccagcctgggcgacagagcaagactctgtctcaaaaaaaa

SEQ ID NO: 231370 - DNA, 469 bp, Homo sapiens
taagggagtataattaacttgttcattgtgtattgctcagaaagcagaattaagattactgtagattggctgggtgtggtggctcatgcctatcatcctagcactttgggagaccgaggcaggtgaatcactggaggtgaggagtttaagaccagcctggccaacatggtgaaaccccgtctttactaaaaaatacaaaaattagctgggcatggtggtgggcacttgtaacctcaactacttgggaggctgaggcaggaggatcacttgaacccgggaggcggaggttgctgtgagccaagattgcaccactgtgctccagcctgggtgacagagcaagaccctatctccaaaaaaaaaggaaacgattactgtagataaacaacctcatggccgggcatgaggtggtggtgagccaagatcacaccattgcagtctagcccgcgcaacaggagggaaactccatctc

SEQ ID NO: 231371 - DNA, 226 bp, Homo sapiens
gagagctttggttagaaatatgaggggtaggagaaaatcatttggccgtagaaaatactgattaatctttgggaaaatttggcatgtgatattaagaataggatcagggttaggcgtggtggtgcgtgcctgtaatcccagcagtttgggaggccgtggtgggtggatcacttgagaccaggaattcaagaccagcctgggtacaaagtgagaacctgtcaaaaac

SEQ ID NO: 231372 - DNA, 330 bp, Homo sapiens
tgggaccgagagattccggcttttccccatcacagggcggggacgttttggggaaactcctctgaggtcactgtgactcaccctgagggcaagcaagcaccctccacccagtgccctcgacttcgctgtgctaaaagagtttgaaaaaggatgcccagcctgcagcctaagcggagagaccccagggggacacttccccacccgagccttagtttccttcggctgtggagaggaataaccgcctggacttggcaggactgtgcagcattccatctgtaaacatgtgttgagttcagactatatgcctagcgttaaaaaggatgctgatga

SEQ ID NO: 231373 - DNA, 130 bp, Homo sapiens
ggattttccattttgaacaaaactcctctgaccagaaaaatcttacccctcctacccaggggatctgctgtgggtcagcagggctcccattgctgaaacaactaagcgcccttaaaggccaacgatcatg

SEQ ID NO: 231374 - DNA, 387 bp, Homo sapiens
catttgttttatgtttgttagtatattgagcagtgtattagggatcaggtatatagatgtaaaaggagtacacagtctagagaggaaaaatagtgacaggctgggcgcggtggctcacgcctataatcccagcactttgggaggccaagatgggcggatttcttgaggtcaggagtttgagatcatcagcctggccaacatgatggaaccctgtctttactaaaaatacaaaaattagctgggtgtggtggtggtcgcctgtaatcccaactacttgggaggctgagacgggagaattgcttgaacccgggaggaggtggaggttacagtgagctgagaccatgccactgcactccagcctgggcaatagagcgagactccatctca

SEQ ID NO: 231375 - DNA, 411 bp, Homo sapiens
ctggttcctaacaggccatggaccagtaccagtttgtggcctgtgggttggggacccttgccatagagaatacttcttcagccctaaatattctctgctctgtctattcatttctcctctcctctaaaccatggcaaccactcaattttttactgtctccataattttgccttttccagaatgtcctatatttggaatcatacagtatgtagccttttcagatcaggttctctcacttagtaatatgtttttaaggttattcatgtcatgacttgcttcctcatttctctttagaaatgaataatatttcattgtgtggatgtactagagttcagccttttatctactgaaggacatcatgttacccttcaaaatttgtcaattataaataaaagagctataaacatacat

SEQ ID NO: 231376 - DNA, 242 bp, Homo sapiens
actataaaaaatacaagaaatggattattatagaagtcagcccatgcttacttttgaaggaaaggagggtgtttgattggcctgaggcacatggagacttctgtggtggctggcaaagttccatttattgacgtgagtggtggttacaggagtttgtgcttaaataattcatcaaatcatacatttcctgtggttatctgtgtctgttttattttacaatacaaaaggttttaaaatgcaga

SEQ ID NO: 231377 - DNA, 469 bp, Homo sapiens
caatccctaggtttggggaatgcaatgtcacttccttacaacctcaggcagctgccagccagctcacttcctgggaatgctgtggacaagcagccagccccccaaagacccaaagctgctgagtagatcattgcgcatgcgccccgtagacattgcgaacatcaaatcaagtggatactaaagtgctttgtaaacccataaaatgccgttatcctcattcactgagaaaatcctagatacgagttcactctgtatggttttatatgtgcccgttcaccgtattttattcaactatgtttactctcttatcggatttctcacagcaacttctactaatgtcccccaacttctagatgctaacttaaccccttcccccaggagacacctcagaaatatatacattcacttgttctgtcacctgagagcacctagacacaataaaacctcaatagccataaataaaactagt

SEQ ID NO: 231378 - DNA, 644 bp, Homo sapiens
gtttaccatttactcagactaaaacattttattgaacttttaggtaatattaaggagttttaagaaaacttcctccacttgccccttaggtctttatatttcactaaatatctttgcctaaaccttatgatgggtatgtttactaaaggtactgacaggacttttaagtgtgaatacagtactgctcaatgtacaccaactgcacattgacaaaaattgtcctgattagattattcctataaacttaaagggatggtttcatatggatataccctagaggtggtgataactcattaagttagtctttattcttagactaatcttacttaagacataaagaagattagaaatgtgataacaagatacagcttctgaaaattaaccagaaagtttttttacttcaggtaaaacagttcttaaattccatatttctgtgacattcagaatggtttcatgactgacttaatatggatttgaagagaaggcatatttccaactattaaaactatgtgggctactgtgcccaggcagggtgtctcacacctgtggtcccagcacttcgaaaggccgaggcgggcagatcacttgaggccaggagttccagaccagcctagccaacgtggtgaaagcccatctccactgaa

SEQ ID NO: 231379 - DNA, 298 bp, Homo sapiens
ccatcaatttgtcattatttttcccctaatgtccaacatctttgtctatcgctgcatacatttaaacatacccattccactttcttcctcatggtctccttcctaaccccatgctgtcatcgggactgggtgctctctaaggatgcgttgtgccttgcatgctggagtcccatttcccatgtggctgttagcacgtgaagagatggtagtgatgttcaccatgataatgctgctggtttattgtggaagatctcagcagaagtcactgtacgtcattttgttatctctctcctttttt

SEQ ID NO: 231380 - DNA, 349 bp, Homo sapiens
caactccgcgtatttactgatcctcttaagccaattccagaactctttacattaacaattgctgctatagaatctcactttatttgggaggccaaaattataaatttcacatcaattacttcccttacttaccagccttagcagcaagagactttgtagtatttaaaaaattaaactccaacctcgaagaaaaaaattagtcagcattgaaaatatttaacataatactacatactaaggtttaaaagcaattaattccaaaagtgtggttctaaaaaagtgtttctgcaatagcaggactggtttggtatatagtctaccaaggtaacaacttctaaggtcgaacaaa

SEQ ID NO: 231381 - DNA, 440 bp, Homo sapiens
aactgaaacttggtctgagagccgccatgtttcatgtctcatttcaggctactactttgcatctttttgacttacagcacttaaatatgcaaatgcaaaattgttaaggttttttttttttttttttaaagatggagtcttgttctgtctgtcacccaggctggagtgcagtggcacgttctcagctcactgtaacctccgcttcccgagttcaagcgattctcctgcctcagcctcctgagtagctgggattacaggcatgcaccaccacgcccagctaatttgtgtgtgtgtttagtagagatggggttttgccatattggctgggcaaggtgtttcacacctgtaatcccagccctttgggaggccaaggcaggcagatcatctgaggtcaaaattgttaagccttttaaggaagagaaatgtatggcttattgatt

SEQ ID NO: 231382 - DNA, 444 bp, Homo sapiens
agctggacacaggctcagaaataatgagatgcaccctgggtttacacctctggaggactttcagagtctgcacaagtaagaaagaaatggtaaggcagaatgtcaggcagcctggctaaacagtgaaggagtgccctagttctcggaaaatttttgtctttgttcatttgttattgtgcttcaggatttaaaggcatctctgttaggtcaccagctaatgacagagataatgaaatggagacttcaccgaccacaaatgacaaggaatacaggctttgcaagattagtttgggaatgtcactaataaaatgggtgactgcagccctcagcagtaacaatagcaaaccatggagagggaaataatctgatttccagagttataacattaaaatatttaaaatgtcaacaaaagtttaaaagcaggaaggtatggcccattcacat

SEQ ID NO: 231383 - DNA, 469 bp, Homo sapiens
aagcatatatatttataaaggaggaaaaagacagttattatgtgataatcatacctggtaccctttccccctcattatgtcttttttttttttttttttgagaaggggttgggattataaaagtaacatatgtagttattaaaatgtcatacaggccaggtggagtggctcacacctgtaatcccaacactttgggaggccgaagagggtggatcacttgaggtcaggagttcaagaccagcctggccaacatggtgaaaccccatctctactaaaaatacaaaaattagccaggcgtggtggcgcatgcctgtaatcgcaactactcaggaagctgaggcacaagaaatgcttgaacttgggaggcaaaggctgcagtgagctgagatcaagccactgcactccagcctgggcaacagcgcaagactctgtctctaaataaataaataaataaaatgtcatataatat

SEQ ID NO: 231384 - DNA, 493 bp, Homo sapiens
aagaaaggaacagaagcaatattttaagtaataactgagaattcccccaaatgagtgtcagatatcaaactacagatccaggaagctcagagagcaccaaagatggtaagtgccaaaaatctacacttagccacaccatattcaaacttcagaaaatcaaaggtaaagaaaccatcttgaaagaggccagggaggaaaaataccttacctatagagaaactaagataaaaattacatccaacttctcagaaatcatgcaagcaagaagagaatagtgaaatatttagtgttgagagaaagaagcccaccacctagaattttatatcctgccatgttgtgttacccttccaaagtaaaggaagaataaagacttactcaaagtgaaaattgagggaatttgttgcaaatccgatttgtaagaaatatgtataaaagacttaaagcaaaaattgagggaatttattgcaaatctgatttgtaagaaatatgtaaa

SEQ ID NO: 231385 - DNA, 678 bp, Homo sapiens
ccggctaattttttgtattttagtagagatggggtttcactgtgttgcccaagctggtctcgaactcctgagcttaagcaatccatccgcctcagcctcccatagtgcagattttacaggcgtgagccaccgcgcccagccctactcaggctttaattatttatggcaagcctgctgtgtgtaggacactgtgccaagtgctttgcagtattttttttattgtgataaaagatggaacaaaatttattattttaaccattttttaaatgtgtaattcattgacattgtttacattcacaatgtgtgtaaccatcaccacggtttatttccagtacttggtcatcatcccaaacagaaattgtaaccattaagaaataagtctccattcccatctatgccttggtaacctttattctgctttctttctctatgaatttgcctgttttgggtactttcatgtgagtggtatcatagaatatttatccttttgtgactggcttatttcatttagcatactgtcaaaaaggttcatccatgttgcagcatgtgtcagaattcatgtctcttctcttctcgcttttgctttcctttcctttttctttattctttcctttcctttccttttctcttttctttttcctttccttttttcttttccgtcccatcatgtccaggctg

SEQ ID NO: 231386 - DNA, 571 bp, Homo sapiens
ttgtggtgaaattgccttttcttttggtagaggggaagaaagtagaagtcaagaatataaaatgagaaaacaatcttcccccttacaaaatgttagaaaggccttgactgagaaggcaagttgagtggaagcatccgcacttctaaagtgcttttgacagagcactgggattggagctacagataaattgatgttcacttttccagaaaacttgtctttcagcatctttaatggtcacaaggcttaatggtcacaaggtgggaagaggggatctacttttccaggagcttcttaggtcaattgcagaggggggacatactgcttatatggtattggcaccaatattagaagtgtttcccagcacagcaagatgaacaccttccccataatgccttccacaatctgcctttctggaacaaggcattcttgtgtcctagcaattttcagatgttcccacttggaagacattctagagcacagacaatcttattactaatgaaaaaagaaagccagtatcctctctttttattctttcccctcccccacaatcttgcttcatagtggtggtggg

SEQ ID NO: 231387 - DNA, 134 bp, Homo sapiens
tgatgttcattttcgctggtatcatatcttgaaagttttaacgatactggggcacagaaaatattagaacctccaaattcaattccagagtattccaaaacattttaatactagaactacctattctatttttg

SEQ ID NO: 231388 - DNA, 930 bp, Homo sapiens
cgggctggaaaagtcaccaactacagcatccaggtgctggccttcacccgcgcagtgagacggggtcaggagtgagcagatcttcacccggaccaaagaggatgttccaggtcctcccgcgggtgtgaaggcagcggcggcctcagcctccatggtctttgtgtcctggcattccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataa

SEQ ID NO: 231389 - DNA, 235 bp, Homo sapiens
acataggacgcagatggcatctgtgagaatggcagagtaataaccactaacagcttacctctccataaaagcaatgagaaccctggcaaaattgtcacaattaactttttaagagctctggaaattcatcaaaggcttgcagcaatccaaggatcactgattcaagaaaaacaactggaccttggtaagaacagtgagcattgtggcattttaacttaccctacttccatcccct

SEQ ID NO: 231390 - DNA, 305 bp, Homo sapiens
ctccattctgaatttgagtagaaatgagcaaacaggggagaaacaaagtacgtatcttccctgttggtgtgtataagggacccagaggtaagatcaccagccccaactccagttttggccataactctgggtgaggggggataaggtggtaaaagagatggacgtgggggataaggataagaattaaaccatcactaatatacaagagcctaaacttgtcctctactggcaaaatctgccatgtaaataattctgctagcccctcgtggttctggacattattgagaacacctttcaaggaccta

SEQ ID NO: 231391 - DNA, 389 bp, Homo sapiens
caggtgggaaaggcaaaggcaggaaggctgccaaagagcctggtattcaagggaaatgaatgagcaggcagttgtaatctcagtggcatcccactccacaatctgaagtgcatccccaagggttagggagagcagcttaagaaaccagcagacatttcagaagctgagccctatggacagtgcacatcccatgctcaaggagttccggtggtcctagcccattagccacgtttgttgagactcagcggagcacccccagtaagtggctgccctattcaggagtacttttcagattcaagtctttatcaatattaagggaggaaattcaggggtggaggtgggcgagcaggggcctcctctcttttgggaagcctatttctttggccagc

SEQ ID NO: 231392 - DNA, 156 bp, Homo sapiens
aggcagttttttcaatcttttgggtagtagctcttgagtctgtaaagcctggtaattttctagaggtaattggcattaaccatcaagactctcctcacatgctcccttcccactctggcaccctcctcccacaggccttcctcccgtcctgctgcc

SEQ ID NO: 231393 - DNA, 482 bp, Homo sapiens
ttgtcaacatttttggaagtataaatattattaataacatttgtaatttataaatatttttcatgcctttatttctgtagcactcctacagtcaatattataatcctattttaagaaaataagtatattggactcaaagaatttgagtaatttgattgaattcacatagctaaaggacaagaccaatatttgaattgtctttttctgaaaccatattcttattgtgccctttttagtgatgctaaaaggtgtggtgaacaaaatctctggacccaagattgtgtgtcaaggggacaaatgatactatcagcctgtattagtttgacatcctgtaattaagtagatacagtatttccaaaagtcttttttaaagaatattttgtattgtggtgaaacatatataacacaaaattcatcatcttaaccatttttaagtgtactgttcagtggcattaaatgcattcgcattgttgtgtaagtca

SEQ ID NO: 231394 - DNA, 338 bp, Homo sapiens
tgatgcctgttacgtggcttggaaaactggggcttgggaacgaggaagccctcgcccaaggtaagtagcctggaagtgcccatgtgagtgtccacccagcttgctcaggcccaaagctcctacaataaaataatgcctccatcctagagagcagggctatgtgcaacagagaaaggaaaaggcaggccgggcacggtggctcacgcctataatcccagcagtttgggaggccagactgggaggattgcttgagcccgggaggtcaaggctgcagtgacctatcattgcaccactgcactccagcctgggggacagaagacacgctatctcaaaaaaaa

SEQ ID NO: 231395 - DNA, 391 bp, Homo sapiens
cttgctggccactttgtccccagtacctgcctggagcagtgttgtcacctagtaggggctgactacgtatttgttgcacacgtgaatgagttgaacataacagtcaccacatggaacacgtactgtgccctgcgctgtgtcaggtcctttcccgtgttatctccgtaattatggcagcctcgatggatactgtggttatcctctttttacagaaagggaaacaggctcagaatggtcaagtgacttgttcaagctggtcacttgctcatttgtttattaaagctttactggatgctttgtgactgggaggaagtagactagctactgtgtattaaatatttgtttgtaaggcactgtattaaatgcttgagcagcttcattattcgtaata

SEQ ID NO: 231396 - DNA, 409 bp, Homo sapiens
aaaggtaaaaaaaaaaaaaaaggaatattaatcttactgctttgaatctttagagcaggggtgtccaatcttttggcttccctgggccacattggaagaagaattgtcttgggccacacataaaatgtgctaagactaacaatagctgatgaactaaagaaaaaatagcaaaaaaaaatctcataatgttttttaaaagtttacaaatttgtattgtactgcattcaaagccattctgggccgcatgcggctcatgggctgtgggttggacaagcttgctttagagtctaaaatttacatgacagattcaattcctgtcattgtaatgggctgctaagaatgttacagatggtttatgttgagtgttatcttcacataataaatgaaggttactgctatacctgaaaac

SEQ ID NO: 231397 - DNA, 172 bp, Homo sapiens
attggaaattatccatcaaatttgataatgtaagagagtcaagaatatattatgtcctatttccccctaccttttttccccataatttttatttcaaaataagctctagagattcttagctggttcagcaggtcatggagtaaaattaaaaaataacaatgaaggggcactg

SEQ ID NO: 231398 - DNA, 420 bp, Homo sapiens
tttttgatctgtcagaattcgttttgcaagaatcaagaaagttttggtacaaattcattacctctgtaaacccctgtttataaactctgcattagtacttttgccttctaaggcagtcaaagtttgttttaatttatttataaattgcagtagcaagtgctagtgcccattacattgtggggaaatcaagtttttgacagtattagaatttaatgttttaactgattttattggcagttctaacacaaacagatacatcccttcttaacattaccctttaatgaacaaggatcagacaagttgcataaggaaaggaaaggaaaatgaaaaagaccaagcagaaggatgaaggctacaacagagaaagtaagcctaacatattggtgcactgatgacaaaaggagtaattcagtctgaaaa

SEQ ID NO: 231399 - DNA, 376 bp, Homo sapiens
tgacaggacttttcctctcatccttctgctctctctccttctgtatattgtggtgggcaggtgggaagcctagaataacagaatccatttagttcccatgaaggaagcgaaccgtggcactgtgaagacaaagctgtcaactagaggcaggcagaaccaagagcatcacagagaaagagagcagcggccttgaacaaaacatgaaggaatgcactggtggggtgagacttaagcagttatgtgagctcaaacccccttagcgtgtgggccctttctgtgtaggttgtgttttctattcttttcaacaaaatagttctaaatgatagtttttcagtgctggcttttcaagtacagatgtgctggagaaggagtgagg

SEQ ID NO: 231400 - DNA, 685 bp, Homo sapiens
  misc_feature (42)..(43): n is a, c, g, or t
  misc_feature (448)..(448): n is a, c, g, or t
taaggtcattgttttaaaaaatgtgggccaagctcgtgcgannttcggcacgaggagttgaggggagccagtataattagtttcagctgaggctgacaaggaatgtgtaagccagccttgtccaaccggcagcccaacacaaattggtacactttttaaaacgtgaggttttttttcttttcttttttcttttcaagctcatcagctatcgatagtattagtgtattttatctgtggcccagggaagccaaaagattgaacacccctggtgtaagctaccaaaatgccccttttcaaaactggccttagttctagaacagaaaggacactttctagtttgtagtgttgcagttagttccagcttggaggtcagcagaaatgccaccatgaggttggccagggaccttttgcgggaagccatggcatggtatgttggagcccttgtggnccgtgtgtgtgtgtgtgtgtgtgtgtgtgtgtctgtgtgtgtgtgtgtgtgtatgtgtgaatggatgttttattttgtgtcatctttacccgctgctcctttcccagtgctaccacaatgctggcctccaggccagcgctcacgttttatttgtagactgggcctttgctctctgcagcctgggcttttgtgtggctcagtgggaggctaggcagaggcaggggtggagagatcttt

SEQ ID NO: 231401 - DNA, 397 bp, Homo sapiens
gagaaattgcctagatccaattgccatagacatgcatccattattgtaaatacagctggctctctgtatccactgattccatatccacaggttcaaccaaccacagattgaaaagactgggggaaaaaactcaaaaacaacaaaaaaagaacacaatagtaaaaactaatacaaattttttaaaaaatacagaatacagtgtaacaactatttacatagcatttacattgtcttaggtattataagtaatctctagagatgatttaaagtatacaggaagatgtatataggttatatgcatactatgacatttatagggattcatggattttggtatctgcccagggggccctggatctagttcctttgcagatactgagggacagctctatcatct

SEQ ID NO: 231402 - DNA, 421 bp, Homo sapiens
atcttattaaatgaagctgtgacataaaaacattttctattcctatatttcccaccaattccaattattcttcacctgtttgtttgtccaagttagagaggttttaagatcattctctttcatatgttctttaccattgaaagattacatttgcattgttttgttttaagccaagagtagggccctggatatagctaggctcactgtggttttgcaaactttatattgggatgaatgcaagttttcactgaataaaaagctggtcctcctacttcaacctgtatcacaatatgatgttataaatgtttctttcagtttatcccaagagtatgtgctagtattttcaagtgtatcgacatatagaaaaaatctgaaaccctgatgtcattcattgtttaagtgtaaaataaaaaaaaaacag

SEQ ID NO: 231403 - DNA, 365 bp, Homo sapiens
ctttgttaaatttctgtatgttcttttttgtataaagatggagagaaaggatggagtgatactaaggaccctaataacatctctgttcaaattaattactaagtgatagaagtattcatatgccattaaagatttgccaattctatttgaattttatttgataaacttgaaaatcaaataacctaacagctgtcttttctttctttctaaacccttttaagaatagatttaatatttttctgagttttcattaaagagttatttatgttacggtttgtttttataaaagtagcatcgcaaaataaaaaagtctgcatccttgcaagttattcactgctcatgtgcttgctcttctctggtaaatt

SEQ ID NO: 231404 - DNA, 266 bp, Homo sapiens
atggtgctaagaggaaagttcatagcattaaatgcctacattgaaaagtctaaaagagcacaaacagacaatctaaggtcatacctcatgaaactatagaaacaagaacaatccaaacccagcagaagaaaagaaataacaaatattagagcagaactaaatgaaattgaaacaacaacaacaaaatagaaaagataaatgaaacaaaaagctgcttatttgaaaagagaaataaaattgatagaccattagtgagattaaccaag

SEQ ID NO: 231405 - DNA, 366 bp, Homo sapiens
taaaaaaattttaaatttatttttaaaatttattttaatagcagagatggggtttcaccatattgcccaggttggtctcgaactcctgggctcaagtgatcctcctgccttggcctcccaaagtgctgggattacaggcgtgagtcaccgtgcccggttatgggcctaaattagaatcacttataattagaaaaaaatcaggctggaaagtggaataaaaaaagagattccagggtagaggattatataatacaaataaaagacttgtcatggatgaattattgtggagaagaaatgatgtaaaaatgtactaagagtggccagaggaaaaagtaatatgaagtccaaagccaaaatgtgaatttc

SEQ ID NO: 231406 - DNA, 893 bp, Homo sapiens
ggcattttccggtgcctgcaccaaatcaggaagctcctagtctgtgccccaagatcacgcctcatttggaggtcacacgaggcctggctggtgggtcctgccagggcactggatctggagagtggaggaagcactgggtgccggggtttgggctcggggccatgtacgcctcctcctaccccccacccccgcagctgtcccctagaagccacctttgcccacccccaccccaccccaccccaccccagctcaataatctgcttcttctagaaggaaggaaatcgtctcttccctctgtagcccccactgggagtgcctcagctgctgaggacagtgatctgctgactcagccttggtactcggggaactgtgaccgctatgctgttgagagtgccctgctccacttacaaaaggatggggcctataccgtgcgccccagctcagggcctcatggctcccagcccttcaccctggcagtgcttctccgaggccgggtcttcaacattcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgattga

SEQ ID NO: 231407 - DNA, 315 bp, Homo sapiens
gcaaacaggaaggaagatatctagaaaaatgtcaaaagtccccttgccagagtcccacagttgcctcaggaaattgctcccagcatgaggctcatgggactcacggatgccctgcctccctggccagctcttctcctccgtggcggccatggtccagcacttcatgtggcaccctctgccccttgtggacagacacagcggcagccgggaactcacctgcctgctcttccccaccaagccttgaggccacagcgaagtacacaccgcctttggccccagtttgcttcttgtcccgccccaccttgggctgtcttc

SEQ ID NO: 231408 - DNA, 306 bp, Homo sapiens
gcttattttgatgtctaaagatctgttacctgtatcctgatgttcatcttccaacacatatttattgaatatctactatgtcctgtgttctggacaagtatgcatgagaacaacatacacgaagtttatcattaaatgggaaaagagcagacattttaaaaagcacccaaaccggccgggcacagtggcacatgcctgtaatcccagcacgttgggaggctgaggctgaggatcccttgtgcccaggagtttgagaccagcctgggcaagatagtcagagctcatctctatttaaatagaaaaaac

SEQ ID NO: 231409 - DNA, 1072 bp, Homo sapiens
ggaagggcagataaagctgccgacgctgtgttcttctttaccttcgctttaatggtcttcacagcacgtcgtgtttatgagtcagaggaccctagagcgacacttgttggggacgggcaggacaccacagcacgacaggcagctcctgcaagtggcggcgggaatgcacgccggagtcggcgtgccagcgcggtggaaaccggttctcaggttctggccgagtggacttccccttacatcagcgggccagctcctgtcaggcaggcggccggcgattggccgggaggaggcagtcattcaaactgccttttgtgtttggctaatcagggcagcccaggttcccagcggaggtgcgtctgtggtgtcagacacctgtgtctcagctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgctttaatatactgcctcttttaatgaaataaagtaattgtttccttagctgtgtgctaggaaagccaatacaaagacatataagaaaaaccccacagacctagattcttaaaaccattcatatttgatcccattctcaagatatctcattatatacatgcaaatag

SEQ ID NO: 231410 - DNA, 660 bp, Homo sapiens
aatatgaagtggcttccatagcattatgcagtcaaccatggtgtaaaagtcaataaagataagccctaccacttatctctgtggctcaactagcagcagaaagcagggagttgtctgaaggagcagcttcatttcggctgtttctctctccagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgctttaatatactgcctcttttaatgaaataaagtaattgtttccttagctgtgtgctaggaaagccaatacaaagacatataagaaaaaccccacagacctagattcttaaaaccattcatatttgatcccattctcaagatatctcattatatacatgcaaatag

SEQ ID NO: 231411 - DNA, 499 bp, Homo sapiens
aatatgaagtggcttccatagcattatgcagtcaaccatggtgtaaaagtcaataaagataagccctaccacttatctctgtggctcaactagcagcagaaagcagggagttgtctgaaggagcagcttcatttcggctgtttctctctccagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgcttta

SEQ ID NO: 231412 - DNA, 877 bp, Homo sapiens
ggaagggcagataaagctgccgacgctgtgttcttctttaccttcgctttaatggtcttcacagcacgtcgtgtttatgagtcagaggaccctagagcgacacttgttggggacgggcaggacaccacagcacgacaggcagctcctgcaagtggcggcgggaatgcacgccggagtcggcgtgccagcgcggtggaaaccggttctcaggttctggccgagtggacttccccttacatcagcgggccagctcctgtcaggcaggcggccggcgattggccgggaggaggcagtcattcaaactgccttttgtgtttggctaatcagggcagcccaggttcccagcggaggtgcgtctgtggtgtcagacacctgtgtctcagctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaaggtttgttcgacatgggtgaatcaatgaattgcacttcaacagcaaaattggattgtattgattggttggctcactcttctcatcctttatgtttcagagaaggtcggattataaatgcaagcacctacatttaagcaacagttgagatgcttaagaacgtgcttctgtgtgattctgattaatccttaactatgctctgatttcattttacttgtaaatcaattgacacatacttcagggaccatcctgtcttttctctggggttgctgtcaccgtatttgtaacttgaggatttaataattgaagattgat

SEQ ID NO: 231413 - DNA, 911 bp, Homo sapiens
ggaagggcagataaagctgccgacgctgtgttcttctttaccttcgctttaatggtcttcacagcacgtcgtgtttatgagtcagaggaccctagagcgacacttgttggggacgggcaggacaccacagcacgacaggcagctcctgcaagtggcggcgggaatgcacgccggagtcggcgtgccagcgcggtggaaaccggttctcaggttctggccgagtggacttccccttacatcagcgggccagctcctgtcaggcaggcggccggcgattggccgggaggaggcagtcattcaaactgccttttgtgtttggctaatcagggcagcccaggttcccagcggaggtgcgtctgtggtgtcagacacctgtgtctcagctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgcttta

SEQ ID NO: 231414 - DNA, 200 bp, Homo sapiens
gaagaccatttatcattttagttcatgtagaacacattgttcataacaaactatagaaaataaagtttaaggctgggcgtggtggctcatgcctgtaatcccagcactttgggaggctaaggtgggcggatcacctgaggtcaggagttcgagaccagcctggccaacatggtgaaacctcctctctactaaaaatacaa

SEQ ID NO: 231415 - DNA, 556 bp, Homo sapiens
cacacccgctcaatttcaaactcattttttcacaattccttttaatttgatctttatttttttattaatgtgatttttctcctagtacatattactttcaacatccaatatagtttatgcatttataatggttattgtgaactgtatgaccattttattagattataagccataagaagtcagggattctttcacattttgtttggtaatgtatctggagtacaaaaagcaaaatatggacttaaatatttgtagaatgaatgaatcatgctgtcataaaacttgtggcaaataaatgctagggaaaaaatttggaattaagctcatcctgtagaggtaacctatattaaaaatttgaaaattctaacacatagcaacagttatcacgaatgttattggtggagggatagaaaaatagatcaatgaaacagaataaagaaaccaaaaatagatttttgcttaaccgatttttgaaaacaggtgcaaaggtaatgaaatggtagcagcatagcctattcaaaaaatggtgctagaagaaatgtacatctagaggcaa

SEQ ID NO: 231416 - DNA, 912 bp, Homo sapiens
gagtggccccgaagcttctttgctattttttgtgccctgagctgggaagtgggcttggcccccacaggcacgaggggcaccagcctggtgacgaggccggtggaggtgggagcagttatgactgcagccaagggtggaacctctgttctcaagttggacaaaggcagccatcagacccactggcatattccagagagtcccagtgttggggctgtgtgccctgggcacaatatttaacctctctgaaccttaatttcttcagggattttgtttaatacatctgactgacagtagttacaactgtggggatgtgtttctctcttccatgaggaaggcagttcaagccagactctatgaccttcaacaggcagatgaaaggcaagaagttactactgagtgcctactgtgtaccaagcactctgttacgtttcaatattttatgttgttaattccactaacctgagaaaggatacatatttttaaaaaattttaacagctttattgaaatatagttcacccatttaaagtatacagtttgatagcgttttgtattcctatatttgtaaattgtggcaaaatatacgtcaagtacaacttggcattttagaaattaagtgtacaattcagtgacatcaaacacattcacaatattatgcaatcaccggccatgtactgtggctcatgcctgtaatcccagtatttcgggaggctgaagagggtggattgcttaagctcaggagtttgagactagcctggccaacatggtgaaaccctatctctacaaaatatacaaaaattagccaggtgtggtggcatgtacccataatcccggctattcaggaggccgaggcaggaggatcacttgagtccaggatcgtgccactgcactctagcctgggtgacaaactgcga

SEQ ID NO: 231417 - DNA, 691 bp, Homo sapiens
atttttttcagaaatgtattttggtttctcttatggctgcttcaccatacatgctgttgcatttatttcccgtgttttattttgctaatctgcctattggcattttctaattgtaattattttttttaaattagttaatttattttaattgacaaaaattgtatgtgtttattatgcacaacatgatgtatacatgaagtgtgtatacattctggaatggctaaattgagctgattaacatatgcaatacctcacatatttaccatttttttgtggtgagaaaacttaaaattttgaaatataaaaccttatatttcaagaatataatacattgttcctaactatagtcaccctgttgtacaagagatctcttctaattgtaattcttatcaataaatcatcatcatgattaggtctggcatggtgcctcatgcctgtaatcttaacactttgggaagcccaggcagggggattgcttgagtcgaggagttctgtatgagaccagcctgagcaacataatgagacccagtctctaccaaaaacttaaaaaaattagccaggcattgtagcgtgtgcctgtggtcccatgtactcagaggctaaggtggtaggattgtttgagcccaggaggtccaggctgcttgagctgtgatcatgatactacattccagtctaagtgacagagtgagac

SEQ ID NO: 231418 - DNA, 172 bp, Homo sapiens
ttgttacaaaattggtttttatatattaacattgtatcctgagatcttattaaattcaaacctcagtattagtagtttatgtattttttttggatgatctctttatacagctatgcattttagaataaagaacattttgttttttcttttcccatctgtttatgttttttaa

SEQ ID NO: 231419 - DNA, 143 bp, Homo sapiens
ggaacagaaaatggaaagccttgttttgttgttgtagttgtttttagaaaatgcagttagccacattttaacagtttttaaaaatgaatcctcaacttattgtaacagcaataaataacactaaaaactgtatttcaatctcg

SEQ ID NO: 231420 - DNA, 456 bp, Homo sapiens
agaagactaataagagtaattaaaactaattaagactgtgtgctccagcaattctacttgcatgagttaccaaaagcaaatttataaggattgttgatgttgccttgtttgttgttgcaaaatttttcagaaacaaaagggaagtggtttataaattgccatatatccatatatatgtagctgcaggggtgaagcagtcctccacttgacatggaatgatctccaagatccattggagtgagctacaggacattagcattacagaaagagggatgatatacacatccgttggtgtgaacacaggatggctctggaaggttatggagaccctgggtgcttcaggagggggacagaggaattcagtgccacacagggagatttatcgttcaccaaataccctcctgtactgcatgaacctttttttttcttgccatgtacatatatgacctattttta

SEQ ID NO: 231421 - DNA, 459 bp, Homo sapiens
cacgcctgtagtcctggctacttgggaggctgatgcgggaggatcgctcccagtccaggaggttgaggctaccttgagctatgcttgcaccactatactctagcctgggccacagagtgagacttggtctctaaaaaaacaaaaattaattaattaaaaataaaataagataaaaaattaaaaacaaagaccataaatgccatgagttatgtttgttttttctaaaattttattcccagcatagggaataaatgcagaagaggtgcttcataaatatgtactgaattaacagataaaacgagggttcataataagaacctagactccttggagggtccatgagaaggtttttctttgtgtctgcgtgacaaattgtcagtcccaggatggtgccagaagtaaagttgggtcattggagggtgactttgacaacgtctgacatctgcagagaagaggcag

SEQ ID NO: 231422 - DNA, 587 bp, Homo sapiens
agcaagcctccgtctcaaaaaaacagaacaaaacaaacccaaaaaatcacaataagataccacctcacattcactaggacagctgtaaccaaaatgacagacatatgttagtgaggatgtggagaaattagaaccctcatacactgctgatgggaatgtaaaagggtacagttactttgcaaaacagtttagcaattcctcaaaaagttaaacacagaattaccatatgactcagcaatttcacacctaggtatagacccaagagaattaaaaacatatgttcatgcaaaaacttatctgcaaatgttcatagcagcattattcataaggccgagaacatccatcatctgatgaatggataaacaaaatgtctatattcacaatggagtattatccagccataaaaaggaatggagtgctgatacacgctatgatatggatgaaacttgaactcattatagtaagtaggagaagccagtcacaaaagaccacagattgtctcattctatgtacaactgatcctcaatttcatttcattataatgctgacaagattaaaaaaaaaaaacaactcccagcgggggcccc

SEQ ID NO: 231423 - DNA, 449 bp, Homo sapiens
tgggattacggtcatggatgtgattaccaccacacccggcctgaacacactgtttaatctctgtgaatgctcttttcctcctaggtaaaatagcataataagagttcctgactcataggttgcaacaaaaactgaagaaaatgctaaaaagcacacagcatggctgggcgcagtggctcagacctgtaatctcagcactttgggagggtgaggtgggtggatcacgaggtcaagagattgagaccatcctggccaacatggtgaaaccccgtctctactaaaaatacaaaaattagctgggcgtggtggtgcgcgcctgtaatcccagctactcgggaggctgaggcaggagaatcgcttgaacctgggaggcggaggttgcagtgagctgagattgcaccactgcactccatccagcctggtgacttgagtgagactctgtctcaaaa

SEQ ID NO: 231424 - DNA, 441 bp, Homo sapiens
gtgtgtgtttgtgtgtgtgtgtgtgtgtgtgtgtgtatctatttaaaaggcctttataatttttataattttatgtttaattggcaattaaatccattttgacttccctctagcaccaccagactttttctctctgtaccttatgatataattttgctatttgatttttgcctgagttgtttcctttaacatgcaaacttaaggctatttagctgacaactccctaggggagtaaaacaggttattaagaatttgaaagcctaagataggggaaaaaagctccttaagtatctatacgatgtacttctatcagcatgcctactatgtctatatatttatgtgatgtgtacacaatttctcgctactgaaaatatataaaagagttctaattaattggcttaagataaaaagcacttgaatctaatactttatcaggaaaaa

SEQ ID NO: 231425 - DNA, 741 bp, Homo sapiens
ccatcatcaaaaccatcaagtttaagaataagcagaaacactaacaatatattaaatggagggctacgcatttgtatttctgacttttcagtatataaactgcacacatgaagactatctcaggtcatctgatcagaaaccagtataaagcactaagccttccattagagacccatactgataaaatattccatttacagtacaaactcaagcaaacctaagatccttaaattgtggatatatttcatggtaataacagaagatctaacaaatgaaaactttttgctaatttccacttagcatcaagatagcaaatcagcccacgaatgaagcacacagtatatcttgatatccttcagcaacgaaattggaataatattaagttgtccatgaactaaatggatatataaaatgccaagaggtccagctgaaacagagacctcttttttccctaaaaaagaagaatctcacttcctgggtaaagaacaggctggtctaccctgccaggaccagtcttctcagagtcttctacagacaagatttacctgataagtctgcactggggagaaaaatgcacatcacaggctctatcattctgtttcttaaccacttacaaataagattcctttactactaccaatgttctttacaatataattactcaaggttcatatggattttggggttttttggctaattcatcaagccttatcatgaatttaaaacaaaccattgacttct

SEQ ID NO: 231426 - DNA, 306 bp, Homo sapiens
tcttcaggtgccgtggggctgaccagtgcccaccaactgtccacgcagatgggcgaagaggaaatggccctgcagagaccttcagagctccccccggcagcccactcccgggcatcagtcatgaaaattcaccagctttccccacaactaggggcctgggagctgagagcaggaccggacaatctggccccagcgccaagggcaggaacttttcccagcttctcttcagagctgcatcaaagaaagcagcgcccagtgacaccgctcctcttccttccacgcctcaggcctccacccctcaccctt

SEQ ID NO: 231427 - DNA, 536 bp, Homo sapiens
aagaaatgaacatatatggtctttgctttcttgaagcctaaattcttttgttcctggtaacatttttagttcctgtttggccatcacaacagtcttactcattggttcctcattgttaaactcttaagtttcctgtggtcaactgtgagatgaaaaaaattaaggacaaaatggggagttttaaatatagctaattttgtgtttatttattgcaagattatggccttactggcattttttgatgtgaaaatgtagtgatttttttttctgtgtgtgttgtcaaaataattatattacatctctcattttcctaccttcaccatgaaatcccaaagttggagtaccgaagatcagggttaaattcagatacaagcattaaaaaatggatttttaaaaatgtgtctgaaaattgagtgtctaattcaactttcaggcatataatgagcaagtttttcatacacagatgaagagactcatttctaacgggttggtgcttcttgcttgggctgaggcaaacagaaggctggtgtgactct

SEQ ID NO: 231428 - DNA, 1251 bp, Homo sapiens
gctgctttttcccttgttttttttttcttccttttaaaacaaagcagcgattcattccctctcccccagcagcgcggtcgggtgggatgggcaggcgagaaggccgttttcctagcactgacctacgggtccctccctgaaacgcggtgtcagatggttactgattaatattttggagaggccgcggcggcaggcagcgggtgagtctctaatcttctaaaaggggttcctatagaaacgcggagcggggcgcgccccccgctcggcccaggcccgggctgcggcgcttcgcacagcgcgcccctccccaaagcccctctttgcgtgggcgctcccctctccttccccccccgccaacaaaaaatcagagcagaaaaaaggattagatcggctgagcgcgaactgaatccctctcgattctgacatttcagcctattagcatttctccacggagccttctgaaacctattaaagtgtaatattaaaaacctcttggctgggggcctctctcgccttccatccgccgcgccccctccagggagggcgagaccgggaaaaaaataaaatctgttgagctcagaggaagtagccgccaagcccaaaaagtgcttggctggccacggcggccgtagggggaagggagccccaatcccccagactttgtacttttattttgcgctttcagcaaaatcctttctgggttgagtagccgtgagctgcccgcggccgacctacctgaccgggggcgcagggagtgcggaccacgccagcaggactgtcctgggggcccccgcaccctctctctgcagccccccgagcccggctaggcattacgtaccctggaaaggaagcttggaggggcagaaatccttccaatgctgcctcgaagagcaactgcagtgataagattttaattaaaacaagagaagcccgctctttcgccccgcgctgcggactcagcgttttcgcattgcccgttctgttttttttaaatcaatttttaaggcaactttttgggaggggggaaaaatgagcgagttagtgcccattcgttctattttcttttctccacttttagaaaaaagtggggggaggcttcgagaacgaacgggggggtgtctaatttaattccaggataaatttgaggaaaaaagttcagcctcttgagggcagtttcaagttgcccttcctggagcttcctgcgttagtttctaggctgccctcttttggaagctgtagctccgctgggga

SEQ ID NO: 231429 - DNA, 1152 bp, Homo sapiens
ggttttaggattcagtttccaaagctgttttgccacattggtctaacttggtattccccaattttggaaaccagtgtatgaggttttttttggccacggagtttgaaacactctctgggcactcatgctatgtgctgtcacctttttcagagatagttttaaagtcacttggctttgtttgggatgtttgcagttcccagttacttttggtggcttattcaggggcatccaattgggaattttgaggctgccagtgacccctgtttgccacccctgcaattcaacctgggcaaaataggggggccccttttcccaaaaaaataataaaaaaaaaagccagcatcctggacagagctgggggctacctggatgctgccaaaggccccagaagcctctcagaaggcccctgtgccacccccaaccccgcactccagtcttacctcctcctggcccctgacctttctgggtatcgaaaatgctgggctgacccagctggctgaggagggggctcccactgctggggggctccaggtggttcaggtggaggtaggatgggtacagcccactgggcaggtgggagaagccttcatgggcgtggcggcccacagctgcaccatgggcaggttgctaggggttggggagcggaaggacaggtcagagggcagtggcactgggctcccatgggacgaggccgagggccccatcccgctggccacaaagctgcccaagaaggcctcgccctggaaaggaagcttggaggggcagaaatccttccaatgctgcctcgaagagcaactgcagtgataagattttaattaaaacaagagaagcccgctctttcgccccgcgctgcggactcagcgttttcgcattgcccgttctgttttttttaaatcaatttttaaggcaactttttgggaggggggaaaaatgagcgagttagtgcccattcgttctattttcttttctccacttttagaaaaaagtggggggaggcttcgagaacgaacgggggggtgtctaatttaattccaggataaatttgaggaaaaaagttcagcctcttgagggcagtttcaagttgcccttcctggagcttcctgcgttagtttctaggctgccctcttttggaagctgtagctccgctgggga

SEQ ID NO: 231430 - DNA, 569 bp, Homo sapiens
cccctcccccaggcctccttcctccaccttccccgagtccgtcaacacaccgcacagcctgcatcactggccttagccacgtggaggcaaatattggtccccggagagggcctccctccctccctcagatcctcagagttggaggtgaactcccatggctgagctgcagggtgccttggatttccatgagtccaaaccctgagcaattctgaggccggccagtcccgcgacgttatcctctgttttataaaactgccggcactggtgctaagtgatgtccaccaggaacaagaggtgaccactgactggatgtcgccacagttcctgagaacagtttattcgtctactaagtattagaatatctattacattaattttaaaaaatgaaagctcctgcctcgtgagatttttacatcaaccatgagattctttgaaagccttcgagttcatgggccagcacttctgtgacggcgtttacttagacaaacattcccaccaagtacaatttcaaaagctgaattttaaaaaatctgttgtggtgcttgagggcttctgcagcagcctcagga

SEQ ID NO: 231431 - DNA, 476 bp, Homo sapiens
catttctttgttaatgaacttttcatgcactttttttacttatctagtagtctgcttattgagtagtttgccttttcatcatgtgtctgtgacacagagcaagtatcttttctatgccttggcaaattgtcatattgctttctaattttctttctaatcatgatcatgatgtgcatctgttatttacgtagtaatttgtgaactgaaaggctaccaataaagtttatactttatgcaatttcaattaatatacagtggtaactgttatttgaaccatgatgtagggaactagtgttatttaactaaattatggtaactgaaattggtgcataacaaagctgtaaaacaaggactgcctatatccttttcagtgcactaaatgctacatgattgtttcttacctcaccctatgtacttgtcatgtctttttaaaaatgtactcaaagaacagaaataataaaccaaatagagaagca

SEQ ID NO: 231432 - DNA, 386 bp, Homo sapiens
ggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcac

SEQ ID NO: 231433 - DNA, 437 bp, Homo sapiens
ttttctagtcaacaatacgcttattacataaaatatccatgaaaatgggacctgggcattatctctcaagtttggtttccttattattgtttaatgttaattttcttttccagaaggctcatctgaatatatttttaatattagcgggtttttagaaaaaaatacgtccttgactccaacttgccagttacacatctcatctggaccagagtcggtagttggagtacattggtgaatagtcaccactctctgcccttgtgaagcttgtattctatacaggtaactacacggcagaaaacttgtaagaatttagtcatgatcaggaagattttcagcttattgatgtttcctcacagttcttgtccaaaaatgcgggtttccactgtattgaatcacttcttaaataaatattgattatgtgaaatagtaccaagaaa

SEQ ID NO: 231434 - DNA, 322 bp, Homo sapiens
tttttttttttgtatgttagtagagatggggttttaccatgttggccaggtctcgaactcctgacctcaagcaatccactgcattggcctcccaaagtgctggcattacaggtatgagccaccgtgcctggctgccaaaagttaccttcttaacacttgaatttctggtctcctcagcttccctatccatataggcacagagaggcagcatttgttttccagttaaaactctacctcattgtgattattatccaatacaattgttacaaaataagtaaaacttttatgaaacaatacaacataactgattttactctttaat

SEQ ID NO: 231435 - DNA, 896 bp, Homo sapiens
tcaatgagaggctctagttttggggaagagggaaacacctaaccttgacagaatcatcaccagagacacctgccggctgacaaggacagctttcttggagccaacagatgatgcaaggaaataagaagtgcacagacgcgttcagcgactcctccagcatcggcagcgtgttggatgatgcagacagggaggaccgagagccaacgttgtgagagcaggcccactgccagcaagcctccggctctgaaaaatcctcccaaattcgctcctcttccagaaaacagtgtcaacttctgcttcgattctgcctttctgacagtcaggagggtgcccgctgaagtttccaacacccatcagaacagctaccagccaggcaggaagcacggagaacaggagtcctccaagaatccagaaatggcctgtcacggctccagcagcttcctcccagcagccaatgacacggccaccttatgtgagtcaaagttcccctctccacaccacaagccagtcacgggtgagcctgggagaggcaaaggtacctttctgcacagtgaaaatagtgcttttgagtcatggaatgcccaccaaccaaagctgctggagagaaaggacacagctggaaccgtcccagaaagcaaagctcccaagcactatggggacacgaccttgctaagagaaccctgtcctcctgagcgcacagtctctccctgccaggtccaggccagctgcagtcaggaagagaacagacttgcagcaggggctctgtccacatctataccctgggggtgcagggatccaggagcccaggtatttgctgtggaaggaaaagctcccagctcacaacctgattctcaagagaagccagcccagcccccatggaggaagccaaagactgg

SEQ ID NO: 231436 - DNA, 431 bp, Homo sapiens
gatggagttttactttgtcgcccaggctggagtgcagtggcatgatctcggctcactgcaacctgtgcctcccgggttcaagtgattctcatgcctcagcctcctgagtatctgggactacaggcactcgccaccatgcctggctacttttttgtatttttagtagagacgaggtttcaccccattggactggctggtcccaaactcctgacctcaggtgatccacctgcctcagccacccaaagtgctgggattataggcatgagccaccacgcccggtctctaatagtatatttttaaaaactcattgagttctctgttttcatgacctctcaacttggagtactggttaagataataaatttatagccaagtgtgtatttactatacacatttatagtcaaataaaatgcacatattttcatcatatt

SEQ ID NO: 231437 - DNA, 432 bp, Homo sapiens
caacatagtgagacccccatttctacaaaaaataaaaataaaaaatgagccgggtatggtggtgtgcacctgtagtcctggctacttgggaggctgaggtgggaggattgcttcagccagggaggtggaggctgcagtgagcctaggcaacagagagaggcttcatgtcaaaaaaaaaaaaaaaaagatttgagtttcttctcctttgttgggttgcaaaaggaacacttcgaatgtggtttcagtgcacttaaaaatagcgagttcagctgggcgtggtggctcacacctgtaatcccagcactttgggaggctgagacacggggagaaacccatcgaccttgtggggctggaccctacaaggtgggtaggtcacctgaggtcaagagttgaagagcagcttggccaacatggcgaaaccccgtctctact

SEQ ID NO: 231438 - DNA, 456 bp, Homo sapiens
ttaggagtatcctgacaacccgatggaaagtggcctgggtgtcaaggaaaaagcaacgtggaaacaattcaggtttcttccatataagagagacaatcttttcccaggtgtgggtcctccctcttggcagtagcggagaagtttttgaaagataaatgatgcttttattgtgtcatttggcctttgtttggcgcttgatacagcccagggtttgctattctaaaatctgtcactagacagatgtgtgctgcagccagtgtggagaacatggggcaggagagaggaagaaccaggtgtccccgttccccagaccagtgctgatgtgctaccagaaatgggtttgcaagattaatcaccttcctcctgcttcccttgaattctaattattgttgtcaggatctgttgaagtagtaaaagctgctggcaaccaagacacataaaagctaagctccagtt

SEQ ID NO: 231439 - DNA, 2675 bp, Homo sapiens
  misc_feature (806)..(806): n is a, c, g, or t
  misc_feature (1268)..(1268): n is a, c, g, or t
  misc_feature (1497)..(1497): n is a, c, g, or t
  misc_feature (1965)..(1965): n is a, c, g, or t
  misc_feature (1970)..(1970): n is a, c, g, or t
gaagggagacagggaagtgctgggaggagaagggtgggtccctggcgagggctccacccccgggcctgtgcccacagacctaggtgaagacaggcactccagccttcacgtccaaatgttgcatttcccaagaccactttgacccgccacgcccccattctgtgcctataaaaaccccaagaccctagcaggaagacacacaagctggatgccgagagaaacacattggcgaaggaatacacaggtggatggacgtcgagaggaatgcactggtgtaggagcacactgggatgccagcaggccatcgactggtggaatgacacaaagtttggctggggcagttggagaagagttgggccaccaagcggccagactccaggggaaaaccatttcccttctggctgccccatctgctgagagctgcttccactcaataaaacctcgcactcattctccaagcccacatgtgatcctattcttctggtatgccaaagccaggatacagaaagccctctgtccttgccataaggcaggggtctaattgagctggttaacagaagccgcctatggacggctaaactaaaagagcatcctgtaacatatgcccactggggcttcagctgtaaacatttacccctagacactgccgtggggtcggcgcctcacagcccgcctgtctgtatgctcccctagaggtttgagcagcgggacactgaagaattgagccacacccccatcacacacccgcaagtgggacaagggaacctttcccatttcactgctgtgacagtgcaaagctattaaantgaagttgaggtagcaaggaataccaagacaactgagaagtccttataaagaacacattcagtacttttaagatgttattttccaaaacatacacttttgggttgcctgtcagactggagatgtatgcctgtcgagtcacgttacactgaatttatttaggaaatagtctgacatacagaagtttcacttctcctgccacttgtgaaggatttgtctcattggtgtggtgtcagcctggtgagataggacttgcttgtggtttggaagctgtctgtgggcaactccaagagctgttgtgctctgcctctttatgaaccttctgtgcttatggaaatggttcccagcgtgtgctcctcaggaatgagtctgagtgacagaggtgccagtaggctatgagatggtagcaatgaccttagctagtcttttttgtttgttttgttttgagacagagtctcgctccnttgcccaggctggagtgcagtggtgcgatctcggctcactgcaacctctgtcacccaggttcaacctctgtcacccaggttcatgccaccgtgcctggctaatttttgtatttttattggagatggggtttcaccatattggcctggctgaccttagctagtctttcttaagaggctgggagcctgaggacagttgagaggtactgagctagttaaacctcaggcgctntccctgcgaaggctctatggcagataccacttggggctatagaagctgttacctacagtgtaaattctggatttcaatgcagagggcagacatagggctactaattttattttgttttgcaaggacattgaaaaaaagtcattgtttactgtcgtcagcattttataaaagggaggatactttttaatcacaaaatatgaagaagtttattatttgttttttgagatggagtctcgctctgtcatccaggctggagtgcaatggcatgatctcggctcactgcaacctctgcctcctgggttcaagcaattctcctgcctcagcctcccgagtagctgggattacaggcatgcaccaccacgcccagctgatttttgtattttttgtagagacaggatttcgccatgttggtcaggctggtcttgaactcctgacctcagatgatccacccaccttggcctcccaaantgctnggattacaggcatgagcccagctgtggtttcttatatcatactgttaagtgtacttttaaagctttaaaaagcagtgttaaccctttcttaaaacagatttcagggaagacagacgtttaaaacattagccttctctccccatctggagtatggtttggaagtcattgctttgtagtaaggcattattttcctggtacattgccaaggaccaacaactgttaaatcaacaaactaagattttcttctagatttgtatcggattgtgactttgctttctccctttcaccacccattaatgcttagtaaagccactatggacctcacgtatctaaacccttccctgaaatgcatctctcttttcataccactccaatgggaactcctgttgatttgtttctgggccctgacagattagcaggaaaagaaagcgctttagaaaagtgagaggggagttcagaggttagaggggaatcagaaaattaatgtcatgattatcaagaatgtttccagaaggcagggctcatcagtccttgacaaaaaggctgatgaaaaaaatggagttgagtgcagccgatcacctcaataatcctagcagtttggcaagctgaggcaggaggatcacttaagtcccggattttgaggttgtagtgcgctgtgatcacaacactgcactcggcctgggtgacagagctaggctgtctctt

SEQ ID NO: 231440 - DNA, 493 bp, Homo sapiens
cccctgtcctgcaagaggatttggagtttcttctcgggaaggtggacaataccctgtctgtcattccaaggccagaagtgactgggtaggcaagacatccctggggtgagaggaaccttcctttctatggccctcctggtggggaggcctggcctcaagtcaaggagatgcggaaagcagtcccagagggatgggggaggcagaccaggcactagattcacaagacgccactgagagcagcctgcactttacacctggactccacaagacaccactgagagcagcctacactctacacttggacttcacgagacgccactgagagcagcttacacttggacttcacaagacgccgcttctgtgcgcttttcctttgctcctcaccctttcatacagactgccactcacccttgaagacttggctcaaatgctatctcctctatgaagtcctccctgaccaccgccctccagtaagactccatctactgcgccc

SEQ ID NO: 231441 - DNA, 429 bp, Homo sapiens
gaggcatgggtatgatttctctactccccagaggaagcagctctttgagacaagggtaagattcagccacggtgtgttgctgttgtagaagctttaaccacctcagcttacagcagaggtttcagcaaaataagcttctctttctataaatggcttcttctcatcgcatctctgtggacagtgtctaatggtgggattggctcattttctggaaccaaataaacatttgttcccactagccccatagtgctagcaccactattaatgagcggcaatgttgtccattgctgcaggagtcattagggaagccctggtagagctctgtttattaccacgggaggtgtcagaggcagagaaagcacagctggggcttccaggctccagcagatcacgcagcgcaggcagccagagccatcattcttagacttg

SEQ ID NO: 231442 - DNA, 139 bp, Homo sapiens
tacagaagagacaggaaaaatattcctctccccatttgtcaccagatggaagggaaaaaagtctgtcctgagaatttgtaaccacaaggaatccctcatatctataccagtttgagatctaaatttatccgtgtagtct

SEQ ID NO: 231443 - DNA, 375 bp, Homo sapiens
ggaggtcgcagctgactaggtgagggcgggagactgcctgctcgtctcctcctggccccggctatccagggcgtcgaggtgaggtccgcagccactcgggcggtgcacaacatgttccaggagtcccgcggccgagcggcgcacagaggagcaaggagaggaccggaagaaccgtgctcttggctgcaatttgtttccaagagtgccaagacatgcccgagactctcagcgcgctctcagagcatcaactcaagcaccgaaaaaatctacctttgccttcccggggattcattctggggtatgcctgtgttgtttctttttaagaccactatagtgggaacaaaccaggaggtgccgagttgcaaaaaaaaaaaa

SEQ ID NO: 231444 - DNA, 415 bp, Homo sapiens
cctcttctcttccagggaagacttggttgcttagacacctctcctttatttcttttctgttttaattcttgcctagttggaaacttgattgaaagctatgctgaaaactagaagaaaaactgcagtgttccacatccatgacaatggtcattgtcacttttaggtattgggacaaaggtcacatctggacaacaaaatgcagggtaggaggaggtatttatttgttctccttaacaggtttaaagggacttaagatagcgagactctggaactgataattttattagttggaacagagggaacaatgcagtgaagtgacattacaaacagctcccaaagaaatattttctgatgtttccaaataccaaattgcatttcctgccttgctccaggcatgcactgcaaacttttttct

SEQ ID NO: 231445 - DNA, 412 bp, Homo sapiens
ctcatttaattctcacaaccaccctacaaattaagtgctcttatcttcactttacagattaggaactgagacacagaaaacttaagtaactcacccaggatcacacagtgacatggccagggttcaaatgcaggcagtccagataaggcagtgctataccaccttaccatggtaagtcaaacccttagaacaaaattagggagcataatttttggaaagttataactatttatctttctccttcgttttcttgtcatcccttttgtttgtttttttagtaatagccagtattttttatttccactttcccatgagtctattatagctaacttgtaatactgtaactagaaaggaaaatgttttcctctcctgcctcaactcctaaaataaagcacttaatcattaggacttc

SEQ ID NO: 231446 - DNA, 584 bp, Homo sapiens
gcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaacta

SEQ ID NO: 231447 - DNA, 545 bp, Homo sapiens
gagctgcttattgctgtcagcatcaacttcacagaataagtgtaggctcacttgcctaggtaaagcatatagattggctctaagtgagtatcgctccctgtgaataattgagatttgattatccttttcccaaattttaattaggatacttatgtaatgtattttattttaatgcagaggtatttatagagtccataaggagttatatcggttcaaacatttctcctaaaaagaacaaaggttttatttgctagctgagagttcaagatatccttttggagatgaacagtattgctcacttataagaagcagacagtcagaatacaatgggatggaattagaagacctgtctctttcagcaagttaagactttaatatggtacccctgtataaatgtaagaaagttaactcattatttgatcatgtatgctgcagtgctttacaaatactaaaatccttaagcaatacaagacataacatattctgtccttttaaattactgaaagacgaagactctcggtttcttccaaatgtttccctgaaac

SEQ ID NO: 231448 - DNA, 271 bp, Homo sapiens
acaaattctctgtttttgtttttctgagacatcttaatcttttgttcttttttgaataatagttttgctggatatagaattcttgattgacagtttttttgtctttcagcattttcaatacatcattccactatcttctagcctccagtttctgatgagaagtcagctgttaatcttattgaagatcctctgtacatgattactcacttctctcttgctgcttgagtttttgtccattatttcctcaagtaatctttctgtccccttactc

SEQ ID NO: 231449 - DNA, 446 bp, Homo sapiens
ggcactctggaccacgctgagggcgggccggcttccctgcgcctgcgctgacattttgcagtttgggaaatggcggtgctcggggacgtcgatactgacccagggcgggaggcagctgcgagtggattgtcgggccttttcagaccggggtctgaacctctgggccggggcggggctcgggtgctgcctggctctgccaacgttctgggccctcgagtgtgaatgagctccgcccgccatccgccttgtagtcctcgcgtccggccaccggcgcggggctcccacccatccccaccccaccccaccccaccccaccccgtctgtttcctttctggtccagtggggacagccctgagtgagcagcgtcgtaggagtaagatacctgggcccccggcctctccttcttgccctgcccccgcaccccctcccgcacggggacccggata

SEQ ID NO: 231450 - DNA, 463 bp, Homo sapiens
cacagtaatctcctgccctacctttccctgattcctgctccctcagaggcaatcactttcaacactttgggctgtttcttcaatgtggaggtatttacctttatatttcataaataaaccaactgctatttcttgacatcatttgacttcatgttgttatacatacatgtttcctttccccatttttcagtacagttatatgatcctttttgaataacttagtattccatttttacgttattatgactgtgtaaatagtattcccagtgaagccccccacccaggtcactttgatgatgtttcctttttaaatgttgtgctttgtttttttctccttggagttagtaactgctctttcagtattgtctgctttgttttctatatgcacattcgtaatttattctcaaatgcttatttagtttccacatttttttaaccctgggcctagtaactcgtttttctt

SEQ ID NO: 231451 - DNA, 263 bp, Homo sapiens
agacaatgtgcagtagagcctctctagtatttccaaagagatgtccccaatatctcaagctcatggtttttgcaacttccatcaacccatcctcaaaattagctctttaaatcttacacctaccatagcctctcatctctgtcccctctttttcattcccagtcctattttagttgaggcgtttattgtaacagtaacctcccacagtgtactgaatgcagccttcatattgctaccagattaatcttccaaaaccactgtgc

SEQ ID NO: 231452 - DNA, 845 bp, Homo sapiens
gcagctttgctgccagagggggctgacttgatagggagcagagcgtggaaaaacctcatgtccagtagcattgtcagtaacagtagtcatcttggtggcaaacaaacagagaccagtggctcagcaggtcttagatcttgatcccagttagggcaagcagtggcccagctgactagctagaagtttactagtgagatctggatagtgagaaagctgtgggggaccacacatctacacagaagaggcctaagacagcctaagctactcacacaattctggctaaacatgagtctgcatacacatgcaaagatgtgagagggcccaacagaaagtaaaaaccagagcagagtttaaaaccgcgtgaactttgctgcacttctcccgaaatacacagatccatccagggtgaaagtattactggctcaaggtgtttgaccacaatcattggttgacaaccactaaggaatacagataggggtgaaccctaggaagccaggctgaaaaagaaaaacaagaataattaaaaataaatgaggctaggcgctgtggcccacacctgtaatcccagcactttgggaggctgaggcaggcagatcacctgaggtcaggagttcgagaccagcctggccaacacggggaaaccccatctctactaaaaatacaaaaaagttagctgggtgtggtggcaggcgcctgtagtctcagctacttgggaggctagggcaggagaatcacttgaactgggaggctgaggttgcagtgagctgagatcatgccattgcaccccagcctgggcaacaacttaacttttttgaaactctgtctcaaaaaaataaaataagata

SEQ ID NO: 231453 - DNA, 312 bp, Homo sapiens
tagaagaatcgaggctctgggggagggtggctgagaaacaggtccaaggtcacatagccagtcagaggcatttgtactgtaactcgggtctctgtttcgcttattgtagtaatttcccctttgcacagatgaagacatttagacatggaggacagttttttcgtaagattcttctgcttggcaaggacaaaacagaaccagctccagactctggaacttcctgccatgatcactttctaaaaatccaaacttatttcctccccactctgttggatttcataccttccataccaataaatatcagaaaagtga

SEQ ID NO: 231454 - DNA, 316 bp, Homo sapiens
cgtgcccgtctgctgcaagcctgtgtgctgtgtgcccgtctgctgtggggcttcttcatgctgccagcagtctagctgccagccagcttgctgtgcctcttcctcctgccagcagtcctgccgtgtgcctgtctgctgcaaagctgtgtgctgcgtgcccacctgctctgagtcatcctcttcatgctgccagcagtctagctgccagccggcttgctgcacctcctccccgtgtcagcagtcctgctgtgtgtccgtctgctgcaagcctgtctgctgcaagtccatctgctgtgtacctgtttgctctggggct

SEQ ID NO: 231455 - DNA, 456 bp, Homo sapiens
cggcgtattttaaagagcttaagatttaaagttagatttgtctacttgttgagcactatgtacaaagcaagctccacaaatctttcttgagctgggacagtgcaccaggccccatgggatagcgataagcgagactcactgccattcacgcttagtggaagacccgaggtgcatcaggaaacaacccagcactctatcatttgataacattggaatgtgctaagtgcatgaaaaggaggaatgattcactctagaaaccagtgagggcttcacagaagatgagcttagctgacaatagatgctgaagctgtggagtgaatcagaagtggaaaaaacccggctcccctaagcaccgtattcagatatcatttttcatgcactgattctagaaacctggcactaaagagaaaattgcatggaggcaacatgtatgatgtggtacaattgaatccggga

SEQ ID NO: 231456 - DNA, 696 bp, Homo sapiens
gactgtctcaaaaaaaaaaaaaaaattatttctcttaactcttttggcttagtgtagacttgaaattttggggaatacattttaaaaagttgaaatatagcctatttatagtaagatggacaagtccttagtacactgtttgataaatttttgtgaacacactcatgtaaactattatccagattaaggtatagaacattaccagcaaggccaggtgcggtagcgcacgcctgtaatcccaacacttggtgaggccaagatcatattgatcactttagatcaggagtttcagaccggcctgacaacataatgaggccccatctctataaaaaataaaaaaaaattagccaggcgaggtgacgcatgcctctagtcgtaactacttggagactgaagcaggagaatcacgtgagtccaggatttcaaggctgcagtgagctgtgatcgcaccactgtgcttcagacttggtgacagagtgagaccttgtctctaaaaaagaacaatcccctatcccccaagaacattatcagggccccagaagcagttaatattcatacctttcaatggcaaccagtactttttttttttttatcagaatagttgttatttttggatttctaatttttgaacttaaatggcatcatagaatatgtacccttctgtgtctgatttctttcattcagtattcagctttt

SEQ ID NO: 231457 - DNA, 506 bp, Homo sapiens
ccgatccgccccagacaggtctaagctacctctttgcacctgggaactctgtgccttttgagagttgaaggcttaaaacaacaacaaccaccacaacaaaactattcacctttttatccaatagaaactaaggctgtaaaggatgatgcccggcatctgctcagcttctgatgaggcctcaggaagcttccaatcatggcagaaggcaaaggggaacccatgtatcacatagcaagagcaggagcaagagaggcgcggggagaggttttaaaccacgtcttgcaagaactcactattgcgaggacagtaccttggggatggtgctaaatcattcatgagaaatctgcccccatgatctaatcacctcccaccaggccccaactccgacactggagattacatttcaacatgagatttgggtggggacaaatatccagactatatcggggctgtaccagcaattgactcctgacatctgttctgactggtcagagtctgttctgata

SEQ ID NO: 231458 - DNA, 398 bp, Homo sapiens
ccgatccgccccagacaggtctaagctacctctttgcacctgggaactctgtgccttttgagagttgaaggcttaaaacaacaacaaccaccacaacaaaactattcacctttttatccaatagaaactaagctgggaaaaccaagacatagtgaatctgagaaactgcctaaggacaagctcatcggcaagcggcagagcagtttttaatcaaggcccactttttaaccactggaaagaaaagagggaaggttctgatttcatgctcactgggacacttcctggacacattcagcttcttacccattattcagaaggagaagtagaaacctgtagaagtagccctggggagggtagtttctgataaaggatgtctccatttggaaattaattagtaa

SEQ ID NO: 231459 - DNA, 419 bp, Homo sapiens
tttaaacacagaatcttagtctgtcacccaggctggagtgcagtggcctgatctcagcttactgcagcctctgcctcctgggctcaagcagtcctcacagctcagccttgcaagtagctgggactacaggcatgtgccaccatgcccaggtaattttttttggtaagacagggttttgccgtgttgcccaggctggccttgaactcctaagctcaagtcatctgccttcctcggcctcccaaagtgctgggattacaggcatgaaccactgcgactgaccctctttgcctttttgaggcccagttttctcatagggcttttgagagacaatgagtcaacaaaatgtaaaatgaaaaaaaggctttgcaagtctaaactaaaactcttgcatttgtagcttcagtgaaacctttgagatg

SEQ ID NO: 231460 - DNA, 390 bp, Homo sapiens
tgtggaacgtgactttcctgatgcgcctggggctcttgcccctatgctgtggtgctctaccagatgccaggtccacacccctgctcactgggcaccgccttccctcccgccaagcagacaggaagcagcatttttatcctttggagcctaatttggtgatgcttttccagcacccatggggtgtgctttcccttgaggttgagtccttgtttcccatgcatcccacagggtgagactctcactcatggtcaggttcgaacactccttcccacccatgtctcctcctctttctggtttcatcaatggtaacccttccacaccagtcttctggtgctcttcaaacacagcttgtaaattttttcccttgctgaagtgattttcccagccaat

SEQ ID NO: 231461 - DNA, 322 bp, Homo sapiens
agggaaatggctaactgacgaggggcgcgcgagcagcggctgcctgaaccccaaccgctgcaagtttacgccccgggaggccgggatgaaggccagggacaggaaacgcggaggaggaggtggaggaggagggggcgcgcagcgcaggcccctgccccccggcccacccaggaggctctgccagctaagcagcgagcaggtgtcagacacagacttccctggagttgactctcagcctctcccactcggaccgcgcgcctctcccactcggactcggatcctcgaaacttttaatctttaaagaatacaatgtgaaaacctt

SEQ ID NO: 231462 - DNA, 438 bp, Homo sapiens
gaccagctccagtttcatgggcccaaagagctcagtgaagcaggctttaaaaatggatcacccagcctctgcaccctgaagtctgaagattttctaatatgatcctattcccataaacaagccttaattccaaagtcttggagtgaagaatgactgtatgaaatttgtacctgtgttaattagctctgtctccctaggaaagtctctgagcctcaactttcctcatctataaaatggggataataatagaatcattgtgaggattgaatgaaccttatagttcttaacagtgtgctttgcactctgtaaacactcattatcattattactttaattaccgctactgttattaatctatgcaaattctgtctgttcttttgagactgagctgagattcctcctcttccatcaagtgttccctgactactccacctggaa

SEQ ID NO: 231463 - DNA, 537 bp, Homo sapiens
ccttgttgcttatatctactcccaagttaaaataagaacaaactgacggggaggttacatggagatggctctgtggaagcgaggcttggggtcagatggcctcggcttggccgcagctccctgtgcgtcacctgccttggctgcgtggtgcggcggctgggagtggtgcgccttcttacctgcgctcctgcggagagtgtggccgtgccagccggtatgttgggagcccaatgacttgtttcttaagccaggcatccttgtgagccacatgttgttgagacgctagaccaggggtcggaggtgtggcctatgccagtccggctgggagcgtggccctgttggtggcgcttctcaggcccacggtcacgcagtcacatggtgccatgctgaggcatttgacttggaccagacatagtgctgtttcctcccatcttagtgggagtcaggagccagccagggcctctggggttctagcctcctgcacctccttgccggcgtcctcagggtttctgcgatcagctccttcatctgcgaaag

SEQ ID NO: 231464 - DNA, 371 bp, Homo sapiens
tagtatgaacgtaagatactggtttttagaccctagggaatagagggtaaggatcgaacttcaggtagggacttttaggttgtggttccttcttactccctgaactcactcaagggatgtggtcctctcctgaggctacagtgaactcaggcggctgagatgttgagacagggtaggaggtagaggagcagtgccttcctctggggtcggtatgattccggaaacactgcagccccccgttaccagtgctggagtgacagcattcaaaaatgtacttggtatcttctaaaagcttttaaaatggaaaccatatagtatatatacacacaagacttcaacaattttcaaatggatagtgagcgaatacagtc

SEQ ID NO: 231465 - DNA, 451 bp, Homo sapiens
aaataaagctgcctccgtacacagcttcatcactggcctgagggcatttcagtttatttcagccaattaaaataacaattactgcaggaggtgcttatgggagtaccttctgctggttgagtccccaccactcctggtatgattaaaactcctcaacttcaagttttcatatcgcgatgactacttgtacttcaaaaaaaaaacttgtacagtaatttggaagagcacgttctatttattcccttcattttcaaattcttttcttaatgttttacagacccctttctacagtattatagcctgggcttcacctcttcttcctcttctcagaaacagtttgtacctactaaattattatataaaagccagcaccattgttaaatataatttataatgagctaaagtcagaaaccgaaaaagtaaaataaaataaaatgaataagaaaccacc

SEQ ID NO: 231466 - DNA, 447 bp, Homo sapiens
attttgtatcaatcttattttctaatgtatgcattttaatgctataaatttccttctaagcactacttttgctacattccataaattttgataattagtattttcactttgattttgttcaaagtatattaaatttatcttgaaacctcttctttgacctatgtgttattcaggcatatgcttcatcttcaattattttgggatttcccatatatatttctgttattgatttctagtttaattccactgagatccgagagcagagattgtgtgatttctattttctaaagttggtaagagggtatttatggccccaaaagtgatcttcaatattaagtgctcaatttgaacttcaaaagaatatatttccttttgtagttgaatgaaatactttatatatggcaagtattaagtttgtgcaaaagtaattgcggctttgtcattgct

SEQ ID NO: 231467 - DNA, 500 bp, Homo sapiens
tatgaatgaatggatttgaagggcaggttgaatttagatcatggaagaagacaacattatcagtgaaatcatcccttaattatagagacaaatcattcaacatttctgagttcatactctgtgccttgtgggacatacaggtgaaagactctttccctgcagcgtgcttccttggagaacacttcccttctttcctctcctcatctatttcctccacctttcctgctctcctccccattcccacttactgaaatgctaagtgcccatcaactgctctgttgctgcatctttggtacctctcttgtgaccctcaccacattatgcctccactcagtaatttaatttaaagtataacctctcatcatagcctttgtttattgaggggaggttccatgccacctccagtacctggacactcaacatgtggatagactgagataggccacttatcatggtaatagttatttactaattcttagatacggtgttgtaagtatgga

SEQ ID NO: 231468 - DNA, 388 bp, Homo sapiens
ataccttgcatagctcactaagcacacctccttccatatgagctgtgttatattgtggtacatcatttggaactgctgagtctatatggaaatcctgatgtactctcgtagaccactagccacactgagagtgttggaaactaaagaccccaggtgtcctttggagccaaggacagttgtcttgtacaagatcagtggggctggacccatccatttgtgagtcctgaagtcgagctcaatgatattgtcttttgcagtgactgaacgggctcccatgccaggcctggctggatgttggcctgggagccctctttgcgcacggtggtacaagtcctctccctgctgtgcagaactaagagctctggaatgtgggcacagcatgtggtat

SEQ ID NO: 231469 - DNA, 502 bp, Homo sapiens
tgttataaaaaaagacggacaaaacaatcgtatttgaggacatgctatatttcttattttctcaatttttaatactttggatattgcttatttgctcaaagcttcagttaactccagaattaggcctagtagtattaatagtagtagcagtaaagattacgtgacctttaattttttagacagtaattcttatttaacacaataggctccatacatatatatttattatgattttattgcttgtaagtgtgtatgtttagtgtttgctgtatgattttattgaatatgtttaagaattatgaaggtcactgattttatgtgaaaatgacaaattatgtacctgtgtgaagtatatcttgcctcttagaaaggtttctcctttcctgagctggaattttctttaaagttttctgagaattaaactttgaccagaaaaccttctatcaaacttttctgggtaactgatgtgatacaaatttgatttttgtgcatttcattatta

SEQ ID NO: 231470 - DNA, 772 bp, Homo sapiens
ggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggcagccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcagcaataccagaagaaatggatgtgactgctttacattaatttctactgatcccatccaaacagataatatcagaagaaatggatgtgactgctttacattaatttctactgatcccatccaaacagatgaacaacttgatgtcttcctttaaaaaaaaaatgacatgtggccttcatagcttttttccttccccttgatgtaaatctcaagtgtttaaaaggaggaatgagtctaaatcatagaaaatctctatttagattgggataagctaattagctattatttattgatcccttgctgtaagtcagaaactatattcgatgctttcaatgtattaaatctgatccttctctcaaccctgcaaagt

SEQ ID NO: 231471 - DNA, 444 bp, Homo sapiens
agggaggcaaaatgtgtgtatccctgagctggaagttcaaccaggcagatttcatgggcttctttcacacaagaaggcaataccagaagaaatggatgtgactgctttacattaatttctactgatcccatccaaacagataatatcagaagaaatggatgtgactgctttacattaatttctactgatcccatccaaacagatgaacaacttgatgtcttcctttaaaaaaaaaatgacatgtggccttcatagcttttttccttccccttgatgtaaatctcaagtgtttaaaaggaggaatgagtctaaatcatagaaaatctctatttagattgggataagctaattagctattatttattgatcccttgctgtaagtcagaaactatattcgatgctttcaatgtattaaatctgatccttctctcaaccctgcaaagt

SEQ ID NO: 231472 - DNA, 1094 bp, Homo sapiens
ggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggcagccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcagacccaggcactacagccaaatctaacctgatccacagatgattgaaggatcgggggagctcggcacgggatgtggcagcaaatgtgcggcactaaggacaaagtcactgccttttgtggaagccagatcagaaagatgactgtgtgttgtgagtggtggatagagagccctgttgcccaggtgagaaggagctcagttgagataaggattccaggagccaactcgagcccctcaggtagagacaacaataccggttgaggctgcagctgtggagttggatggtgtttagtcagtgctgaaatcactttcctgggagtcccttggcatgcagtcatctgagtgctgttgttgttgttgggtttttgttgtttcctattttaaaagagtaatcataatactgacgaagtgagggcctgttttcaaagaacatttacttaaagatatagagtaaggttagcatcggtcttgccagtggtagaaacctatgccaccaacagccatcatgaaagggccccaggagtctttctggttcttcatttctattcagtttgattcaacaagtgtgtattgattgaatgctttctgtgtgccaatcattgagctagccacagaggaggcaaaggtgattaagccacaattccttccctcactgagctcacagtctgatgagagaggcagataggcattgt

SEQ ID NO: 231473 - DNA, 511 bp, Homo sapiens
cagaaagataaaacagtattacgaccaaatttatcagagagattacatttcttaatttggaaatgtaaaatttttagtagttttgacaaatggttgtaaccaaaaggttatcagctaggatagaaataaaattaggctgctggtagattaggaaatcatgtagaattagacgatgtctggtaaaaattttgttttcctttcaactttgaggcagttagtctaatagaaccctcagtggagttagaagtgcccagaattattaggaagtgggcaggggaggctgcctcattacttccttcagctttcaatcagtacaaaatggagcttaaaatcaggctttcagcagacagcaggatgttccatatctacctatccacaaatattcctcattatttttagcctgtaactgtcatatagcacttaaacttatttttaaatgctttgctaatgtttcacttgagtagaaaaacgcacatgatattctataaaatttacctgcaaatatactaaa

SEQ ID NO: 231474 - DNA, 541 bp, Homo sapiens
accaggaaatggagcctggaataagcatagccaccagaagggggtattctagaggagagacccagagaagtggaggtccaggttctctggatgaactctgctcaaatctttacttgacccctgaactacacatgaatgaagcagcttcaaaacaaccactgaggcttaagtaacttaactgtatattgaacttgcagtcattgcaggtgagaccacagtttgagtctaatcaaggtaattgcctgctaaaacaaatacctcagtcatttttaaagcaatacggtagaactcaggttatactaaatataactttctcaatgtccaggatacaatccaaaattacttgacagagaatgaactaggaaaatatgacaagaaaaagacagccaacaggtttacccagagatgaacaaggtgaccaaaagatataacacaaggactttataccagctattctaactgtgctcaatgaataaaggcaaagatgtttacaatgaatgaaaagatggaatatctcagcagagaaatagaatatgtaaaa

SEQ ID NO: 231475 - DNA, 230 bp, Homo sapiens
agttatctacccttctgtaaatactcagatttcttttatagctgatgttgtcacccattttttatgacaattactagaacagagttcaccaaccttgttggcatttagtaactggactcccaactgggctaagcagttgtagtaaatgtccctaataggcgtaaatagaggagagtaaaatgaactggaaatgttaataggagggaatgagaaagaaaaagttagatgag

SEQ ID NO: 231476 - DNA, 363 bp, Homo sapiens
attcactataaaaaaaaaacaggtaagtcaaaaaatgaagaaactcaccgcatagtgccaccatctcagagatgattgttaaatattgggtctttatcttgcccatccttttcatatgctatagaaatgcctatcttcccgaaaataggcttatcttagtcacagttttgtgatgtgggtccggtcccccccaaccccgccatggagtcttgctctgtcaaccatactggatggctcactgcacaccctgtcccccgggctgaggcaggagaatcccttgagcccgggaggtggaggttgcagtgagctgagattgcaccattgcactcccccctgggcaacaaggcaagactctatatcaga

SEQ ID NO: 231477 - DNA, 476 bp, Homo sapiens
ctgcgtatcctaggtgagtttgaggtccccacagagaatggaccaagtaatcattgtcaccaaagagggatccttcctggtggtaggtgcgatggataagtgaggggtaccagcaaccacctgtcataggctgacggcccagatgataagttccccactgtgaacttgcttttagtcagagaaaaatcagctctgtgaatctcctagggtctgcatatttaactaatttgggatgtttcctattaatgcctatttttcgaaatgcaaaaaaatacaagtaaaaatttacctgtaatgtcagcatccagctgtaaccactgttaatattcttggtgtgttccttacagacttttgtctattccagtgcatattgatatacatactcatgttcatttaaataaaatgggattagacaatgcttgatgttttatgatatattttctcataaaaatttaagctgtcttacaaaatttaat

SEQ ID NO: 231478 - DNA, 179 bp, Homo sapiens
ttttaagtgtacaaataggtgtatatatttatggcgtatgtgtgacgctctgatacaggcatacaaagtgtaataaccacatcagggtatttggggtgtccgtcacctcaggcatcgatcatttctttgtgttagcaacactccaattccactcctttagttattttaacatatacttg

SEQ ID NO: 231479 - DNA, 387 bp, Homo sapiens
gtccacatttaaaaagtgaatccagtgttgtcattgtgatcgaaatggctcagctccaggttctaagagcttcctgttcagtacatagtagtcaacaaccttgtttgcattaatggcatttttttttaatttggaagaaagcaaggcccttcttaactttcatcccttgttttaatgttagcaatgttagatgcaaaataaggccaggcaaaacgtcaccatggttgttctcagaaaagcaaaccaacttcggactgcattaaaagagtttctgcctgtttagtaaatgtgccacatttggtgactatttttctttttttgcaatatttcaacttgtattgtcaaaagtgctttggaaaaaaaatataatatttgtaataagaggca

SEQ ID NO: 231480 - DNA, 459 bp, Homo sapiens
taagttttatcctaattgtaacattaaattgcaaagaaaataatgttttctactctatcttaaaatatatggctaatacgcattaataattaatgtaaatgtattacttctctagaccgttcttaggaatgtctcagaagctgtttgtttatgtcaacatgaatatcatctgagatttcagaagaaagagaatacataatttatacctttagttttgagttaaattagtatcatgttcacaccccgtaaacaattaattctctaaggagtaggctctctcattgaaatggtaggttagaaataaaccacatacaggaatctgtaaaataattctgtttgttatttttattatatctaaatcttcaaatagttttcttttaattaaaaaaatttggttattctagaaaaatactttttttccatccagttaaatcaaaataaaactatataataagtatg

SEQ ID NO: 231481 - DNA, 372 bp, Homo sapiens
tgcgtgaaaatcccattcaggctatgatccacggctaaatttcagtcccaagcatctatcacatgtcacctctaaagcgccatctgtctgctggtaacactactactgaagcatttgctctgctgagggaaaacaatatgctcctatattaggggtcatttctgctctacagggaagaaggactctgtctggccttataaacctagaatactaagaataacctgacccccaattctgaggcagaggcagtgagctcaggtcaaggataagctctgacagttgtccagtcaatgccagagaagtctctctcctaaaagagaaacacacacaaatatacacaagattgaaggctgaggaaagtgctcgaaagga

SEQ ID NO: 231482 - DNA, 502 bp, Homo sapiens
aataataagtgacagagtcaggactaaagggtcaccgagcgtgcattcgagtcatacaatgctagttttacacttagaattacttgaatgagaaaatttaggagtatatacagggccttttaagtattaatcaaagtataatataatttcggtactatttatgtatgtatttcttctaggagctagactttcgcatgtcttaagtgtaaggtataggccaggcgcagtgtctcacgcctgtaatccccgcacttttgggaggccaaggtgggtggatcacttaaggtcaggagtttgaaaccagcctggccaacatggcaaaactccgtctttacgaaaaatacaaaaattagcagggcgtggtggcacatgcctgtaataccagctactcaggaggctgaagcaggagaattgcttgaatctgggaggtggaggttgcaatgagtgagatcacgccactgcactccagcctgggtgacagtgagactctgtttcaagggga

SEQ ID NO: 231483 - DNA, 870 bp, Homo sapiens
tgcatggggcggcctgggactcgggggcggggtcagtcatataaggctgtgcccagcgcttttggaagcagtaagtccagcccgaggctaaggaggtgttaaccaccgaagggaggtagaatgtttttccccaccagaggaggcagcgaccacgtctcctctatggaggcattcaagagccgtccagctgaagcagcatcactgtctgagctcggaaggcacaatccacataggtctgcatggtccacagagctgcatacccacggggccagcgggaggtgggcagctgccgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaaggtgtgtcttcagattcatttagtgttcgtggaaccccagggaaagctgatgtaaaaacctcttttttctcccatatgtctcaaaaagttgtattttctgggtccaagggatctgcaagcctcctaaaggcatttccattgtcactaccaccaggtgtgaactgtaatctggcacgtatagttccaagaactgtcataatagatgctgaagaaacattgtgaaggttaactcgctgttaccaactgtgaagtcattagctagaggaatcttgggcggtctgaaat

SEQ ID NO: 231484 - DNA, 850 bp, Homo sapiens
cggggtcagcctgcggtggaggggaagggccctagagccgtggggagaggcagcccgtggcctggagcagtggaggtgttaaccaccgaagggaggtagaatgtttttccccaccagaggaggcagcgaccacgtctcctctatggaggcattcaagagccgtccagctgaagcagcatcactgtctgagctcggaaggcacaatccacataggtctgcatggtccacagagctgcatacccacggggccagcgggaggtgggcagctgccgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaaggtgtgtcttcagattcatttagtgttcgtggaaccccagggaaagctgatgtaaaaacctcttttttctcccatatgtctcaaaaagttgtattttctgggtccaagggatctgcaagcctcctaaaggcatttccattgtcactaccaccaggtgtgaactgtaatctggcacgtatagttccaagaactgtcataatagatgctgaagaaacattgtgaaggttaactcgctgttaccaactgtgaagtcattagctagaggaatcttgggcggtctgaaat

SEQ ID NO: 231485 - DNA, 1414 bp, Homo sapiens
cggggtcagcctgcggtggaggggaagggccctagagccgtggggagaggcagcccgtggcctggagcagtgggtggatcgggcggaggccgtcaagctagccggaaggggctgtgctgtcaaccagcgagcgcaggaggtgttaaccaccgaagggaggtagaatgtttttccccaccagaggaggcagcgaccacgtctcctctatggaggcattcaagagccgtccagctgaagcagcatcactgtctgagagagaggcatccaaaagggaaaaagccggcctgaggtggaccacagcagacttgataggcaggcttgaggaggcggcgtctgatttacacagggcccacagattggtctgatcaggtgtgacgtttacatagcgctcggggaaggctggtcgtcccaccctaatcttattaaacaaatgggctttctacttggccagtaccatcttgtctgctccttactatacacgcgggtggcaaagacaggagaagatggagccaccgttttgaacgtgtctattcccaggtaacctttctctgttggcacaaccaccagtattagcctatgcaagcttccagcttgcttgtctgtgcctgcagcttgattttacaggttgttctttgttagaaaagaaaatgatttggggcattccttttaatgcttttcattaaaaggaaaaccttaccaaggacttccttattctgtctgcctaaataatttatttttaactcttctatcacagctcggaaggcacaatccacataggtctgcatggtccacagagctgcatacccacggggccagcgggaggtgggcagctgccgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaaggtgtgtcttcagattcatttagtgttcgtggaaccccagggaaagctgatgtaaaaacctcttttttctcccatatgtctcaaaaagttgtattttctgggtccaagggatctgcaagcctcctaaaggcatttccattgtcactaccaccaggtgtgaactgtaatctggcacgtatagttccaagaactgtcataatagatgctgaagaaacattgtgaaggttaactcgctgttaccaactgtgaagtcattagctagaggaatcttgggcggtctgaaat

SEQ ID NO: 231486 - DNA, 298 bp, Homo sapiens
tccacagagctgcatacccacggggccagcgggaggtgggcagctgccgggctctcttctgaagcaggtgagtatggagtcccctgtttgtctgcaaagaaacagactgcagacattgctgcagtcatggtctcggcaacgtcatccctgatctagtggaaggccaaggtctctttctagcaactacataagtagagatggaggagaacacaaaacaggaagacaatttttcctttttctctcattttgggcctcttttaattacgaatgctgacctttgtcagggaatcatttttaa

SEQ ID NO: 231487 - DNA, 584 bp, Homo sapiens
tttggagtggcggttgggcggttgggcggttgcatggggcggcctgggactcgggggcggggtcagtcatataaggctgtgcccagcgcttttggaagcagtaagtccagcccgaggctaaggtgagagcgtctgccgggacagtgtggctggacccacgtggcaggtgcgaggcagggtcactgcggatgggagagaaggcgtagaggcctcaggccttgtggggtgtcacctagagatgccccaggagggctggggggccggggtgtttccagtgaagccagttggcatcctggccgctctctccgagtggaaggcagagggaaataattgtattcacgcagggtggatcgggcggaggccgtcaagctagccggaaggggctgtgctgtcaaccagcgagcgcaggtggcctggtgtagaccccgggaggctgggcggggacgctgggcggggacctggttgaggacctgggcggggacactgggtggaaaccctgggtgggcacgctgggcggggactctacagggctctccctctgggtagtcacattcacttgttgagttgggtgtccatctcctctg

SEQ ID NO: 231488 - DNA, 852 bp, Homo sapiens
aaatcttcatcttgtcagaattcccactgctgtaattgaagaataggactcttataggacctggggctcccaggaggaagtcattggcaaaatgcagatccagctgctccaaagtctacaatacctgcagacaaaggcacggcctcctctgaaggtagagcctggggaagtccttgggcagccctaggaaggaggtggacctcctgcctctgctctgccagcaacacaccttgaggggtcctgcttatcctaggtggggttgtgttcagagaagtggagggaggctgctttggtgaaggggtcttatgcgaggtcctcatgcaaggaccatctcctatttgtagagacaatctttttgttttccagatgcagaaacctctctggtttagtcaggtgccctacactctgacatgtggctggcaggctgcagccactgccaccccctgtgtgaagtgacgagaaccactggcagtccttaagggctatgtggtcattttcctagatggccttgaggctcagtgattgtaactctcaagtgccttgtcctgttagcctcctctgttgaagaacttagagcatgtggggtctggctgtcagccccctgacagcttgctgccctccaaggcatggcgttcttcataacacacctgctttcacaggctggcttccccatccgccatgatattcacatggtctcttggtagagccctttcattctagggtccggggcaaggcgggtagtcccaaagtcctcttgctgattctctttctcccaggaggctccaaggccatcagacaaatgcacccttggtgacctcctttgatatcccagcaatcctgagtgtttgcaca

SEQ ID NO: 231489 - DNA, 466 bp, Homo sapiens
tgtctctggcttgtgagacttagcataatgttttcaaggttcatccatgccgtggcacctatcagtactttattcctttttattgaggaataatatttcattttacggacataccacattttgtttattcatctgtggatggacattcagattgtttctacctttgggctattgtgaatagtgatgctatgaacactggtgtacaagttttgtttgaatacctgttttaacttctttggggcatatacctgctagtagactgagtgggtcatatgttaattctatgtttaactgtttgaggactggccaggccaatctgttttcctgagtgactgaaccattttacatttccaccagcaatgcatggggggttcaaccaatttcatcacatctttgctaactctttggtttctatttcttgttttgtttttttaagtgttaattatagctaccctagtgagtatga

SEQ ID NO: 231490 - DNA, 327 bp, Homo sapiens
aggaaggatctggtcccaaggaaatactcagagaagcaaaagcagcaacttttcaatctgcaggtcagaaccaacaggaataaaactctccagggacagatggcaacaaaacctgccaagcaactctactcaagtgactgaagcaggcgccgctgccggggaggaaccgatgggagagaaaggccaggctgggccctgacaccgccaggactccccctccaggaaccagggggcttctcctggtaagcgtctcaatagctatgcaggacccaccaatggcaaaggttaagcaggtatatgtgcatgtgcgtgtgtgtgcgtgtgtgt

SEQ ID NO: 231491 - DNA, 2398 bp, Homo sapiens
gggacccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagcttcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggcccactgcccgcacccctcctggtgctctgccccagccgggccgagctggaccgctggctttaccacctggagaagcagacggccctcctcggggggccgcggcgctgccactcggcacccccacagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccggaccaggccaactctgaccgtgccagcattggccgacggaggaccgagctgagacgcagtggcagcagccggtcacccgggagcaaggcccgggcagagggccgcggccctgtcaccccactgcacctggacctgacccagctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacctggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagccagggtgccccgaggaggagggtgggtgggtccttgtgtggcctggcgcgcgccacagggcagcacgggagacgttgacaccaccggacgagaaag

SEQ ID NO: 231492 - DNA, 124 bp, Homo sapiens
cagctctgaaggaggctctggggcctggggtaggctgtgccctgcccagcagccgtctcatcctcagtctgtccatctacaccatttctctgccttcacggctgcaggaagaatgatgaggccg

SEQ ID NO: 231493 - DNA, 396 bp, Homo sapiens
agcactgccaaggacatggatctctcaagctcctgtctggcacattgcaggaagtaaggggcatgtctaaccaccacgctcagccaagccaaagaacaaaggcagcggcactctctctggaccttggggaataacacagccctcccaggcagaagatgcaagcattcctgttgcagtgcaattaggagcagcgaagaaactcagacatgtgccccttctgtgttggcaactgatatgacagaacttcatgaggtgcaaaatacaggctgtgtgtgtgtgtgtgtgtgtgtgtgcacactcggtgctatatgctgcagcccaagtttcagagtgatttttaacttgaagctgatgagatgggatattgtgtcttttttaaaaatgtaaccaacaaca

SEQ ID NO: 231494 - DNA, 396 bp, Homo sapiens
catagtatgcatttttagtcttattcctgggtctgttttatttcttcatccatgttctgtcttttttctcaccccaacttttttttgcttttacctctaattcttgtccatctagttaattccttttgaataagttagaatataaataagtagtaaattaatataaatgaataaaatagaaaacttcattgaaccatcttgtcattactttaatcaacagtttccaaccttggctgcatattttaaaaatactgatgcctgggtgccacctcatgaaatttcgatgtcattgctctgagttgcagcccagacatcatcattttgataagcttcctaggtgattcctgtgtgcagccaggataggaaccactcttctaagtctttgctgggatttaa

SEQ ID NO: 231495 - DNA, 968 bp, Homo sapiens
gtctttcacaatagagctacccagagcactggctactgttagaacaagatatatagcatatatttcaatagaacgcccagataataaaaaatctgaatctggatgtatctatatcctattggcttgttataggttatcagagcactggatactgttagtacaagatatatagcatatatttcaatagaacgcccagataataaaaaatctgaatctggatgtatctatatcctattggcttgttataggttatcctttattttattccagagggaaataactttaggtataattctaagaactgcataataacttgaatactttttctctgacaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231496 - DNA, 1103 bp, Homo sapiens
ggcacgaggcttcaggtccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtgtgggtgtcccgacgtccggagggggcaggagtttccacgggtcctgggacagagctcacctgttttgttttgaattacacttatttatatgcaactacaggcctgacgctagcggtgaagaaggcagatacagccttttaaggagttggcagatgagtgggagagagaaaactaatctcattatcggccacaggctgtggtcagtgttttgaaggaaaagtacagggatgtttggcaactgtggtatttcaggtttgaccttaaatccttacttaaaccaatttttacaaggattggtctaggtgcccgggcgcggtggctcacgcctataatcccagcactttaggaggccgaggcgggcggatcacgaaatcaggagatcgagaccgtcgtggctaacacggtgaaaccccatctctactaaaagaatacaaaaaattagccgggcgtggtggcgggcacctgtagtcccagctattcgggaggctgaggcaggagaatggcgtgaacccgggaggcggagctttcagtgagccgagatcgcgccactgcactccagcctgggcaacagagccagactccgtctc

SEQ ID NO: 231497 - DNA, 1712 bp, Homo sapiens
ggcacgaggcttcaggtccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatgatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231498 - DNA, 1923 bp, Homo sapiens
ggcacgaggcttcaggtccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231499 - DNA, 1493 bp, Homo sapiens
atagaaagtcactaatggtttacgttcctttcatggttcacgaatagtttacgttgttaaagggaagctggacgagataataaagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231500 - DNA, 1514 bp, Homo sapiens
ggcacgaggcttcaggtccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231501 - DNA, 1476 bp, Homo sapiens
ggcacgaggcttcaggtccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatgatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231502 - DNA, 1054 bp, Homo sapiens
ggcacgaggcttcaggtccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaacaaaaaa

SEQ ID NO: 231503 - DNA, 387 bp, Homo sapiens
actgaggaggagagatactctgtgaggtaaatgggagttgcagagaagagggctggttgtgagggcacctgatgaatgccatgggagcagcaggatgtctaaggactcagcaggtatctggtcccaattaatcaatacccaagaaaagcaaaagcccaacagtttccttgtgcttaactgttttctctgacccaattggccaatcttaggctgttaacattctctcttcagcatttgaggacagaaggaagcttaatgactggtctggggtacatcccaggattttgtaatggatccccaggaagcctaagggatcaggatcactctagtatttgtgtctactatgttaagagctgctgctcttagggtgggtgagcatagccaacc

SEQ ID NO: 231504 - DNA, 385 bp, Homo sapiens
ttcattcattactgtggtcataatacacagttacctggccaggaaagagtacacatcacagggatctgctcactgcacgtgtgcctgagctctccctcactttctgccttcttcaagaattcttccctgattggtccaaccagaagcgctgattctccccacctgatttcctgtaattttataatctatgtccttcacttttgtgttatattgtttatttccttttggtctttttgtgtgcatatgtatatgttttggggaatggggtattcacttttgttactcactgtgttactcacttttgtatgcccatagtgcagagcatggtgccttgtacatagagtatgttcggtaaatatgtgcaataaaaagtcctttgattaca

SEQ ID NO: 231505 - DNA, 834 bp, Homo sapiens
  misc_feature (236)..(236): n is a, c, g, or t
  misc_feature (806)..(808): n is a, c, g, or t
aggggagcaatgtagacacaggatctttccagagttatcccctggttgtgggaatgccggaatacctcagataaagtaggctaaatccgctagccgcgacagacagtctcgagtcaagtgagtcaggtttggaaggtttaatgattttaccctacactaaaagagagcgggtaacaaagttccaccgttgaggacaacggaggccgattaatttttatatttttcaaatgtgaaantgtgttgttataaacaatgtagctttaggatacattctactcacaaaacagtcgcatgtaaaatgtttttatacacgcattaaagaaaaagaaactccttaaaatgaagtaactatttcctgtttcattttgtttgaacagcttttgttgctcactacgagttgctttaaatctctgggaaggtctgttccgaatttactacttctggattggctaaaatctctttaaagtgtgtgctttgttctctaaaaagcttaggtcagttgagcaacaagctcctcctgtttttttctttttttaaaaaaaagagctgagtaatgctggaggcttctcatgtggctgatgcaaacctggagaatttgcatcatcatttagctgtagtaagttggtgtgacaggcaggcgcttaaatacaagcccatgaggaagctgagctggtttgtaatgatagggcggcagcagcagcagcagcagcagtggtggaacgaggaggtggagaattgagagcacgatgcatacacaggtgtttctgagtagtaattagatcgtgaagggtctctgtggttggaannncgtggggccgtaggatattctctatg

SEQ ID NO: 231506 - DNA, 2468 bp, Homo sapiens
  misc_feature (1937)..(1937): n is a, c, g, or t
  misc_feature (2016)..(2016): n is a, c, g, or t
  misc_feature (2187)..(2187): n is a, c, g, or t
gctcggtccgagtatcccatctcaccggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttancatattcgaactaatttctaagaaatttagttataactctatgtagttatagaaagtgaatatgcagttattctatgantcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaagatggttttacacactanagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaattt

SEQ ID NO: 231507 - DNA, 3128 bp, Homo sapiens
  misc_feature (236)..(236): n is a, c, g, or t
  misc_feature (2597)..(2597): n is a, c, g, or t
  misc_feature (2676)..(2676): n is a, c, g, or t
  misc_feature (2847)..(2847): n is a, c, g, or t
aggggagcaatgtagacacaggatctttccagagttatcccctggttgtgggaatgccggaatacctcagataaagtaggctaaatccgctagccgcgacagacagtctcgagtcaagtgagtcaggtttggaaggtttaatgattttaccctacactaaaagagagcgggtaacaaagttccaccgttgaggacaacggaggccgattaatttttatatttttcaaatgtgaaantgtgttgttataaacaatgtagctttaggatacattctactcacaaaacagtcgcatgtaaaatgtttttatacacgcattaaagaaaaagaaactccttaaaatgaagtaactatttcctgtttcattttgtttgaacagcttttgttgctcactacgagttgctttaaatctctgggaaggtctgttccgaatttactacttctggattggctaaaatctctttaaagtgtgtgctttgttctctaaaaagcttaggtcagttgagcaacaagctcctcctgtttttttctttttttaaaaaaaagagctgagtaatgctggaggcttctcatgtggctgatgcaaacctggagaatttgcatcatcatttagctgtagtaagttggtgtgacaggcaggcgcttaaatacaagcccatgaggaagctgagctggtttgtaatgatagggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttancatattcgaactaatttctaagaaatttagttataactctatgtagttatagaaagtgaatatgcagttattctatgantcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaagatggttttacacactanagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaattt

SEQ ID NO: 231508 - DNA, 2797 bp, Homo sapiens
  misc_feature (236)..(236): n is a, c, g, or t
aggggagcaatgtagacacaggatctttccagagttatcccctggttgtgggaatgccggaatacctcagataaagtaggctaaatccgctagccgcgacagacagtctcgagtcaagtgagtcaggtttggaaggtttaatgattttaccctacactaaaagagagcgggtaacaaagttccaccgttgaggacaacggaggccgattaatttttatatttttcaaatgtgaaantgtgttgttataaacaatgtagctttaggatacattctactcacaaaacagtcgcatgtaaaatgtttttatacacgcattaaagaaaaagaaactccttaaaatgaagtaactatttcctgtttcattttgtttgaacagcttttgttgctcactacgagttgctttaaatctctgggaaggtctgttccgaatttactacttctggattggctaaaatctctttaaagtgtgtgctttgttctctaaaaagcttaggtcagttgagcaacaagctcctcctgtttttttctttttttaaaaaaaagagctgagtaatgctggaggcttctcatgtggctgatgcaaacctggagaatttgcatcatcatttagctgtagtaagttggtgtgacaggcaggcgcttaaatacaagcccatgaggaagctgagctggtttgtaatgatagggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataat

SEQ ID NO: 231509 - DNA, 562 bp, Homo sapiens
actatgtgaacatacaaaaaaaaattgaaatgtatactttacatgtgtgaattctatggtatgagaagtctagtctcaacaaagctgtaagaaaaaaaaattccaactctatcaaaccccagagctgtgtgttcttagaataaaggtttcccagcttcaagtctcagtttcctcctctgcaggatgggctaataagccacatcaccttgcatgaaaatcaaggagacagcacagctggggcccagcacgtagtaggcctcactccgcacgaggttccttccgcagaggggaagggaatgggggttgcccaagtagggcgcacggccaaggccatggctggtcctggacggccagacggactggacggaggaggaggctcaccgcccatgacataatgtagatggatggctcgggccatccgtcaggctgggagcgggtggccggggaggaggccgtgagggagcccattaccgtacacgtgttaacagcgcatcctttgtacagacagccgcgcgggcgcgggccagggccgctccccacattgtctgggcgccgcggccgc

SEQ ID NO: 231510 - DNA, 498 bp, Homo sapiens
ctccagcgggtccccgcccaggcgggaggccctcccagctgaagcctttcgctgactagattacctgggggaaaatgacttaacctcttcgaacccccagaaggtcagaagctttgcttttgggggagaaaatggtgtgcaaacgagacgcgaaggaaacgcaaaccctcgggcgtcggcgcagcctcttccccgagcctgggtctgtctaatggcccagagggagaggtcgcacccccgacccctggcacctgcgaaaccaagcgcccggtcggctggcagaaacgaaacctcaacaccctccagcctcccccgcttggttcccggaaccggcgagccaggcttcgcggaaacttgcccggcggcagccgcctagggccccgggatcgccctgaccgcagcccgcagctccgggccgggaggtgcgggccggcgcggtcgggcccgagcagcagcgcgacgcgcgcttccgccccgctcggctccggcggcggccgc

SEQ ID NO: 231511 - DNA, 210 bp, Homo sapiens
cagtggtcaggatcacagccagtaaatccagatgacctgggttcaagtcccagtcctgccacttcccagctgtgggcttttgcacaagtcacatggtcttcctgtgtctcagcccccacccccccatctgtaaacaaaacaacactgtaaaataacagtgtctacctcatggggatcttgcaaagatcaaataaagagctttgaagaaca

SEQ ID NO: 231512 - DNA, 235 bp, Homo sapiens
cggccccccagtcctctcttatgtgttgactcctgctcggcacccgggatgtgcggagtgactgatgttgtcagtgacctttccactgtgccctccgacttccccacccagatgggaagtattttcaataggacgtctgttggctgagaaggatttcttttcccacccatttgaaagctatccactgtgaaatgtagccagcaacctgccaccagcaataaattaaaatcaatga

SEQ ID NO: 231513 - DNA, 362 bp, Homo sapiens
aacagaagacattaagaaaacctaactctgaccccttataattccatctccaaactgaccaatcagcacttcccaagcccctacctgccaaattatctttaaaaattctgatctccaaatgctcgggaagactgatttgagtaataacaaaactctagtctcccacacagccggctctgcgtgaattactctttcttcattgcaattcccatcttgataaatcggttctgtctgggcaacggacaaggtgaacccattgggcggatcccacaattaagtgggatcaagtaagcttatactatactatcagaactgttgtgtatatttaataaaaatgaatgaacacagaatataccaaataa

SEQ ID NO: 231514 - DNA, 719 bp, Homo sapiens
aaacaacagcaacacactagagtttggaaaccactgatctagttcaaatccttcattttacagatgagaaagaggtccatctgttaagtgacttgttccaggcctcaagaaactcaacatttgtataattattcttttcgtttacaaaaagtcattcagatatattctcacctgggaggtgcattctattctgatccacagggtgttgctcagatcatgattcagtcttttcagttgtcatcttgtgcagtcttcaacgcccaaatgcaggacgtaagtcccacgtgcctgtgggaggatggcttctcctgttttacctgccttttcacatgtgccttttcattgttggcttcatttgccaaaatctagatgattgatacatgataatgtttgtaatgacaataatagtgataacctgactttagacttcagtattcttcagagttttcacatttggttctcattgccaccaccctaatatagggatggagtcatataaccattttacagatgaagaaattgaggcacagaagactgtgatctgcctcaagtcacataagagattaacggtagagctggaactagagcacttttaacacggtgttctgtctaccccgccacaaattctaatttgggattttcatgtttctcaagaaaataaaataccctctcaatagtataagctttgcacatgtgagaaattgaatgctgtgattaga

SEQ ID NO: 231515 - DNA, 410 bp, Homo sapiens
gacttctgtgatttgattcacagcaaaaacaattcatttactcaatacagaagaataagcaacagaataaaaatagatttcgttatacaatctggatttggggaatctataggtctaccccttcaaatatttattatcttaaatattattttcagtgcttgtaattcctttgaataaaatataaataatgctttctgaatgctttataaatagtgaatatggatttgatagtgaaacaggggctaatgtcctatataggatatattgtctctaattgattaccatgagcacttcttacttatcagtaacttccagctcattaactgaagacattaatttacatgaaccagaatcacaaagatacttgtttaaaattcagatttctgagccctatttggcctactgaatca

SEQ ID NO: 231516 - DNA, 280 bp, Homo sapiens
tctggataaaccaaatttgctgacctcttaaccttggacatccagtctctagaacagtgaaaaaattaatttctgtggtttaaactacatagtctttgcaactttgttatggcagccctggcagactatcagaaatgcattaagatgttcacaaaaagaaatgtacaaaatgttcttagcaacattcttgtatttggttattctgagaataaccaaagcctaaaaacagtccagatgtccatcaagtgtaatttgtataaattatgtttatttattccaa

SEQ ID NO: 231517 - DNA, 559 bp, Homo sapiens
cacgaggggcttttaaaaggtaattagattataagggcagaggccccataaataggattaacatccttattaaaaagacctggagacgtcccttcctcctactgccatatgaggatgcagcacaaatatggtgggtgtctataaatgaagaaatgggctctcaccaaaacctgatcctgctgacaccctgatctcaaacttccagccttcagaactgtgagaaataaaggtctgttatttataagttattcagtttataatattttgttatagcagcctgagatgactaagacacagccagtttactggctttttgataaataatagataactgattattttaaaactcatgtgggtatgggagcaatagggagagaaaagaggagataaaatacacacggaagttggcacatgctctccagggttttgcagaaaccaggtggtagccccaaaggaaaatcaataaccactgcttctatttgtggctctgtttccacagaaacatgtttgtgggtgaatttggaaggcagatttacaatgccaaaacaatcagtccaaa

SEQ ID NO: 231518 - DNA, 781 bp, Homo sapiens
  misc_feature (605)..(605): n is a, c, g, or t
  misc_feature (663)..(663): n is a, c, g, or t
tcagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaagggagattcagaattactaagccgtcttctcagtgaaagattttcagtcaaccagttagatngtgaccactgggcacccattcattatgcatgctggtatggaaaagttgaagccactcncctattgtttagaagaaagggaaagttgcaatccaaaccttttaaatgggacaacttagttccccccctccttttgctgccgggaaggaaggacattgctgaaaattagttccgattc

SEQ ID NO: 231519 - DNA, 571 bp, Homo sapiens
aaaaaatttgcatgtttcttccttttgtttttcagacaattgagaatctgaaattctttaatcctgaaattctttaatcctatctctcacagtaatttaccaacacaatttttgcatatacttctaaaacttgatttagaaacagactgtgttttaaatttgtatttaatttttgtaaagttatgttcctgtgtctgctcacaaaagtctataatgcttggtataactgtactcaagctgaactataggataaaattttaaaagttaggccgggtgcggcggctcatgcctgtaatcccagccctttgggaggctgaggcgagtggatcacaaggtcgagagatcgagaccatcctggctaacacagtgaaactctgtatctactaaaaatacaaaaaattagctgggtatggtggcacgcgcctgtagtcccagctactcgggaggctgaggcaggagaatcatttgaacccgggaggcggaggttgcagtgagccaagattgcgccattgcactccagcctgggtgacagagcgagactccatctcaaaataaaatataataaaataaa

SEQ ID NO: 231520 - DNA, 358 bp, Homo sapiens
ctgcctggctgagtaaaggaatgaataaacaaacttccatttattgttttgtcaacagattgtttcataaacagtcttcagttgagtgtgggtatgttcgagaaaaaaaaatgagagatactgttttgaatacaatcgccttgacagatggtgacaatgaccaggtcttttgatctggactgacttgtatagcccagcacccagcacctaggaggtctccagtgaataccttttcataaatgccaggtagagggcagctgctgctattgcggcctcaagcagaaaggtttctttggctgaataaactgtagcactagcaacaacacagtggttattttctgtcctgtttcagtctcca

SEQ ID NO: 231521 - DNA, 438 bp, Homo sapiens
tcctaagagaaaaggaatatcatttattgcctcttgcaaagtaaatactcctctatttaactgacgggatgaaccaatgatgtcatttaacagtttgtttgttggtgatctctactgctgaaatctcattaacatacacatttactcctttgatcttcacgataatcccatggaattggcaagtaaaaggcattattgacattttacagctttttcaggagttaagctgccttcgcaatgaggatcaaacctgcagcttacagcttatagactcgatgtatgtaagcaaaatggggaattgccaagtctaccttaaaatggccatttgccatacagttacttgatagacccattaaattccagtaaattcaaaatgttccaatgtggctaattattccagaaatgccaataaaaatgaaatgtgatgttccccaccct

SEQ ID NO: 231522 - DNA, 551 bp, Homo sapiens
ggctaatttttttttaaaaaacattgtagagatagagtctccctatgttacctagcctggtcttgaatgccttggctcaagtgatcttcccatctcagcctcccgagatgctgggattacgggtgtgaaccaccatggcaggccatgaatgagttcttgagaaagaagactttatgaagagatgaccaatgggctatagactgaatttcagacaatggtcagatttcagaagtccagaggaaaaagaaaggacagctactgagcactcaggaaaacagacaagtttagagctatgtgtaatggtggatgagtgggaagaacatacagttccattccaccatcaggttagagaccagaatgaataggctcaagatggaaataaagaatagacaagtgaagagatggagacagtaatggagatggtttactgagcagacgaatgcagagggagatagttcactcttgacaagtaacaagcttgttaataatgaactaaaggagaaaagttagaagcatgtagatccgagtatggtcatttttgtcaggattta

SEQ ID NO: 231523 - DNA, 488 bp, Homo sapiens
ctcttgaggaaggagacctccctgtaggtatgtcggctgtggactcttgcctgtcttctctgtgggatccaagagatagtcccatgatcctacgagagagtagatgtgagccagccaaaagaaacatcaaacagaggcccaggaataaattgcaaaatccctaaggatccaaaagatctgcaggattcctcaggcctgcctagatgttgtaggggtgagtctttttcaaacttgttccattgtgatttctagttacagcctgcatgttcccctgggttgctgtctcccaaaaggggatctagcaaaaccatgcagcgtcagaagctaacaagcagtgtgtttcttcaggattcttgcaagtgttggatgtctgcctgtgtgtgtggtattttgtgtgtgtgtgtgtgtgtgtgtgtgtgtgcgcctgtaagtcacttctgcttaaaggaatgtggcaaacacactccagggcttcatcttttttgagt

SEQ ID NO: 231524 - DNA, 429 bp, Homo sapiens
atcatggagcactaagtttaattcatagagtcattcaatgcttatttattaagggctagtaccaggccctgggcatataaagtacaatgaaagaacacagtttctctcattagtatagtaggatcctatatagtaggacagtatcctagatagtaggacagcctactatcctgtcaatttaaaaatcaactaaaagtcatacaaccgaaaagcagactaatctgagaaactgaaagggaaagtaaaacagcaaataaaaaacaacacataatgaatatcacttttcagaactacagctgacccttgaacaacatgagtttgaaataaatgggtccaattatatgtggattttttttaaaaactgtattggaaaattttttgaagatctgtgataacatgaaaaacatgccaaccatgtggcctagaaat

SEQ ID NO: 231525 - DNA, 369 bp, Homo sapiens
gataataacaaaggataaaaacagaaacttggctgggcgcggtggctcacgcctgtaatcccagcactctgggaggccgaggcgggcggatcaagaggtcaggagatcgagatcatcctggctaacatggtgaaaccccaaaccccgtctctactaaaaaaattagccaggcatggtggcgggcgcctatagtcccagctacttgggaggctgaagcaggagaatcgcttgaacccaggaggtggaggttgcaatgaactgagatcgtgccaccatactccagcatgggtgacagagactccatctcaaaaaaacaaaaaacagaaacttggcttattagccagagttgtatgcactgaggtctatggt

SEQ ID NO: 231526 - DNA, 518 bp, Homo sapiens
gcggggaggatcaagtgtaaaaatgattttgtgaccagggaataaattgaatagcctgccagatgtgagtgtttggaaacttcacaggcactgggatataaaaacaaggtaaaaaacatgtgcagtattctcttttactggtaaagttcacaagtttcttataagagtgtaacataacatgtatctcaaagttcctgagacatgtaactcaatatggttcttgtagagcagcagaaagaggaatgtgaagaagcttccagatacataattcatgagtgtccgtagactctaggctgagtagctccatctgccattgtttccaaagggtaacacccttccctgaatgtgctacaagaagtaccagtgtgcttttggtgttcatgtctaatattctcactgcatcatagcatttatttttacagggaagaagaatctattactctgatttacagaaaactgaaatgcctgactgtccaaaatatatttccgccctgcaaccccctaagcttgataggagc

SEQ ID NO: 231527 - DNA, 477 bp, Homo sapiens
taagtattcaaaaatttccagtgacctagttttttaagtttatgtacaattgtcatgatttttagaattctttttcagtcatattttgttttttatgtctaaagttgcaatttactcaataatgccctggcaccctgaaaacattaacgagcatgtttgaaagctggtttgaggtacctatagaatcattcacaaaaatcctcaaaaacctgccttaaaagtcccgtttatttatttctggaatacagcaaaggtgggctttcctggtgtgagcttccttctcatgatcttcacaaataaagaagcaaaaccaaaatagtcaaatggctctgctcagggtcatgaagcaagtgcatcaaaaatggaaatggacattctctttgtctttttgccagtccaatgaccacacagatggcttcttaacatggtgggaagatgatgacctatcccctttattcctccaatatcaggaacata

SEQ ID NO: 231528 - DNA, 383 bp, Homo sapiens
taaaaacccctccttgcaagccatcagagagttcaggtcttatgcatgagttacctgcttctccttgcttggcaccctgcaataaccacttcgctttctctcactgaaaatccccatgtcagtgtttggctctgctgcattgggtgggggaacccaagtttgattcggtaacaatgacagttataatgtattaggtttatgaatttaggaaaaacatatgagaatgcaaacacattgctgaggcttacccaacaccctggaagaaaaactgaggcaagaaaggagtttgaagcttcagtttcatcagcttcaaagtagatccacctttgaacacattccagtgcttttgagagaataagtgctgaatgaatgaatgaatgaat

SEQ ID NO: 231529 - DNA, 426 bp, Homo sapiens
cattgttcagaatctagacttaatcctgaggattttgaaacatgatttgacagcaaaacttgatcttgtctcaaacagcagactcaagcaactaggctgtcaagactgttgtatgcaatcagactttactaatttgcaagggaaatataattgcagagtaaatggtgttaccaagtccactgcctaatgtagtttcttcctgcagataagtaacatgaaaacattataatgagaatgccagttgattgattttcaaagagaaaaatcttcttttacaggcacatgtaatgggaaaaaaatgagtctcagctttttcaaaacatttgtaacattgctgtgtgttcatttggtatctcaattctgcaatggaaaagactatgggcaatcatacttcttatgacattacaggcatctttttctctgatt

SEQ ID NO: 231530 - DNA, 340 bp, Homo sapiens
cctagacccattctagtgaaaaatgtttagttgctgctttcttatatgtaggattaggaggtttaagtatgtgataaaatgtaaggcctcttctggtgttaaaatgctgaagtattttatatgtaggtatgtacatatatccttatatatgtgtgtgtatattatatgtatgcacacacacacacacacatatatacactttttgttgcaacatctattaagcttttggttttgtttgctttatttagaatcatatcatatatgctattcttttttaacctgctctttttcaccttaataatcacagggtattccatcatcttggtgtactaaatcaatt

SEQ ID NO: 231531 - DNA, 326 bp, Homo sapiens
tactcacattcagagtggtaagaagtcgctggactctagtatagtttttatcttaaaaaaaaaaaaagactcaggagtgaggctcttaacgctttactctcatttgaagaccttccgacaaaaaagcagcaactcctcaagccgagtttctggtttcttgagcatcgacgccgcgtccccgcagcgcccacaggtcccgcaagcccccagcccgcctcctgcccaaaacaaaggacgtcacccccagacctctggacacagaagccccacacgcacgcacacgcacccctccctgtcacctccctccgagagcccctcaaacgcct

SEQ ID NO: 231532 - DNA, 365 bp, Homo sapiens
ggggaagggcaggtagatctgaagggggatgaggaagggtgttggcaaagctttcgagaggagctgagaatacagttgagttgggaagaacaaatagtgattatccaaagaaagaatagggaagcgtaaatagggctggagaagcaacttgttctgggtagggaagcaccatgcttcgggagctgcagggtcgtgagtttaacggtggagaatacagctgggatgtggtgagggatcaatctcggtgtgcatggtgcagcccttcgtagatgaccctgatatcagtggacatcacttacccatgtctgctttattttccagtgggttcccagtgctagtgtggtgcctgtcagatggaaggccct

SEQ ID NO: 231533 - DNA, 839 bp, Homo sapiens
  misc_feature (676)..(676): n is a, c, g, or t
cctttcagtagcttccagtttcctttctggttacatcacattgtcgcttctgtaatttgttcccagttaaccaagtcacccacctgttttcacctccttctccttcccaccctcacggccatggttttgaaccagggtttcttcccacggtctgttgaggtcactaacccctgtgtcgtcttctcctgaaccgagtctgttcagattctcagaccagatccctggccatgccaccatggtagaaataggccttggcgtcaaacttatttccagggaaattttgccagtgatttggacttccttcctttccttttgcctcgcctcctctcccatcggtcatttactcacctccgcatttccgctggttccgcgtttctgtctagtggctcaggttgtcgcccttcagggcatgcctttaattgagataatttctctttacttactgtataggagggaggggacccagaaggcgtcttccttcctcactccctcatctgtgcgatgctacacctctgacagatgtgaacttgagggtttttttttgtttttgtttgtttgtttgagatggagtctgtcacctaggctagagtgcaatggcacaatctcagctcactgcatcctccacctcctgggttcaagcgggtgtggtgcgtgagtgcgtgggaggctgaggggngggatggcttgggggcgggagggcagggttgtggggggcgggaagggggcgatggggctcggaggtgggcggcggggcaggagggggtgggggaagagggggggggggggggcggggaagcgggaagaggggcgcggcgggggtgggggtgggtggggggggg

SEQ ID NO: 231534 - DNA, 1172 bp, Homo sapiens
tgatggaccattccagttctagagttcccaaagagacgtctttttggagagcggcagggtaccagaaatccttcactcaggctatagcatggccaccaattataagtaacttgaggcccacccagccaaacatgcctttccgggtctagtgctgggttccagaacaggaagcctggcagattcctactgccacagattctttttactattattattgtcaccttatttttcttttggtggaacccctctagggcttccaccggattctccaccatttacgctatcaattttatcagttttggttttatcgtttcagtgcttctttttgctaacggtagcagccaatatacatcatctctggagacaaatcacgccatagaaaatattgtagttttcctcatttttcttaacgccacagagtcagctgggctgtagtaccagcccggatgtaccagtttactcagccactccccctctcatggacatctgcatggtttccagtcttgcaaattcatacagtgccactacaaataaaaccttgcgcgtatgctgttttcatatttgtgcaagtttactttcagagtagattctagaggtggattgcgggtcaaaggtaaatttgcactccctcccaacaatgcaggacagatcaggttcctgtattgtccttaacagcgtacctcgcttgttaaacttttggatttttgacaatctgatggatcagaagccttagctcagtgaggttttcgtttgcattcttctgattatgaaaaaggctgagcacccacttaaatgtttaggggccccttgcatttttttttcctgtaaactgtccattcatgtcttgtcccattttctactgaataccatccattaaatctccgctttagctgagttgcgcacatttccgacgatcttcgcggtaatttgggctcagcgcggtagttttccaaccctgaccctgcacggggagggggtgccttaactaaggtaacgaaaaggaatctgggtcattccagggaaagcctactaaaatcaggaggctttgtgagagccaaaatactaactttcaaaaaagcgaaaatactcccaaaactcaccggcagcggttttacttaggcgttaattttagctactgtgcccgttttatctactgtagggaccaacgcacg

SEQ ID NO: 231535 - DNA, 647 bp, Homo sapiens
tatgaagtgagggacaaagatctgttcattcagcagagccgtggtatgtgcctgttaaatcgggcactgtgcaagccaatagggtgaagatatacatattaatgagacacagccctaatctttaggagctcaaactttagttgtgggagagacagtcaagtccattaaaatatacacagtgctaagtgtttaacagtagcctttgttaaggctacagagcacaaagggaaagagtaacaaagcgcctgggggaggtgggagagcttagagaggaggtagcgttctgagttggatcttgaaggctgtggtattgaacctccaaagcggggagagaggctctctcagcgcaaagaccaaggtattataaagtgcgtacagtagcagctacttactatggctggatgatgatgataattttatctaatatttatgtaatccgtagaatgtatcagttatgtcttttcctatttaatcttcagaaatagaaacagcccaacaatttaggtaagtatagcccccattatccctcatttccttttggagacagggtcttgccctgttgcccaggctggagctgcagtgagctgtgatcatgccactgcaatctagcctgagtgacagtgcaagactctgtctttccaaaacaa

SEQ ID NO: 231536 - DNA, 509 bp, Homo sapiens
tttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagca

SEQ ID NO: 231537 - DNA, 876 bp, Homo sapiens
gtgtattcacaagagactgactctccatcagtcacctcacctcctacctcctgtcccagtggccatcttggtggtaaccatttttaaaagtgtaggagaaaaatctgttcataaatcttgcttcctatgatcagttcccctatgccatgtggttgcccactcattcttttttgattcaaagaattatccacttcctcatgcctactaaatacacagaagagagtctccaacattcctacatgatttagttacattatgttcagcctgcgttcacactgcagactctgtggtcatctccagactttaaggtctgtatggacaacctttgtgagcaccaccctctctggtttctgcagtggctggctctctatagttcctacacatctgaggaccacactgagcaccattggaaactcctccagccccgcgattggccctcagaggtctccctgtctacacaccagcagcgtctccaacttgcacactcagctgtctccaggactctccttccgagacctggcctctcatcctctggctcttcagaggtctcctggcccattccagctctcattagctccccatgcagctaggacaccatggcaggctgtttcaggaatttactagctaccactctggatttccttactgagaaaattttcttctgtcctctctattgttccctctttgcaagttccagttctgggaactcctttgatcctgggagtgcctgagatatctgcagaaaggcagggatccacactaatggagacacccactgacttgtaatctctgatagcaactggatgccacttcaaatcagcagttgcttcctgaatgttttgtgacccctcttcacatccctatagcagctgatca

SEQ ID NO: 231538 - DNA, 452 bp, Homo sapiens
cactttctattgtgacttctgttgtgtggtacctaggtccaaagcctgggcatcatgtttgatcctctcccgtcagcttctcacatttagtcatttgccatgtgctgtagattcttcctctgagggtttttttttaatccaactcttcctttctcttttcattgctaccatttttatttaggttcttatgacttccgagtggcctcactccaatttgttcttcatatctcagcgagctaattcttcctaaggcacagttcctataatgtcaactgtagtggccctgattacctcattctagaatttatggtctacttcactagagccccaaacctccatctacttaatttcctattaccgcctaatgtgtatactatgtttcagcttacctggtctagctgctgttacctaagcatgctttttcctacctctactcatacttagttaaaaaa

SEQ ID NO: 231539 - DNA, 969 bp, Homo sapiens
acatctttccatcatcgaaaagttattgataagatttttccatcactgaaaagttattgataagtgccaccatgtgcatgagcagccctccaggtgctggcttgtgggccggtgtttgagaatcttgccagttgaatgtgggcatctgttgagggtttcccaaaggctaaccgttcgtgccagagggaggccgtggctcattcctagggccctgggtgagactggggctcatgcacacacaggtatcgatggcatgggctgtaacgagctgagtgcctgctgccctttcctagtggggggggtgggctcctggagaacagaggggaggctgctactctccagggccacagggagcccagaacgccacctcctggtgtcagcagcagcaaatccatataagtctgcagcaacttagcttttgcctcctcagaggaaataattcatccagggggcacaaggcagggtcagagactgaggtaagtttcagagcaagagtgaaagtttattaagtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtgcttactggagttgtgcggtgccctcttgaggcagtcttcccttaccagttcctaggggaaggtcacacgctggttaaactttgccactttgcctcgtagtgtgcatgcttgacctcactcaccaactcctgagattttttttaaattttttaatttaagttctagggtacatgtacacaacgtgcaggtttgttacataggtatgcatgtgccatgttggtttgctgcatccattaactcgtcatttacattaggtatttctcctaatgctatccttcccaccccacgacag

SEQ ID NO: 231540 - DNA, 1023 bp, Homo sapiens
acatctttccatcatcgaaaagttattgataagatttttccatcactgaaaagttattgataagtgccaccatgtgcatgagcagccctccaggtgctggcttgtgggccggtgtttgagaatcttgccagttgaatgtgggcatctgttgagggtttcccaaaggctaaccgttcgtgccagagggaggccgtggctcattcctagggccctgggtgagactggggctcatgcacacacaggtatcgatggcatgggctgtaacgagctgagtgcctgctgccctttcctagtggggggggtgggctcctggagaacagaggggaggctgctactctccagggccacagggagcccagaacgccacctcctggtgtcagcagcagcaaatccatataagtctgcagcaacttagcttttgcctcctcagaggaaataattcatccagggggcacaaggcagggtcagagactgaggtaagtttcagagcaagagtgaaagtttattaaaaaagtgttagagcaggaacgaaaggaaataaagtacacttggaggagggccaggtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtgcttactggagttgtgcggtgccctcttgaggcagtcttcccttaccagttcctaggggaaggtcacacgctggttaaactttgccactttgcctcgtagtgtgcatgcttgacctcactcaccaactcctgagattttttttaaattttttaatttaagttctagggtacatgtacacaacgtgcaggtttgttacataggtatgcatgtgccatgttggtttgctgcatccattaactcgtcatttacattaggtatttctcctaatgctatccttcccaccccacgacag

SEQ ID NO: 231541 - DNA, 477 bp, Homo sapiens
  misc_feature (341)..(341): n is a, c, g, or t
  misc_feature (347)..(347): n is a, c, g, or t
  misc_feature (350)..(350): n is a, c, g, or t
  misc_feature (386)..(386): n is a, c, g, or t
  misc_feature (399)..(399): n is a, c, g, or t
  misc_feature (417)..(417): n is a, c, g, or t
  misc_feature (447)..(447): n is a, c, g, or t
  misc_feature (469)..(469): n is a, c, g, or t
gacaggcctaagactgggtggacattgaagaactgtgtggatggcaaggtcgaaatgggatatcctatagaaataggtttctcagtgtgagtggagttcagttttgggtgtaatgaaggcggagattacttgagagacatccaagtgaatgaagaagtcttttttctttttctttttctttttctttttctttttctttttcaagacagtgtctcactctgttgcccatgctgttagcagtattaggagaaagaatacctccaaattgcctgtgggtagcaaagtgagccaaattccaatagcattctagtcccctgcccagcactgcaaaactgcatacngaatcnganaaagaagcttaaaatgctttgtccaaaaatttgaangtagttagcaacntccgccaaaatagaaganttagttcctctaaggagcctcctggcttcncagaactcctaagcaccagcancctaagcc

SEQ ID NO: 231542 - DNA, 567 bp, Homo sapiens
acatcttatttgagatgtttaacaatgtctggatcatcttttcttatatattacccaggaaacactgtgaagtaagcaaagttggaatgcccaagtcaaagaccatttgaatatttacaagtagatttcagacaggaatactacagggtggtcacaggataacaaattctaggcagcagatttacatgacttgaggctgtgggctgttaagatgctgaaaaaccagggtgtggaccaagctggctaagactgagtggacccaatgtggtgctggatttgacggaggttttacctaggccctcattatatgctcattgacatactaaatcacacacccgccagtgccgtgacagttctgagaccaatatttgatgtaaaaatggatggcaccacagttccgagaaatctccacctttacccaggaatttttatgaacattccactccttggttaaagaaacccatcaagatgaaaccccagaacccattgttctctcttgggtatgcctgaactcccctttcttgagtgtgtactttttgctttgcaataaatctcttctttcactat

SEQ ID NO: 231543 - DNA, 409 bp, Homo sapiens
gccgagacaggagaatcgcttgaatccgggaggcagaggttgcagtgagccgagattgcatcattgcactccagcctggataacaagagtgagactcagtctcaacaaaaaaacaacaaaaaaagaaagtacccaacctagggcccggtacatagtaggtgttcattaaatagccttgattgccagggatatcatcaacaccgtcatcatgactgagtcccttccagcagctggccctgagccgagggctttacagatatctgtcaccattagcacatggtgctgtcgtcccattctgcggaaagcaaggctcaggctaggggaataagagtccagggtcacacagcctttgaggtaggtggccttgctgtatttcaggttcctagaggaagagccctaggaacagcac

SEQ ID NO: 231544 - DNA, 391 bp, Homo sapiens
atgagttttgagtctgtgtttttggtggtttggagcaagacccatcagtttttatttaataaaacttttttaagatataaataggaaaggatgcgttctagaagctgttaacaagagtaaggtgattcactacaaaatgtaacaacaaggaaggaacttattctgaaattgttcagtataagacacagctttggtggtggtggtggtggtggtggtttttaatcatgttttatgtttcactctgccaaccaccacaattaactgaggagaggaatccagttaaattcaggaaatatttttgagcacctaatgtgtatcactattgtgctttgacttacggatacacaacagtgactaagacccagtccttgctcatgttgtggttgggaca

SEQ ID NO: 231545 - DNA, 463 bp, Homo sapiens
taataatcctcacatgatttggctttttcactttgttgatatttagattgatggtacaaaagctattggtggtgccttagttacaccaaactgtactagaagtcattttatgcttcacccttacatactcataattttttaaaaaattccagatgcaattaaaaatactcttggtgaagcagtaaaaattaaatatagacccttgaatatatgccttttaagttgggtgatgaaatgtgaagtttatataaagcactttactgcatgccaaattatcaggcttttcctgaagaaaaatatttgtgtaattgtttgagttgcaaactgaactggttgctttttcatcgaacatcatttttacttgaaaaagaaaaagacttatggaaaaactgtggttattctgacctgagtatttggcagaaaaaaaattcttgaaaatgaataaaatgagcctgtcacttca

SEQ ID NO: 231546 - DNA, 270 bp, Homo sapiens
aaatgcctttgaagttttggtatttatgggtaagccagaaatgactttagccactggagggaaagtctgttaatttatcaattttttaaaaatacacacatgttctgccttgtaatttaagagaggattttagttggtttgcagatatatattccatacagcagaaagagaatatgaaatagatacctcagagtttatgaaagcagattttacttatccagatacttcaaggaaagcctaaaaaattggggcatgacttatgacagagat

SEQ ID NO: 231547 - DNA, 460 bp, Homo sapiens
agcgctggctacagtgctgacagaaaccttgtctttcaagccagacaaactggaaaaaggcaggagagggtaggaaagtcatggagagaagaaaagttctctatgaaccaatacaagactcatccctgtgcaaagcatatgacagacccaaaccagaaaagtaaaagctttgagaatcgaactcaaatctcagactagcccctgagtggcatatacacaggacaaacccaaaaaaaaagcaaggcaaagcttttgaaaactgaactgatattgaaaccactacatatagaaagcaggccaaaacttgtggtctgaccctaataaaggttgattgcctgctaaacaaacaaaataaatcagccttctccaagaaatataacacagctcagagtctaccaacataactttcacaaaatcaggaatacaatccagaaattacttggcatacaaaaaaaaaaaa

SEQ ID NO: 231548 - DNA, 403 bp, Homo sapiens
ctaagacatagatctcttaggggttgtttggctgcaaaaaccagaaatctagatgactagctaaagctaaacaagaaaatttactgtaaggatacatggatttctttatgagaaaatgcaaaaggaagtggaaacttaccaggaatgaaagagaatgctgtttataattggagaaatgtggacatgagaggggcacagaggaagactacctgaagacacacagagagaaggtgaccacgtggttggagtggagcatctacaaaccaacacacataccaaggattgctggcaagtatcaccagaagctagaagaggcaagaaaggattctccccaaagctgtcagcaaaaacacagcactgatggtaccttgatttcagacttttagccccgaaactgtgagag

SEQ ID NO: 231549 - DNA, 147 bp, Homo sapiens
tttttttttaagtaaaatgcactggtcttaaatgtagagtttgaatttgacaaatgtatacacccaggtaaccaacatccctgacaagatacagagcattgccatcaccctagaaaatgcccttctgtcgtcttctccaggctgcct

SEQ ID NO: 231550 - DNA, 398 bp, Homo sapiens
ctaacagatattcttctacattaaaacatgaagcaaatagaaagatggttcccccattcagtaagattattatctgaggcccaaagagaagagcccaataattattcatgtattaaaatattaagaagccttaaagtcatatacacctttaggacattgaagcttataatctatatttaatatcatagtaatgcctcaaagtactctcttaggcattatactacatgctgttgtttaaaataccacactgtatctccaggattcagaaagaagagaggacaagccactttcacacttattccaaactgctcacaaaataattgctttctttaaatagctaacttttaccttctcataaaaatggtatacactgtcactaacagaaaaatatgactttc

SEQ ID NO: 231551 - DNA, 135 bp, Homo sapiens
acacagtaaggtacttaatgtttgcttactaacattatactgatactgataataaaaggttatttatactaagacttgtgttagtaaaggccgtgtagttgaaggcgggtgtagtttcagtattttactagaatt

SEQ ID NO: 231552 - DNA, 662 bp, Homo sapiens
ctgaaaatttgatcactggccagagtaacgctgaggagccatcctgtcttctgcttgagtgtcttcactctggggattctggcaggctggtttcctggccagatgcttctcatccacacctgtggacctcaggaaaccaaaggtgacctctgttggcatggccttgacttcctttccaccaatgcccatgagatgtggaaattgagcgaacatccacaccagaaccatacactcaaacaagcaggttggggcagggaaactccatcacatcatggtgaggcagagatgctgcagccacccagatcattgtgtagtagaggtggcaccattttactatgtgtcctccctgcactcagtgaagtctgtgaagggaggggtcagtgcagcaaggagctcgctctgccccagaggagagagtggaatgttcgaggacacatgaaagcagttactctgcctaccttttaaaactctttcctcctggggaactggtttattctgtactcctaaacagactatatccatgtattcactccttctataaatatttgagaaaaacctactatatgccaagcacttttctaggcaaaggaaatgcaatagccctttcttcccatagcttccagcctggtggggaataaaggaattaaataagcaattacaaa

SEQ ID NO: 231553 - DNA, 416 bp, Homo sapiens
agcggcggggcgaagggctcctcaagcgcggccagagtggacgccgaggccgaggaggcacggagagcgagcaagggctgcctgcacgctgtcacctctcattaaggttttggtatgaagatgatgctggtctcatagatgatgatgctggtctcatagaatgagatggagaggagtccctattcttcaattttttggaatagtttcagtaggatttgtaccagctattctttcaatatctactagaattcggctgtgaatccatctagtccttggcatttttgtttgactccccgtggaacagagttgttgttcagcagaaataatcaagagttgacatcataccagacctcgggactcaacaatccagaccagtatggctctatcttcatgaagaacatacacaatttcaggct

SEQ ID NO: 231554 - DNA, 1189 bp, Homo sapiens
gatgtttctcaaggtccatccaggatagaatgtctcataggtggccacatctcccagataattttgggatcctaatgacctgctcttaccacaggggtgaactagaaataaacgcactccagtttccttcaggggctgggggattataaggaaaagagtctgtcttaaaatttgtcattgattaaaatggggaaaaataaatctcccatgaaagtttatgacttagcttttgcataggttttcacctgaattcatactattttgatggtaaaaaaaaaagaaagaaaaaaagttgagattttgattaagtgttctataatggtggtaatccccaaccacctaacagaatcaaatctaaatatcttctgaaggaacttgccttaaagaattttccacaagtaaaaccttaagcaaaatgagctcacagcaaaaatatcactcatgaaaacaaccatgaagagaatcagacaaaaaatacttcacattggaattatctgacacaaatataaatgtttcagttatttcatgtaatgagaggcctgaacatgactaagaagtaaacatttgataaagaaccaaataaagatattagtatgtttgtgtatctcctcttaacaaaacaagctgtttaaccagtaaagatgagtaatgcatttgcatatagaacaaacagcttgatatggagtgttattttttcagagtaagaattttttttcctttctgagtaacaatttgaggatctctgcatttagaaagtagtaggatttttaaattctttttcattagaagaatggtaatatattggttagcctcttggtttttctcttttattaataatttcagtcttgaaaaacaaaaataacagttaaccttttattagtaatgaaagccactttaaaactgtgttacagcctggtgcggtggctcgcgcctgtaatcccagcactttgggaggccgaggcgggcagatcacaaggtcaagagttcgagaccagcctggccaatatggtgaaaccctgtctctactaaaaatacaaaaattagctgggtgtggtggcaggcgcctgtagtcccagctgcttgggaggctgaggcagaagaatcgcttgaactcgggaggcggaggttgcagtgagccaagatcatgccactgcactccagcctgggcgatagagcgagactgtctcca

SEQ ID NO: 231555 - DNA, 420 bp, Homo sapiens
gaacattaggtctcaggcatgatttggggagagaattgggcagtcagaaaccttgtcatctgaaaaaggtcaaggtctggtagcaataaaaatgcctaagcaaataaaaactcagtagaaaaattacttccctgggcaaggatttgggctgctgtaggacaaatgaggctgtgttgggagagggtctgtttattcctgctaagagcagtaacagtgaaatgcagatgtggaggagatctcccaatgctggctcctcctggggctgagatctgaatctttcagaaaacagcggaggaaccagatgctgtggaaagcctgccacgccgcacccggatctcaccacggatatttaagaaccactggcttcatgacgtttatgtctggtcaatttttccaggggtcgggggcagtttttattga

SEQ ID NO: 231556 - DNA, 570 bp, Homo sapiens
tttttttcactcaaaactttttttttttaatctgtgccatgtacatgtattatacagtatattcacaaaaagaggggggaaattccatttttaacaattaaatacataattattaagttttaaaaattctcctttgtgtaccactccaaaatcctctcctgcacatactatttttttggaaacacctagtcgtctcatcgttatcacaccggttgtaactatgtacctacgtgtctaccttccccatcagactcgggaacaaggagtcgggtttgagtcccactgtcccaagcacagaacgctggactcccagtagaccatatgttgcaaataaagaccttcgtccctttcaactcaggccgtccacgagcccaggagttccaacaaaatgatgtacagcaaccttttccaggcctttatgttgcctcaatatttctcacctgcaaaatgggaatgatccgtacctgcctcgctgtgctgtcggaaggagtcagacgatgggtgtgaaagtattgtaacactatagaaattaattcactcatccatttaacaggcaattattaagtgcta

SEQ ID NO: 231557 - DNA, 349 bp, Homo sapiens
ttaaagatcctagtctacatagcattcctttgggtgtatcttttcagtgtcaaagcaatttcagcaaatacagaattacagaatattgaacaataataaatgctttgtaggctgcttatggaacacttattttgtgctaggtaccttttattagttaacttatttctgtgagggaagcataatttcagctactttactaaaatggaaactgagactcagctagatgaaaatatttgcccaaagtcatatagccagtaaaaggtagagctagtatctgacagacttgatttttataaagctcatgtactttctgctattgctatgtggtttcatttaaagtttttttcaa

SEQ ID NO: 231558 - DNA, 425 bp, Homo sapiens
gattgtcatttggctggctaatgtcacctcagaaggacaaagggttcagcttttggcactgccaggggaaaatcagctctaaagtgttccctgagaccctttttctttcaaaaggccaatagtaaagcactctttaagatgagaaaagttggccgggcaccgtggcttacgcctgtcatcccagcactttgggtggctgaggcgggaggattgcttgagcccaggagttcaaaaccaacctgagcaacacagcgagattccatctctacagaaaatttaaaaattagccaggcatagtggcatatgcctgtggtcccaaatacttgagaggctgaggcaggaggatcccttgagcccaagaggttgaggctgcagtgagccatgcccacaccactgcattccagcctgggcgagaccctgtccca

SEQ ID NO: 231559 - DNA, 539 bp, Homo sapiens
acagatgtacttaaatccttagatagtgttaatgtactacttaaaaaacacacaaaacattatcatttgtaaaatatgctttatcatctattcatgtttgtgaatcaggtttttcttgatatcatgcaatcaaaacaaatttaacataagactgcccaatcatccataatttaaagtttgtgttcatcagaataattttattgttctccttatacatgttgtacatttgagtttgtttgttttttttttaagatagagtctccctctgtcgcccaggctagaatgcagtggtgcaatctcagctcactgcaacctccatctcccagcttcaagaccagcctggcaacatggtgaaccaccatctctactaaaaatacaaaaattagccgggcgtggtggtgggtgcctgtagtctcaattacctgggaagctgaggcatgagagtcacttgaacctgggaggcagaggttgcagtaagctgagatcacgccactgcactccagcctgggcaacagagcaaaattacatccaaaaaaaaa

SEQ ID NO: 231560 - DNA, 461 bp, Homo sapiens
catatgtgtgcatgtgtctttatagtagaatgatttagaatcctttgggtatatacccagtaatgagattgctgggtcaaatggtatttctggttctagatccttgaggaattgccacactgtcttctccaattgtatagattcaatgctatccccatcaagctaccatggactttcttcaccgaattagttgtatattttatatcaaatatacttcataaccatatgatggtttctgaatgaaattttgaagcccaacctaaagcttttcaaaaggaatggataagagagcaggatacattgactacactgctaaaattctagtcctatagaattgattaatctgaaacccaatcgcttgcgtggtttacctttgattaaaaaccttaattatctactgtgttctaggtgtcaggctagctgttgaagatatgttaatgagtaccttgttcttaaattac

SEQ ID NO: 231561 - DNA, 473 bp, Homo sapiens
cacaatatttcttttttaaatttcttaattttttaaaaatagagacagggtcttgccctgttgcacaggctagagtacagtggcgtgatcatagctcactgcagccttagacgcctaggctcaagctatccttccacctcagcctcacgagtagctggttctacaggcttatagtttttgtaaagacagggtcttgctgtgttgcccaagctggtcttgaactcctggctcaaatgatccacacacctcggtttcccaaagtgctgggattacaggcatgagccatggtgcctggccccctggtacttttctttaccaaaatacttataaaaggttagtatgctcttttgcttttcttctgctttgcaaataactagggctttttttttgtcttcttgaaattctcttatcaaattaaacttttattgcctgtttttaaagatcttgctactgtgagaccctgtctcaaaaaa

SEQ ID NO: 231562 - DNA, 358 bp, Homo sapiens
gatcacttgagttcaggatgtagaggctgcagtgaaccaagattgcaccactgcactccagcctgggtgacagagaccctgtgtcaaaaacagaaagagagattacagaattgaaatgttaagtttgatctttctggatgtttctaaataggtaaaatcaatgagtgtcttatttatggtttttctcctgaaggattgacctattcatggaaatccaaacggatctcccaaaggagagattaaataccaagttcaattaagtaatagagagttgactgttagtgcccacatgcccagagattaggacgttgtttattttttcctacagttctaaagagattgttacatgttttttttt

SEQ ID NO: 231563 - DNA, 223 bp, Homo sapiens
ggccgagctggagctggaagaggacgaggaggagggggaggaagcggagctggacggagacctgctggaggaggaggagctggaggaagcagaggaggaggaccggtcgtcgctgctgctgctgtcgccgcccgcggccaccgcctctcagacccagcagatcccgggcgggtccctggggtctgtgctgctgccagccgccaggttcgatgcccgggaggcg

SEQ ID NO: 231564 - DNA, 434 bp, Homo sapiens
ccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaa

SEQ ID NO: 231565 - DNA, 490 bp, Homo sapiens
tttggggtaagaaaataagagttcatttgggggtatgtaaagcttgaaatgtttattcaagtggagatgtcaggttgccagttgaacaaagtagtctggaattctagggcgataacaggtcctaaggcatacattttggagctatcagcatggaagtgaataagaaacctagaaagtgagtatggagaagagagagggagatctgagcaaggagcctgggattactgcagcattcaggggttcagggtgaaggggaccagcaagagatagagaagaaaacaatgaggcagtaggaagagaagaaagtgtatatggtgtcctgggtgctaagagaagaaagcaatcaaggaggagggcgtgattggcttggacagatgctgctgagagtggagttagataggcactagcaatgcacgttgagtttggaggtgtgaaggtggttagtggctctgagagtgatggggataaaactctaactgcagatggttca

SEQ ID NO: 231566 - DNA, 475 bp, Homo sapiens
tcaagtgagaaacacaacaaggaacacacccatgatgctagtgaattagaagatgagtcggccacctggccacgtggggctcccatgccaccaaaccaaccagccaagaaagctttactctactacctggagtgatttattccaattaccatggagaacttggcttgccgctgcacaatagaagcaagaagggctatgtgtacaacccagaggagttctctggcacacctcttagcactcccatgccccaaagtaatggttaatggaaaattacagcaaccaaacaaggcagaataaaggaggactcaggcctttcagaaattaaggtttgggccacactacccaagtaaagaaccccaaccacctgcaattcgaactgacaatggaaatatggaataactcgtggaagaaggaagctgtggatatctactatggctttgcgaccaattacagaatcaagaaccacaatagcttt

SEQ ID NO: 231567 - DNA, 644 bp, Homo sapiens
gatgcagtacacgtgtacatccagatggcacactccttttcaggatccataaatgtcacttaagtagagagatagacatggttccataatctgttcctagctgagaaaacctgaggatctttccaaagtagtaccccatttttacactagaaaactaaatttaacagggagggtaactaaattagaaaatttgttcaaagtaatgctttttagtaaaaggtcactaaataaagaactatccttagattaattgacttatatttgctttatgcatctggcaccaaaaacctcttttaaatactttacaaatacaaataaagtttaaaaaaacaacattattattcaaatgagctattcagtacttataactatcctaaaaagttatcaaattaacttattgccaatcccagaaattttatgacttggacgtcaacaaaacagcaggtgcaactgagaaatggtggaattggtggaactgtatagaaaaaagccagtgttctggtggacgacaagacttttgatctattggtattaatcaatttatggaactaagaatagcctccaaagcattctgccttctttcttgctactgcatttagctggaaattttataatatagattttgctctctaacagggacagat

SEQ ID NO: 231568 - DNA, 175 bp, Homo sapiens
acgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcact

SEQ ID NO: 231569 - DNA, 481 bp, Homo sapiens
tgagggcacaggggcaggggagttcagagtagttgcccagggtacctttcccaaaagcaactcggctgctgactaggggtctaccggctcgctcgggctcttagacacgagcgcagaaacattttctcggactcaggagcgagggcgggtgggcctggtgttccaggctccgcaggcctgagcctggcgggaaagctcaaggagcagaactggaaggcacggtcccagacatgcgtcccgcccccgcccgtgctagctcggtgtagcttgcctgtggagggtctgagaggggaaaaggcaccgggaaaggctggcgggggccgcggaggagcaaagaggatgggactggagagcgcggtgcggccggcgcggttacctttgccattgttttccttaagctgagcggcgccgaggcccccgggggagcgaagcgcggagcagcccacctccacgtcgctgctcatgtcggcctcagcggccg

SEQ ID NO: 231570 - DNA, 89 bp, Homo sapiens
ctaataaatggaagagctgggattcaaatccatttgtgactttagggcctctgctcttaaccactgaattatattaatattcatagaaa

SEQ ID NO: 231571 - DNA, 386 bp, Homo sapiens
aaacctctcaggctgtccctaggtgtgctcacctctccagggtgccctggaagtatttatggagcccctctcactgctccttcactttctgagcgggagctgcacaagatctcccctcagcttctcttgctacttgagcccagctaaagggacagagctggcaatgtgggagctgcttcccagacagagaggtgggaaggaatccaccggctgtgtgctctgagggagggggtggggagcaggagaccagagcacgaggggtatggatgcaggcattcagctcatcgtaaagtctaggcctgcgtcgtgctctcctctttcctaaatttgatatgctcccccacccctaaaataatctatactcatcatggaaattccagaaatca

SEQ ID NO: 231572 - DNA, 553 bp, Homo sapiens
tcagtgccagatgacattcttaggaatttcggggcaagactctccaagcagtgccttgaatgagaactgagagaaagaggtagaaatctccacctgggtgctttagatgaaaagactccagggcagtacagcttcagaatcatcagctgcacacgtattaatgtgcagaaaagcagagtctcttctaaaacagccacacccaaggatttgagaagcagaacgccatattggaaatgcctgcctacacaagcaattaaattggatttatgtcacattgcaagtctgcccccaagaactgttctcccaatgcaattctgctaaatcagatgacattcaaaggtattttcttgccacccataaggctcctgaatgagtcatctgtaaaaggagttagttaacctctatatacctcggtttcctcatttatataatgggaataataatagaatctacttcgtaagattcttataaggacacaatggattaacaaatgaaaattactatatgcatccagcatatagtaagcagtctgtaaattcttgttctttttttt

SEQ ID NO: 231573 - DNA, 512 bp, Homo sapiens
ggtgggccaatcgctgctcggtattccaggcgctttctcaggtttctgctgatcttgcagcgcccagaaatggaccgagcggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtc

SEQ ID NO: 231574 - DNA, 346 bp, Homo sapiens
cctccacacctggctttcagggttttccaggtgggtccggagcggcctgtgcttaagggctcaggtccacccgagactctgcctggcgtgcgtatctgggcatctgcacctggctgccgggcacaggccgtgccaggcctgtacgagctctggggttgttctcccttctttccagggttcctccctggccctgggtggttccagcaaaacagtcgccagggcacatgagtctagttccagaaagaccttgcccctgcctctgagagatggaaaggatacaaacgcattctcttaccaaaaagaattaaattagaagtaaataaaaaagatatatggaaaagtctca

SEQ ID NO: 231575 - DNA, 271 bp, Homo sapiens
aaaaagaagaagaatggggccaaggaggatttaagactaccattataggttacaagttgaattctttttaatattcttcaagcaatgacagtaaagattcaaataacttttaaattacctttgatttctaaaccaagtttcttggaatgtgaaagtcgccaagactgggccctgcagggcctgggttgggctactactgcctatggagattctgagggtattaaccttaataatggcatgaaatcaataaaaatcatccaaaagctttttt

SEQ ID NO: 231576 - DNA, 738 bp, Homo sapiens
tagattaaagtgtaatcacctcccagcccaggcaataactaacaatgttccactgatttactttattaaatactgaatagaaacaatatatttataaaatatttattttatatatataataagcacataatgaacacctgtgtctccagtcttggtttaagaaattaagccaaaagtaatcataagtgcttatgattacttttgaagtcacctgtacaacttttgctgactacatccccttcttcaacactctaacgatggccactgtgagcactgtgtatattgaattgtgttgtattttaataccgtgtgcactactttgttttcctagctgtatgctattgcatttagtgagcataatgaattatatcagtataattcacttttgtcatttcattgtttcagctcttctgtactaattattgccaatatatttctactggcataaaaacagacacataggacagtggaacagaatagagatcgcagacaaatctacacatttacaaacaattcatctctgacaaaggcatcaagaacatacactgggaaaacaacagtcttttcaataaatgatcctgggaaaactgaataaccatatgcagaaggataaaattaaacccatctcaccatacacaaaaatcaaatcaaataaaaatggattaaagacttgaatctgagacctgaaactatgaagctagtaaaaaaaaaaaaaaaataggaaaggggtcgggcgcg

SEQ ID NO: 231577 - DNA, 356 bp, Homo sapiens
ttaggggtttgattttaagggacctgactgggacattcaaagtaaatagtctcagttaatatgtaataatgtaaggctgtggtaaacatagttcctatctctactgcccccaatctaaaaaggtataccatccacagtcatttcttggcagtcaggtgatatctgtagagtactaggttatgtatccttaggagaaacatctaccaaaaatggacaaaactcttctgcccacatgttcatgaactctaattttcatacactatatctcactccatatggaactcaaatgagggccatgcagaaactgccgccaatatgattaatgagtgaactctacactgcctgtcaatttcttt

SEQ ID NO: 231578 - DNA, 409 bp, Homo sapiens
cagccagaaaacatacaatatttattaagttcactgtcttatcctggcatggttcatggtgtaccaaaacaattacaatagttaacatcaaagatcactaatcacagatcaccataaaatacaaaatagtagctgggcatggtggttcatgtctgtaatcacagcactttggaaggccgagataggagaactgcttgagtccaggaattcaagaccagcccagacagcagagaccccatctctataaaaaatacaaaaattagctggatatggtggcatgcaactgtagttccagctactcaggaggctgaagtgggaggttcacttgagtctgggaggttacggttgcagtgggccatgattgtgccacagaactccagcctgtgcaacagagtgagactctgtctca

SEQ ID NO: 231579 - DNA, 272 bp, Homo sapiens
tactgtccaggcaaactcctactcagggtccaaggctttcattccacggcctctcctcaagacaacttgctcaaccccccaggaagagtctcagtgctcccattgtgaccttgaccttggtgctttctgggcactgtgatcacccacaacccttgcacagctgtggccaccctgttgtgtaatggcttctgtgcctggggaagtctctctgacctccagacccacatggataattgcatgaggatataaaacagggcaggggcccagccaca

SEQ ID NO: 231580 - DNA, 303 bp, Homo sapiens
ctactaagactaaaccggaaagactaaaacccgaacagaccaataacaagtcttttattctacctaactagaatttctctgctccctaatccactgagaaagcaatgttttctcccagcttttcttcagttcttctgtccctaaaacaagggttcttttcagagctctcttaaggttttctaaagactttcactgttagtaacaaggagaaaaaaggcaagagatcaaagccataataaaaagtctcccagtaaagaaaagcctgggacccaatggcttcactgcagaattctaccaaacatt

SEQ ID NO: 231581 - DNA, 772 bp, Homo sapiens
caaataatggtcaccaagtctcggaataggttttgtgagccccttgaggcattcatccagcactgtttcagagaaatctctatttcaatctattcctatactttagttattgaaaaacaacagacaacggcaaaagcaaattgacctttttgtgttcctttgtgcatggatgagtggctgactctggagcccaggctgttgcttctcggtctggtgatgaatcctgcatagtctatcctcatatatatatatatacatttttttccttctccccttcccactgcaatttgcttattgtatcaatttgcttattctatcatttgcttattatatctgaattgccatttatgtgggatcgagtttgttgacctttaaaggtattgtgtgtgtgtgttttcttcttccctggagcatctcctgcacataacacctctcttgctgtcatagccagaaattcagtttttaagtttttttctggggtcttcttgctcaagaggaagtatgttcagttgatacggggcttagaattttatttatagcttttattacattctaaaacccccagcagaaacaagtcttaacaaacacagattttaatttctgaacattcttctaataagttttgcacaggtagcggaacaactaaaaaaactgttttttgcattgatggtctacctcattacaatttaacctctaaagggtgttttagccagctctagagtctgctacggttaaggtgaatttactgcttcttcccataataaagaatggt

SEQ ID NO: 231582 - DNA, 428 bp, Homo sapiens
agtttgaaaccagcatggccaacagatgtcagccacttttcccagcctgttttttgattcttattttctatttttcttttttgagatagtactttttaaagagatagtacttttttgatatagtactttataaaagggagatcaggccaggcacggaggctcatgtaagtaatcccagcactttgggaggccgagacgggcccatgacaaggtcaggagatcgagaccgtcctggctaacacggtgaaaccccatctctactaaaaatataaaatattagccaggcgtggtggcaggtgcctgtagtcctagctgcttgggaggctgaggcaggagaatggtgtgaatcctggagacggagcttgcagggagccaacatcgtgccactgcactccggcctgggcgacagtgagaatctgtctcaaaaa

SEQ ID NO: 231583 - DNA, 418 bp, Homo sapiens
ttagtaattgtcattgaaagcaatagggaattgtagattgctcagaaatgaggggattactggctaaccatttggaaagtaaaattaaaatacctaataggtttgatacactaaagtaaattctaatagaatcaagaatttaataagaaaaagtataatgatactaaaataaaatttaagaggctatttttatatttatatccttgttgtagaggaggattctaagcatacttcccaaagccaaaaatgatagaaaggataacattgaaatatactactcctttaaagaacttgtggctgggcatgggtggcttatgcctgtaatcccagcactttgagaggccaaggcaggtggatcgcctgagctcaggagtttaagaccaacctgggaaatgtggcaaaaccccatctcttaaaa

SEQ ID NO: 231584 - DNA, 644 bp, Homo sapiens
gatacatgtcattgtacatttgtcacaacccatatgatagataccaccaagagtgtaccctaatgtaaactgtagattctgggtggtaatgacttgccaatgtagattcaacagctgcaacagatgtaccattctggtgagggatgttgatagtaggagaggatgtgcaaatgtggggtcaaggaatatatgggaatgctctgtatactctgttcaattttcctgtgaacctaaaactgctctaaaagataaagtctattaaaaatgcaaggaatagtacaattctcaacttcattgaaaactttgttaatgaggtagaagttaggactagaaaaaacatagcagaatagcggtgttccactcaagaactcacaggccaaccctggcactatcctctggtattgaaaccctgacatacctgggtgggagtgatactcatagcccatctcaaattgtttatttctgtcgtggtgctagatttatgttaagaaatctacaaattttgttttggctccttcactggtacattatacaaattatgcaatggaactatttatgcccatggagaggttgacatggagtgtatgtgtatacaaaaaggggggaagtggagagagagagagagagattttgcagagattaag

SEQ ID NO: 231585 - DNA, 380 bp, Homo sapiens
agcaccatagggattaccttgtcagaggaaatgtagtagtggaagtgttttggtaaatgggctgtttcctctggaaaatactcatatagtcattgctattgtggttgcttctgtgattttactgtttcttctctatgcctcatgtctatggaaacttcttcttagatataataatttttctggttatcttgctctggtctaagagccaccatctgtttactatgtattgttttgtataaataaaccctcagaaaagcacagtattttgtttaattccaagttcttgccatgggaacagcttacttgtgaactgtgcctacttatgtcttccaccccaaccctcttttcttcctggggaaataccttgggatactgttaaa

SEQ ID NO: 231586 - DNA, 288 bp, Homo sapiens
aaccccccaggagacaaagagggtgtacacacaagtaacgatgtcatgttaaaaatgtataagagcattgtgacctgaccaaggacaaagaactttaccctcgctgccacccagatgtccatagtcattgctcaccctttgatctcaacccccccgcctgcttcccccttcccttaacataaaagaaacccaaaaattcatattagcttaggaggttctttaggacactagttgccatcttctcggttcgctgggtctccgaaataaagttgctttccttgccccaac

SEQ ID NO: 231587 - DNA, 461 bp, Homo sapiens
tctctactaaaaatacaaaaaattagccaggcttggtggcgggcacctgtagtcccagctactcgggaggctgaggcaggagaatggcgtgaacctgggaggcggagcttgcagtgagccgagatcgcaccacttcactccagcctgggtgacagagcgagactgtgtctcaaaaaaaaaaaaaaaattgtctcactaaaacaaaagagcctcctatcacccttgatatgaaattccagaattttctgtgataccacatggccattgcttgttttgctatatgttaatgtctttcataataacttctgagctctgtatatattggggtattagctccttgtcatatgttaaaaatatttttactctagttgtccattaactttatttttcatgacccttgctgtacaaaagcagattgttttcatctttaagtgaataaaactattactggtttattgtaa

SEQ ID NO: 231588 - DNA, 316 bp, Homo sapiens
atgggagcacagtactgagaaatgggagcacagtactgggaaatgggagcccagtactgagaaatgggagcacacagtactgtgaaatgggagcacagtactgggaaatgggagcatagtactgagaaaccccagacctggattctgagtttttcagtctagcccagacttcttatcttagtagacaaaaagagtcaataccagagaaccagaggcatcctctgtattttaatgaactctgcgttttagtctgtttagtagtcatattttaaaagataatcagttttctaaatatatctataagttactacatgca

SEQ ID NO: 231589 - DNA, 490 bp, Homo sapiens
gagcccatgcagaagaaggagttctgtgcgaacaaatcagaaacgggcaaggacacaccccggcagtctctactggttaggaacattcatgggaagtatgtttctagttcccccacaaagctccccagggccccagcatgtcctggggatgccacagctcctgggcagagcctgcagggagtgggcagctgagttggcccaagcaccaatgcatgaatcatcctagaggcatcccaggagcccacagccaggagccaaaatcggggggctgcagctgggacccctctcccgtgaactgcccctgccaggcctttttggcctcactttatctgcctgtccagtgggcacaaccaccttgctgggacaggcgtgtctgccccaccagcaggtccatcctaacagcctctgactcctgtcaactcaccacaaacgggtttcctccacctcagtgactctgtgatttggaaaccaaataaatgtgaaaccgtct

SEQ ID NO: 231590 - DNA, 382 bp, Homo sapiens
tgaactaatgcatgttaatagagaacatgccttaattagggccctatctacacttctgatgggctataatcatttgtggaatcctttgactgagcctccccagagaattactgtcataactgcttgtcagagagagaggaagtccttgaatttaatgtgactatgggaattatagtctttcattttctgggagacccaggcttgaaaggccaccacttggctgggcgcggtggttcacgcctgtaatcccagcgttttgggaggccgaggcgggcggatcacgaggtcaggagatcgagaccatcctggctaacacggtgaaacgccatctctactaaaaatacaaaaaattagccgggcgcagtggcgggcacctggagtc

SEQ ID NO: 231591 - DNA, 275 bp, Homo sapiens
ctctgccaggcctttcccagatggtaactgaaccatttgtttaaattaagtcttgcctaaattataaggagctgagctaattttcaatgtcaagaattcttggaatagagccacaggaggtgggaaaatgtacagtaatgtggaggggttgggggagaagcgaaacatttgtcagctgagggtttctgggatccttcactcatgtttaaaacaatggccaccctccagaagccagccacttcatcattattatagtgttgaagcctagttgcatg

SEQ ID NO: 231592 - DNA, 345 bp, Homo sapiens
gacttattgggtcctctctagaaaaaaaaaaaaaaaaaagattatttttaaggaataactaaagtaaaaacaaagctctacgaactggaaacttgtggattagctactttatgaaagaacattattttagtgtgcaattctggagaagcaaacattgatcaacatttatatttgatatccttaactttaataaacatacacaaaacaaaaattgagttcagtccagtaatggcaaccaaatggtgttttttaactttccagattgactttgtgcccattatttcattaaagttctcttgctctaatgagctagacttgtgggaaaaggtttaaaaataaagctga

SEQ ID NO: 231593 - DNA, 365 bp, Homo sapiens
aggcatgaaccactacgcccagcctggtttggttttttgagcatccatttcctcatctttattattattattttgtgaggcaggtgactcacccaggagagtctcacagtagcgtgatcacagatcactgcagcctcgacctccccagggtcaaggagtcttcacacctcagcctcctgagtagtacatcaccatgcctagctgattttttaaaatttttagtagaaacaaaggcacggcgggggttgctccctttgttgcccaggctggtctcgcacttctgagctccatccatccatccatgtcggcctcccaaagtcctgggattataggcgtgagccaccatgcctggtccatttcttcat

SEQ ID NO: 231594 - DNA, 499 bp, Homo sapiens
aattaagtacaatcaaatatggctgttgtaaattctgggaattggcttggctaggattatatgcatatgcccagacagtgcttagagaaagtgaaaaaaaagacaaaagttggtttgggcaagacctggcttctcatcctccatgtcttttctttcatgtcacaggcatctaacaattagaattactaattatttattcattcactcacagaaaccaatatatgttgagcttctactgtgtctcagaccctgtgaacaagctaaatcagaccatgcccttgtgtagcctacaatctaatgaaggaatcagatggaaaaaaaaatatgaatcacattaagtattgtcatatagttcccagttttatgtctgctcttatgtgcgtggcattttaatgatgactactgcttgttgaatactgtgctaagatatctgtgccggcatctagcctaggacttagttggtgctcaataaaatgtgttgaattaattggtttaatcc

SEQ ID NO: 231595 - DNA, 591 bp, Homo sapiens
gcactccggcctgggtgacaagaattaaactctgtctcaaaagaataaaaaggtaacatcaggtacttctatcatatgtgctcatctctgtgaatggaaaactcttttgttctgtctgcctttacatgaaaatagaatgccagatattcctaatagttggaagcttcagtgtccaatgagtcagctacctgggaaatttggggcagttataaaatgttcccataacctgtttcttcatatttaaaatgcaaataaatcatctccatcctcacatctgaaaaatgcaatgacagatggaaagggctagcaagacatctaagtactactagaccttacgtacatgtagttactttgatgaaataaattcatacaagaaataaatgagtgataaaaacataaacgggaaaaatatatagctcttcttctctgaaagcatctaataaaattacaccatgtcattctttagatgttctgtttacaaaacacctgagggaactgacatgaaactgagacataaacctcttcaatgcagagttcctaaaactttaaggacaaataatattgaattccaccagaatttcttttgaagga

SEQ ID NO: 231596 - DNA, 353 bp, Homo sapiens
aaagattccttcggaattcctccgtataccagcatgtcatctgcaaatagagggagttttatttcttcctttctagacagtatgcccttaagttcttttccttgccttattgcagtagttacaactttcagtactgtgtttcagtactgtgttagagtgttgagagtgaaattgttgacttgtttctgagctcagcaaaaacatttgttgtttcactgttaagtatgacatcaactgtaggttttttggtaggtgctttttatgacattgagtaagttcccttctattcctagtgtactgatagttttttttttattgtgaataatattcaattttatctaatgctttttctg

SEQ ID NO: 231597 - DNA, 840 bp, Homo sapiens
cgaaccccctccgtcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagacttgagaagactcgaagactggctgtggccatgggaagatacaggtacatggaagccatgtccccacattgaaagcccaacgttcctgaagcccaaattactggcccacacagggaataatggatgcgtccctgctaaagtgtcattcacggaaggtggtctggggaccctactcagtgatagaccatgaaggatggcccaagaaaggtcttgccacgcaggaggtggtagaaaatgtccagctaatctcattgcaggcgtacgcagactatagcagaggcaccccacatggaagttgggccaatggcgaagtgttgtgacgagaaacgatgcacagaaccagctccaagaaggaggagacatacaatggcgcacatgtattagaacgaagggagatatgtgaaacaatcacaaacaggcaaagagaaggaaaa

SEQ ID NO: 231598 - DNA, 589 bp, Homo sapiens
cgaaccccctccgtcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggaccacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccaa

SEQ ID NO: 231599 - DNA, 448 bp, Homo sapiens
cgaaccccctccgtcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaattcccacagccctccagtgtactgagggtactggcctagccatgtggaattccctaccctgactccttccccaaacccagggaaaagagctctcaattttttatttttaatttttgtttgaaataaagtccttagttagccaa

SEQ ID NO: 231600 - DNA, 410 bp, Homo sapiens
ggccatctcctgactcgggattctttcaagttagcaaatatgtgatgttttcattactcaggaaaagtgtatagaactactttcaaaaatattttagggacaatacactagaagtgttatcaagagataaattgctttgtagttaaaaagtgaaaactacagcctaaatgaaaggaagggagaataaaaggaaaattgtatttttttcagctgtcattataaaagtgatgttgcccccatttaccaatgaaaagacactgagggccacagtgtccctctgagaccctctttccagggtcacatagctgaaatatgtggccaaaacagtatctttcccaaggcttataactgtaggcccttgtactacactgtgctatatctggtaggaaagaatatagatacacaaacta

SEQ ID NO: 231601 - DNA, 588 bp, Homo sapiens
  misc_feature (548)..(548): n is a, c, g, or t
  misc_feature (551)..(551): n is a, c, g, or t
  misc_feature (569)..(570): n is a, c, g, or t
tctgcattgggctttgtttctctgtttatcaggaaagtccttttcctttactaactgaagctataactgagctggtattttaccctggtgtgtccccacactctcatcctttactcgggactcctcagccccagcacggttcaataactagcaacaaacaggcctgtgacatcataggaaccaacttcactgcatgtttccatggtattaaagagttaccttaaataaacgtagtcaagaatgtaaatgaaccccatttttattccaaaaatagcaggctggccaggcacagtggctcatgccgataatccctgtaatcactttgggaggccaagatcgggggattgcttgaccctaggagttcaagaccagcctgggcaacatggtgagaccctgtctctacaaatttttttctttttttaattagccaggcatggtggtggacccctgtacatccagctactcaggaggctaaggcaggaggatcacttaagcccaggaggtcaaggttacagtgaacagtgtttgtgccattgcactaacagggnggnttttagagtcaaacaaanncgggggccaggggaagag

SEQ ID NO: 231602 - DNA, 564 bp, Homo sapiens
ttctgcattgggctttgtttctctgtttatcaggaaagtccttttcctttactaactgaagctataactgagctggtattttaccctggtgtgtccccacactctcatcctttactcgggactcctcagccccagcacggttcaataactagcaacaaacaggcctgtgacatcataggaaccaacttcactgcatgtttccatggtattaaagagttaccttaaataaacgtagtcaagaatgtaaatgaaccccatttttattccaaaaatagcaggctggccaggcacagtggctcatgccgataatccctgtaatcactttgggaggccaagatcgggggattgcttgaccctaggagttcaagaccagcctgggcaacatggtgagaccctgtctctacaaatttttttctttttttaattagccaggcatggtggtggacccctgtacatccagctactcaggaggctaaggcaggaggatcacttaagcccaggaggtcaaggttacagtgaacagtgtttgtgccattgcactccaggctgggcaatagagcaaga

SEQ ID NO: 231603 - DNA, 473 bp, Homo sapiens
gtgttcttactcctacaagttttccactactcaggggctctttagggtaaattaaccatgaaaacacacacatgcacacacacatacaaactaaattccattcatattaagatatgcttccttttttctctcccctatccatggtagtaataacaagaagtaaaagctttttcattataaagtaaacttccatttttctttcttgatacgttttcaggttttcctctaaaagtaattaaaagtactactcaagttgttcctagttgtctagaatggcttatgctgccattagcttctacagctctgtcattagagaaatggactgtacttcttcttcacctttcacatgcggccaaaattgggttactttaaaaggccagatgtcaaaagcagataaatcctttgtactgtaatgagcataatgatgaataatggcacttatgttcaataaacgatgccctgcccataaacag

SEQ ID NO: 231604 - DNA, 428 bp, Homo sapiens
aatatcatattttaactttattttgtaaaatatactgacagttctcatgccttaggtcttctcctcctttttctactagtttccaccaccactcctgtcaaaatttttggactctgttctaagattaagcttatgataaaagttagtagggggccgggcagggtaatcacgcctgtaatcccagcactttcggaggcagaggtgggcggatcacttgagcccgggagtttgagaccggcctgggcaacatggtgaaaccctgtctctacaaaaaatcagtcggcactgtggcatacacctgtggtcccagccccttaggcggctgaggcaggagaattgcttgggcctgggaggcagaggtaatagtgagccaagatcatgctattgcactcccacctgagtgaaaggaatgaaatcctgtctcaaaa

SEQ ID NO: 231605 - DNA, 764 bp, Homo sapiens
ctgaatgctttttgtcatctctgttttcatagttcttgagcaggtactaaaaattaactggaaacaatgaaagtcatccaggttagggagaggaagttacccgtttatgagagttgcttgagagataagctgaaaggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacacttatttgcagctggaaatgggggaatgggctaactggctaaactactatcttgtccatcctgccttcacttcagtccttccacattgttatttggtgtttggactgtgctagaagaactgttttatacaggctgctattcaataaatttgtaaataccatacccacaccaaaggatttaacactgaaaagattaaggtaattttggaaaattctaaaagtcacttttcactcctgagatagtaggtggtcagaagaaatgaggaactctgtagaagccatatgcaagatgcacagatggcattgtgtttgttgtggactgttgatgttaacaggatggaagaagtcgtgctaagaaactagacttgaagaacttgtctctctcagaaattgagaaattgttagcaatggttgaactaagctcatcctcttggcatttgcagcctacctgtgcatcataggacatgaaataaag

SEQ ID NO: 231606 - DNA, 698 bp, Homo sapiens
ctgaatgctttttgtcatctctgttttcatagttcttgagcaggtactaaaaattaactggaaacaatgaaagtcatccaggttagggagaggaagttacccgtttatgagagttgcttgagagataagctgaaaggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacacttatttgcagctggaaatgggggaatgggctaactggctaaactactatcttgtccatcctgccttcacttcagtccttccacattgttatttggtgtttggactgtgctagaagaactgttttatacaggctgctattcaataaatttgtaaataccatacccacaccaaaggatttaacactgaaaagattaaggtaattttggaaaattctaaaagtcacttttcactcctgagatagtaggtggtcagaagaaatgaggaactctgtagaagccatatgcaagatgcacagatggcattgtgtttgttgtggactgttgatgttaacaggatggaagaagtcaaaactgaactttattagggtataagtgtctctctcagaaattgagttgttagcctggttg

SEQ ID NO: 231607 - DNA, 480 bp, Homo sapiens
cataaacctaaaggtaagccaaaactagaaaacttccagaagaaaacaagagaatgtttttgtggcattacgataaacataaagttatcagttaagacagggcaaaaatatccatgatgcattaaaaaataaataaaatgatctttttcaaaaataaaagtgtttgcactttaaacaatacatttaggaaaaataaaaggtaattcccagatatgaagactatatttataatgtatgtatgtgatgaaggatatgtatctagaatgtatgagaaagtcttatcattcaataataagacagataacctgatacaaaagtgggcaaaatgtttgaatagaaagttatgatgagttttttaaaaaagagtagatatgcaaatggaaagtaagcctgttaaaaataatattttcatccactagggcaatagaaaatgaaattatagtggcatagcactacacactgactagcatggctaaaatg

SEQ ID NO: 231608 - DNA, 478 bp, Homo sapiens
cagatgagaagagggggcagttaaagctcagatttgatgtaacattacagatcaaaggccccaaacagctctcaacctgctggtttttgttctttctccatgtgtgaactgtgttatgaaaggaagtccactgctcaaaatatattctataatactacaatgcaaaccaacatcactcagaacatgaatttgtatacagcacaagtaataaatatttttagaaaactatttacaacattacttcttgtgaacatttagacgagagcaaaatttatttcttcctgcaaagttaaaaaagttttgactgtctagttcagtgctaaattccctggcacctagtttctcattcacatttcatcttaaaatcagatttgcttacaaagtctcctagaaaaaacattctccagcattactgttcaagtgtctgcctcatttgtttagaaaagacaaagggaggccgtaagaaaatatgcaaatt

SEQ ID NO: 231609 - DNA, 244 bp, Homo sapiens
cccctaagtatatcatgctttgtgatattcgctattggtagtgttgtaggtagttataaatacatataaataaaataaaatataaaaatataataatataggataataaatataatcaaaatataagtgtacatatattaaaagtgagagatcaacaatgttttgcttcaagagagcatatcaaaacagttcttacaagagcatcgtgtcagccagcatttccccagcagtgcgatggaacaca

SEQ ID NO: 231610 - DNA, 168 bp, Homo sapiens
gtagtggtggtggcatgggttccggtgttagactcactgaggttctaatcccacatccaccaacaaccttggcaagttacttcccctttctgaggatcagtatcctccttgtgaaatatccccatatcgtgtgtgagaagagtaaataaaataacatctgcaaaccca

SEQ ID NO: 231611 - DNA, 369 bp, Homo sapiens
cacaaatggagcttgcaggattggaagttgctgtgggtgtcagtgagtgagtggggagtgaacgtggaggcctaggatattacttgtttgcttttctatgacttgcaacccagtgggttggtttacaccagcatcgtcacggagctgaaggtggctcacactagctggcaggggccagttgttaccagtaggatttgatactattgacagtttcaggcatcaactggactcttgaaatatacacttgcagataactggtgtctactgtattccctgtttattaaatgtccttttaatgcttactctcaatttctgtatttattttgtgacacactggaaacacttagtggaacccttcaagcgacactg

SEQ ID NO: 231612 - DNA, 513 bp, Homo sapiens
gctgtggagggtggtgcgagctgtggggcgcggatacagctgccacggtttccccagctcccaaggacactcagtgtctctagagggtcaagtgtaaaccagcacgcagcttctcctggaacactgggcatgggaagcttgtgcggatcaggtgaggcatccactggctttgctgccctttcagagaaggcgggttgtctgtcggtcctgctggttggagggtccccacctctgtgaggtggaaataagaggggctctgagtccaacagcagcagctggaggcagagccgagtgcggcaaacaagagctactttaaaatttcatttaaaataaccaagtgcctgatattaaccctcattaggaaaacatagtgttaacaatattagtttgtatcttttcagatttttagatattttagtctcaaaggtatttaaaatgaaaactgtcaaaacataagtttaaaatgtcgagcctgcagggagctgcgtcctcagtagctggttcagctcgagc

SEQ ID NO: 231613 - DNA, 458 bp, Homo sapiens
tttccctttaagttattaatttacaagacaagcatgagttacgttttggttggttgtttattcattcatgtgtgtatgtacatgtgtatgatggagtcttggactcgggctcaagcgatccccccacctcagtctccctagtgcctgtgtttaattattttcacataacactccacatttctaagtgtatggcaacaggatctcacatcaacgaccctgttcccacagcctaactcttctggggcttgtagtaaaaccctaaatttccaattcttttcctatattcaaatgcaacattatcaagtatttgtcttttattgtacatttcatacagatgaagtgtgttatttttttcagagtagtgagtcgttctgaaaatatttgttttcactcttaaaatatttctgaacattacacatgagtggaaagcagaaaataatcacctgacagttaattgt

SEQ ID NO: 231614 - DNA, 137 bp, Homo sapiens
actgttgatctgtcccccaaaaaagactgtttcacttagatttcagaggctctccaattgagaagatttcatttggcactggactgttaccttcatgtttgctctattattaatagattctgcctctctttactgct

SEQ ID NO: 231615 - DNA, 162 bp, Homo sapiens
cctagaggtaaaattgctgggtcatacggtaattctgttaaacatttttaaagagactgcaccatttgacattgccaccaggaacatgtgagagttccagtttctccatatcctcattggcacttggcattgtctgtgtttttattaaagccatcctagtga

SEQ ID NO: 231616 - DNA, 393 bp, Homo sapiens
gtactatattatcatattggttcaggtttaccatactctatgcgtgccagtctttaccgattttaaagccagaagaaggaatctgtaaatcgtactaccattttcttctgcctgtgtgtgatggttctaaacctggcaatccaaatgcactttttaatttgttacacaataatatagtaaaacctcttggatagacatttgctcagttttcaaaaatatctttttatatacattaggtaatcaactacagttatttaaatctgctttttttctgtgaggttttgccatgaacacagaagggaaattgacctcctgttgttgggcaattagagccattaactgctgccgtacaagagtgtaagaaagaaggagagttgactccagagtttgtgt

SEQ ID NO: 231617 - DNA, 394 bp, Homo sapiens
gctcagcaaccaccaccttacattaaggcaagaccctccatcagcaagaagactgaaacttggccaggtgcagtggctcacacctgtcatcccaacaccttgggaggccaaggtgggtagattgcttgagcccaggaagtcaaggcaacatggcaaaaccccatctctacaaaaaaaaaaaatacaaaaattagctggtcatggtggcatgtatctgtagttccagctagtcaggagtctgaggtgggggtttgattgagcatgaggttgagactgcaattactctagcctgagccatagagtaaaaccctgtcacgcacacaaaaaaagattgcagctttctgaaggctcagatgactgttagcacttgttaacaataaagtatttgtaaatt

SEQ ID NO: 231618 - DNA, 443 bp, Homo sapiens
cattgattttgtagattctcactgatacccaactataagggagagatgtttacttgtttgaaattcatctgagtccaaataatataacctgggttttaaacgttcaccgctaatttttttaaagacactgtaaattatttaaaagaaaatgccttctggccaggcacggtggttcatgcctgtaatcccagcactttgggaggctgaggcgggtggatcacttgaggtcaggagttcaagaccagcctcgccaacatggtgaaacccccatctctactaaaaatacaaaaattagccaggcatggtggcatacaatgtaatctcagctacttggtaggctgaggcaggagaatcacttgaacctgggaggttgcagtgagcggagatcgcaccactgtgttccagcctgggcgacagagcgagactctgtctcaaaaaaaaag

SEQ ID NO: 231619 - DNA, 284 bp, Homo sapiens
caaaaatgtgctttgtacttttcaaccaccactgtagcatttagacactatcattcttaactggagcagccagagggttaatggtttgtacatctttcttctctctcactctgtaatactagtttagatcttgacagcaaagattgccagagtagagtgcagcacacatagttactttaaaatagtttactaaactgattccttccttttccctagtgatttggggggataggggctgggtgtaaattcattaaagaagttgtggcattagaaaatcacaacca

SEQ ID NO: 231620 - DNA, 171 bp, Homo sapiens
agcctcccaaagtgctgggattataggcgtgagccaccgcgcctggcgtccagccacattctttaactcagcatctgcagaccttccagtcctatcttggccgcctgccagccatgctgacctttcgtttctgctgtgcaccacctgcccttcctctctcctttctgccta

SEQ ID NO: 231621 - DNA, 416 bp, Homo sapiens
cgcctaattctaataactaggaataaccaattaggtcatctgtcctcacctctgtcacttctctctgaggcttgtggtgttcaaattctgctacccttaactttctagaaggagggagaaacacctcaattcctttccactcttccggttcagatggttcaaacagctggacttctttgacaaaaaaaaaatgactttaatcatgatagaaacatagtacttgaaacacagaacaaacagaagagaaaaacattttctgtgatagttttctcttttggtttctgaaaagtgagcaaaatttttaattaaaaaaacccataaaattgccttaggacactctcgacacagatgagagaagacagtcattaaaataaattacagaatgggaaatggcaccattaccattctccactgat

SEQ ID NO: 231622 - DNA, 435 bp, Homo sapiens
gatgttactcctaatatgtcacaggggtgtacaccctttgatattatttgtaatctcatagagagatattacttcaaatatcacagtggatgtacacacatagtgtataccctgtgatattattcataatatcctagggagatacaactcctggtatcacagtgcgtgtaccccgtgtgtgtacacccttgatattagtcgtaatatccagggtaaatattactcctaatatcacacagtgtgcacaccctgtgatatttttcataatatttaagggagatactgcttctaatatcacagtgggtgtaccgcatgtgtgtatactctgtgacagtatattttatatcctagggaggtattactcctaatatcacagtgggtgttcaccctgtgatatcattcttatttgaccttgctgccttttttaacccacac

SEQ ID NO: 231623 - DNA, 423 bp, Homo sapiens
gggcgcaagttctgccctggcaacaagtgatcagcctccaggaagaccagggattggctggactgcagggcagtcaagggcacaggagggaagccttggcagtgtggctccagctgggcagctgccttctgggcacacactccttcttcctgaggtgcctccaggcatccagcctggcactaggcaatggggactcaggctctacccctgcaccctgtaatcaagagctcctggcctggtgggagtcaagaggtgatatgaagaggtgaccaaaagaggtgattagcagatcaaagggaaaagtcatctgattatctccacagacactaaagaggcatatgataaaacccaatatccagcttacttacacaaacaaaaatcttactaaaacagaaataaattgatactttcttaaatgagaaa

SEQ ID NO: 231624 - DNA, 440 bp, Homo sapiens
tttgagagtcactattttaactctgtcagtcccccagagcattgaaaagacaattacacagaaaaaaacttcaaatcccatccagcctgtttttttaaattgatacataacaattatacatatttatgggacacgtgatattttgatacatgcatgcaatgtacagtgatcaaacaggatatttaggatatccgtcacttctaacatctatcatttctttgtgttggaggtatttcaaatcttttcttctagctattttgaaatacatattgttgttaactatagtcaccctactgtgactgtcaccctatctaacactagaacttattccttttagctcccccattaaccaacctctcttcatctccctcaaaccttcccagcctctggtaaccatccttctactgtctccctccatgagatcaacttttttagctccc

SEQ ID NO: 231625 - DNA, 479 bp, Homo sapiens
ttttgtgaaatgataaaactgcagtgttctttttcaaccacctaataagagcactggcatcaaacaggtgttcattaataaataattcaacaattacaataatataaactgaatactacagcttaagtaagtgcatccaaagtaccttgaatcttcatttcattcattacaaaatccaactgaatttttatttaataaaaatccagttttggccaggcatggtggctcatgcctataattccagcactttgggaggctgaagcaggaagatcacttgaggccactagttcaagaccagactgagcaacacagcaagaccccatctccacaaaaactttaaaaaattagcagggcatagtggtacatgcttatagccctaacaactcaggaagctgaggttggaggatcacttgatcccaggagtttgaggttacagtgatctatattgggtggcatagcaagaccctcatctctttaaa

SEQ ID NO: 231626 - DNA, 218 bp, Homo sapiens
ctccctccacagcaaagttcctccagtccctgtctgactacaatcatttgaaagatcctgagccattaccatcaagctaacccttctagaattcctgacccacagatattgtgacacacaaataaaatgattgctttaagacactaagtttgaggtgacttgttatgtaaaacagattaacaaatctcaacacagatctcaacactgggaggggctgc

SEQ ID NO: 231627 - DNA, 129 bp, Homo sapiens
ctggaagccaattttttaagacacaggtgttttgaaatatgagttcactcagaccttatggcctttgaacatttgcaccatccctacctatttcacctacttggaaggctgaaagatgtagtcacatag

SEQ ID NO: 231628 - DNA, 239 bp, Homo sapiens
atgtgaaatccaaatccaagtggaagcacgattaagtcaggaccatgttgctaggtgttttagaggaactcattgctagcctgaggggcgtgatggaggctgcagatggagacagatacgctcctggagctcctcgcgggagtgcagtagagtcacctgagagtgccccagatgagagatctacagatcctgtgggacacactaatgtcagggcaggcgtcaacagatccctactttag

SEQ ID NO: 231629 - DNA, 445 bp, Homo sapiens
gtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagag

SEQ ID NO: 231630 - DNA, 992 bp, Homo sapiens
ggcacgagcagaggaaggggcggttgttgcggcctccattgttcgtgttttaaggcgccatgaggggtgacagaggccgtggtcgtggtgggcgctttggttccagaggaggcccaggaggaggattcaggccctttgtaccacatatcccatttgacttctatttgtgtgaaatggcatttcctttaaagccagaaaccagagtggggtgcctgctatgcttctactcagcactgcactggaaattctagccagtgtaatatgacaaggagaagaaataaaaggaataaatataggaaaggaaaaaccaaaagtctcagtgtgatataataacctatgcagaaaactcaaaacagtctacaagtaaattataaaaattaggagtgttggcaagttcactgagtgtaggatactaaaatcaattgcatttttctacattgataacaaacaaggcacaggcgcactggctggtgcctgtaatcccagctactctagtctcagctattcaggaggctaaaaaatgggaggatggcttgagcccagcagctgagggctgcagttagctgtgatcacgccactgtgctccagcctggccaacaaggaccctgtctttaaaaaataataaaaaaaaatagaaaaagtaattattaaaaaaatccagttatattaacagtaacagcaaaatatgagcttcctaagaatatgttgcttttgctatgtatataaagagaaagagctctatctctatgtatacacagcaaaagtggtcaaacttcatggagaaaatttaaaaattttatcaaaagccaacatggatctaaataaatgggagaaaagtactgtgttcaagcctaggttgacatattatagacatatcagttatccctattggtcaatttaatgcaatttccatgaaaatttcagcaagatttttcagtagaacttgataaaagtaattctgaagtttatatgaaagcacaaagggccaagat

SEQ ID NO: 231631 - DNA, 711 bp, Homo sapiens
ccagtagttccgcccgctggtcatcgcgccctttcccctgccggtgtcctgctcgccgtccccgccatgctgtctctagactttttggacgatgtgcggcggatgaacaagcggcaggtgagcttgtccgtcctctttttctcctggctcttcttgtcccttcgaggctgctgctgcggggcccggcggaccccagggttctggtgtgagggtctgagctggtctgatacccgggtcattcgctttctttggagactgtggccagaggccgccttgtccgcctcattatttttaaccccgaactgattcagggcctaccgggggcggggcgggaagcggtgtcttcacgttccattcctcccactgaggcaggggagcaaatggaaaccgtacgcgcttgaagtgggagttggggttgcttattgttttagtcattttaaggcggcggactcttgatttctccagtcggagcgactccaggtggtttcgggagagacgaggtttagccggtttctggggcgctcaggaaggcgattggaggccccacaaaaaccgttttgctgctttcagctccttgcaaccctttagtagagctgaaccgtagcgggctgcaccgactttgacttggaccactctgggctccgagttggaacagttacactacttgcccttgcgtccgcttagcactaaggcggcagccctcggaatcta

SEQ ID NO: 231632 - DNA, 277 bp, Homo sapiens
  misc_feature (129)..(129): n is a, c, g, or t
  misc_feature (138)..(138): n is a, c, g, or t
ccagtagttccgcccgctggtcatcgcgccctttcccctgccggtgtcctgctcgccgtccccgccatgctgtctctagactttttggacgatgtgcggcggatgaacaagcggcagctctatatcaantcctaaatnttggaatgatatgtctcatctggcactaactgatcttggcaaggggttaattggtaataacttggaagtgaaagtcctgattgtatgtgtgtgctcagatggcagctattggaaccttgcatattcatagaggagatct

SEQ ID NO: 231633 - DNA, 530 bp, Homo sapiens
aattgagggaaggggattgtcctcttgtgctctcaatggttgtgggctgccttggccttggtgggagggtggggtggggcataatttctgtagtaagtgtgttggcaccagacattcacacagctggggagggtgcactgggccaagcaaagcgggtaggggtgcaccacagcacctactacaggttaggtctcaacagggtcatcctgacatcctattttaatcccagttcacgatttctccaagaactaattatagccatagagtaacctgaggccaacaaccagccatgcgcttcatgcagcagaacagccttcccaacccccaaagctcacatctctggcaatttctctactggtttgctggtcccaagaggaggatcatgatgttttgcataagcatacaaaggaatgcagagataatttttctgtgggcttcttagtattagctttttcagccatagagaggaatttatttgaatcaacaatatttactacagtctctcagatgactagcctcagagctctaaa

SEQ ID NO: 231634 - DNA, 367 bp, Homo sapiens
gaatgtaaaagatgaaagggacatttaaaggtctagttcacatcctgtccagacaaaattgccccatagtcactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctcaatattgcaagtacacaagccaaaaccttagcaattggtagttatattaatttatattttgattcttagaacaacctgctttaccaatagaaatggca

SEQ ID NO: 231635 - DNA, 445 bp, Homo sapiens
ctctaatgagactatattagactctgaacttacagtttccccgaaagaggttgccctaagtatagggatacagaggaaggggcatgggttgctgagacaagtgtcctgagtttgagtcccagctctgctgcttactgactccatagccactataagtttactctgagcctcagtttcctcattgtgaaatgcagcaataatttcctcaccaagacaccgtgaggattgcacaaagtaatagcaaagtcatatactcaacaaatatttattctattcctattgtgtgtcaggccatattttcagtgctgggctacattcattgacaggacagacaaaaatatctacccttatggagttgggaatggttggagagaaagacaataaacaagataaataagtaaaatatagagagtgttaaatgacgttaagcgctatggaaaaagac

SEQ ID NO: 231636 - DNA, 459 bp, Homo sapiens
cttgacagattcccatgactctgggagtaggcagccccaaaaatgggggaagccaagtggacctggagaacggccactcgcagggacactattcaaatgcctaggagagcccactatttcccaaacaagtgcccagacccatagagtggcatcccctgttacctaaacatggagcctcatgccagcagattctctgggtgggaagctggccgctctgatcctccccagttatctgaccatcgggagttttgcctgttcctgacccactacttgatatgacaccccctgtctacaatatccaagatatttttcagctcagaaattgtgtgtgagggcttgggaagactggattcctacattggtggtgatgagcatgccagattgagtagttggaaagaactgggctgggttatggctagcaacacctctgacatgcattttctaacttgtgcaaacatt

SEQ ID NO: 231637 - DNA, 500 bp, Homo sapiens
ggcttttgatgacgtcggtgaatccgtcctcagcggcattttctggggtctcctgcagacccctcagctgtgccataaccaaacgccacgtgcctcagcttcctcacgccccaaactttggaaggcaggtcacatggaatctacacatggaaggacataggcattgcatgcaggtatccggaatcattgatattggtcttaaaatttggaagtttccacttttgctaagactgccatttataatgagccctacggagaggccatgtggcaagaagctgaggctgccagagggaacctgaggcctgccagcaaccacatacatgagtttggaagttaattcttcagcttcctttgagtcttgaggtagctacagcctggccagaacttgactaaacttcataagggacactgagccagaaacacctaactaagcaaattctggttttatgaccttcagaaattgtgtgaaataataaatatttgttgttttcattattcac

SEQ ID NO: 231638 - DNA, 364 bp, Homo sapiens
agaaacacaggaggcttatgcaggaagaggaatgagtttgctggactggggagagtgacagtaaaaagcagaggataataggcatctctggtcatctagggactatagggtggattagttgggggttacagaatcagtgaggtactttttaacagtaggatgggtaaataagagctataatttggaataattatgtagcaatggtggttaggagcaatagaaactcaaagtattacataaatattttttttcttattctcccacacaagcgttttgcctttcctcttaaactgagaacggagtggtttgctatgatgtttttaaattctcacagacaagcattattctttgctgccttttagta

SEQ ID NO: 231639 - DNA, 492 bp, Homo sapiens
tgtgtgtaggtatcaatatatagatactatgatggttcgtttcatgtgtcaacttaactggactaagggattcccagatagctggttaacattctttctaggtgtgtctgtgagattgtttctggaaaagattgtcatttgagttgttagattgagcaaagaaggtctgctcttgctagcgtgggtggcatcatccagtgtgtgggaagtccaaatggagcacagaggcggagaaggggcgaagttactcgccctgtgtgatctggaacatccatcctctccggcctgcaggcatcagagctcctgggccgccggcctttggacccggatcaagacttacactacctgcccctgcttctcaggccttcggacttgcaccaaatgactctacaagcttttctggttctccaacttgtaggcagtagatcataaggcttcttggcctccatagtctcataaactacttcctataataaataagtaaatattata

SEQ ID NO: 231640 - DNA, 305 bp, Homo sapiens
tgtattttatttgtgttcgaaagtccgctaattcccaatgtggagggttggggatgtttcccttagcgcctctgggacgctgtccctaaggccttattccatgttgaatctgacgctctcaatgtccaggctcggctgcggcgtggggaccgaaaaggggcggggtgggtcggacggcagtttaattacgtccccgggaactgcgccgatttggacttttggcacttggacctatgctttaaaaagaaaaaagtgtcattggcgtggagtggggctagtggagggtgaggtgaatgcgccgtttg

SEQ ID NO: 231641 - DNA, 460 bp, Homo sapiens
cccccatttgttcatccatacaatgatgctctgaggagcacacaaggaaggtgcaaatttgataaaatgtgcatgatgtaaggagcataaaccccctcaggaaagagttgctgccttttcactaatgtatccctgagctgcacagagcagccctgggggactgggaggacatgtccccggtgtgaggagcaggggaaaggtgagccttaaatgatcaccaacaaacaacagggcctgtgtctggggcttacaccacgacatgtggtcctcgcagcaccattgctcagaggaagaaaccaagatctcgaggaactgagtaatttgcccacgttcaacaagttggtgcaaaatgaagagtggctcccgtatttcagactttaaggccgacgatcttccatctgtgctctgggggcaagatgggaggtccacagataaaattgcgggcggtatcccccaaaca

SEQ ID NO: 231642 - DNA, 488 bp, Homo sapiens
cactgttgtaggtggtctctttaccttcctggctctcctgggtagtgctagtctcaatggaatgggctcatccgtcctattacaccttgtgaaagcttgagagctgtcatcaacacacctggctgctttgttgattgttctgtaatccatttaaaacaaacaaagaaacaaaagtaatgtattttaaaataacttccttatttttctaaaaccttagactctccctttctcagcttacatcccaatgtctttttttttttttttttgagatggagttttgttctgtcgtccaggctggagtgcaggtgcggcggcatgatgatctcggctcgctgcaacctctgcctcctgggttcaagccattcacccacctcagcatccagagtagctgagactacaggtgcatgccacaatgccctgttaatttttgtatttttagtagagatggggtttcatcaggttagccaggctggtcttgaactcctgag

SEQ ID NO: 231643 - DNA, 449 bp, Homo sapiens
gaggaatggtggaggagctggggtgctgggcgtgcagtagtgcttgactggaaaccggacgaagctgcagatgggagaggcactgcttgaacactcctgccgcatccatcactccgggcacctcctgcagtgcacacggtctcactttgattttaatcccaccaatagcaggaaggaggtatgagcctcatctgcagctcaggatgattaggggacaagtctggggtcatgtgctggtaagggaaagaatgtggactcaatctcacgtggcctggctccaaaacccgtccatttgctaatttagtttaaaccaccggttttttaacttaaaaattttgtttctgaacgttgaaaatgaatataaaattcaatgtgcttctctgtactctcttagcaacttcctgtgaatctataattatttcaaaataaaaagtttaaaacaatcctat

SEQ ID NO: 231644 - DNA, 348 bp, Homo sapiens
gtatcaggagttagcagggaggatatggggataggagaatgggaagaaataagagaagggagaggagaaagcccaaatcatggtagagatgaaagagtcagagaatgccagatggagagaaaataacagaagaggtggcaggtgtggtggctcatgcttggaatcccagccctttgggaggctgaggcaggaagatcgcttgaggccagtagtttgagaccaacttgagcaacatatcaagacccccatctctacaaaaaataaaacaatcagctgggtacttacacagaatatttatgaagaaacaagaacaaaaattcagctggggccaggcaccaggggcttatg

SEQ ID NO: 231645 - DNA, 204 bp, Homo sapiens
tttttcactttaatgagaagaacccccatttctgtcagatgactgagggaaaaaagggatcaaaggaacctcactgaggggctgaatgtgatctctcaagcaaagctaaaaactaccccaggaaattccagcctaaatgagaaactggaactgaaaacgcaacctgtcttagaattggctgcttggaaaacatttgtcatctag

SEQ ID NO: 231646 - DNA, 408 bp, Homo sapiens
gttatctcacattttctgtgtatcaggaatccaagtggcctagctcatatggttctgtcccactctgatggtgttgcaatcaagatgtcaggcagggctgcagttatctgaaggatcctcttccagcaaggctcactcacatggctgttggctggaggcctcagttccacagttctttgccctttgagcctctccatagggctgcttgagtgtcctcataacaaagtagctaactttccacagagcaaatgattcaagagaaagagcaaggaagaatttgcagtgcctttcgtgacctacttttgggagtcatctaccatggcttctgttcagaagggagttactaaaccaatcccaaactcaagggagtagggaataacctccatgcttgaaagtaagagtatccaa

SEQ ID NO: 231647 - DNA, 203 bp, Homo sapiens
ctcccgggacaccacccctggggcaagagtggcacttggctccctggaaagcagagacagacctcccccgtcctccggtctgtcctcaggcccactgcatggtgggataagacctgtggttaggacaccagccttcactgagggcagccttagggctgagccctgcccaggcctcagggggacagaaaccaggcaagaggggg

SEQ ID NO: 231648 - DNA, 326 bp, Homo sapiens
atatttttggtagaaacagggttttgcatgttggccaggctgctcacctggctggcctgccattagtaagaatcctgttcggtcagtttagcaagaatttccctacccttgatgtctcactgttagtaattgttcatccactgaccccttcaccttgctcttggttgtgaatccccagttgtccttgtattctgatttgaacccagtctctctcccctattgtgatacccctattagaatagtcttgaatacagtctccttactgttttaagaagtgttagaataattttttcttgaacacatatcgcccttcagaaagactgcac

SEQ ID NO: 231649 - DNA, 438 bp, Homo sapiens
gtcgattcttttcttcttctgttcgttggctctttacgaggtctttgccttaaacagatacattttagagatggattaaaaaggggactagctcatgagcatagaattcccgatttccttctgtttccacttctgatgagttgtggcagcattaacaccaatgtaacttaattttacagaaatttttgtagtcggtgctactcataatcaggtaaaattattcttcaacacatttctttgttaccgtaatatatttggcttttctttgtggactattttatttctatacattattgtgtaaattgcagaatctttctcgtaaagtggtaggttgccactatttttattggtaaaactctgaatttattatacattacatagttacccctattattggaaactccttgtttctacattaaaacaacaacaacaacaaaa

SEQ ID NO: 231650 - DNA, 1188 bp, Homo sapiens
  misc_feature (416)..(416): n is a, c, g, or t
  misc_feature (476)..(476): n is a, c, g, or t
  misc_feature (481)..(481): n is a, c, g, or t
gggggggtagtcactatttgacatatggagaaagtgaggctcagagacatgcagggacctgcccgaggtcacagagctaatcagcgcagaatcttgggattaaaccctgctgttctagggttttcactatttcttgccttaggagaatcacttgaacccaggaggcggaggttgcattgagctgagattgtgccactgcactccagcccaggtaacagtgtgagactccgtctcaaaacaaacaaataaaaaagataataaaatgctttatgctaagaaatgggagtaagatcatctctggcttggatttttcttttctttctttgcaattacaatagtttatggctgattttttttttaaaggtctgcctgatacatgctttgcaaactctaggtatttcaactttgtcatcatngtgtgtgtccagacgcagaggctcacacctgtagtttcaacactttgggaggctgaggtnggagnattacttgaggccaggagttcgagaccagcctgagcaacagagtaaaactctgtctctacaaaaaatacaaaaattagctgggcatggtggtgcgtgtctgtagtcccagctactcgacaagtggaggtgggaagactgcttgacccctctaggcagaggctgcagtgaaccaaggtcatgccactgcactccagggttgacagagtgagacccctggcaataatagtagttaatatttctcaagaacttcatgtctgaactcactgaattctcacacagcaggccatgagttcaacaatcttttaatccccactccacagatggggaaaccaaggatctggaagcaaaagcctgacgtcacaggctgcggagacacgggacagggacagggcccaggttcttaatctcagtaggtgttggcctccactttgtggaataaacaaggggccaagcccctcgggcttgggaccgtcttaccctcgtcactgccgcgcttctcagcctctctgccaccatctgccctccagcacagaccatgctgagtgttcccagattgtaaaagacatacatctgccctatccccaaacccagcgtcctgggtttgagattacaggcaggagccactgtgcccagccccctgggctatttttaaaaataaataaaatgaaggctttttgtccaaacttcaagatatgttgttagattg

SEQ ID NO: 231651 - DNA, 692 bp, Homo sapiens
ggtgctccacgggggaacccggccccgggcgggaccacccttcgggccacaggggacaccccggagcggcgggggctgcggacaaaggcgtctgcctgatacatgctttgcaaactctagtttcactcttgcagcccagactggtgtgcaatggtgtgttcttggctcactgcaacctccacctcctgggttcaagcgattctcctgcctcagcattccgagtagctgggatttcccagatgcctgccaccacgcccagctaatattttgtatttttagtagagacagggtttcaccatgttggccaggctggtctcaaactcctgacctcaggtgatccacccgccttgacctcccaaaagtgctgggattacaggcatgagccaccgcacccagcccttctcatatttctagagaagctggatgccacattgcaactgcaaggtgccctgtgaagaggcctgcaacggcgagaaaacaagggagacctccagccaacagctaggaactgaggctctcggccccatcacctgtgaggaactgaatcctgccaacaggcatgtgagtgggctggaagtgggccctcctcacggagccttccgatgactgcacagccccagccaccagctcgaccgcaaccccgagagcctgggagccagcagctcagccaagcctggattcttgacccccag

SEQ ID NO: 231652 - DNA, 936 bp, Homo sapiens
gaagacatgtacactggtttattataaagggcgttacagaagatacagatgaagagatgtgtaggttgaggtatagggggacaggtacagaacttccgtgccccccctgtacacgccaccctccgggaacctcagctgtctggaaatttaatgaaccctgttcttttggggttttgtggaagcttcgttatgtagacatgattgattaagccattggccattggtgatcagcttaaccttcagctcctccccactccccaaggttgggggtggggctgaaagtcccagtcctctaatcccgccttgctctttctggtgaccagcccccatcccgaagctacctaggggctgccagccatcagtcaactcacagcatacaaaaacacatcactttggagattccagagattttaggagttgtatgccaggaaatggggatgaaatcacatacgtatttcacaatctttcatgcccttttgtacgtttatgagaaattaggattaaatctaacccaaactgtggctttgaaacttggggctgttgagcatctaatatttggatgaagaaccagataataaattattatatataatacattatatatatgtaaatatatttttatatatgtgagattacattctatctgaaatcaacccaaacacctctgtaaaggagcaagctcttacacattttctaggagctgtgtatttgtaaatcgaaattaagaatagagcattcatttactaaaacgaagaggtttaaagtaacatttatagtctcattatttagagtgcctttgctggccaggtgtggtgactcatgcctgtaatcccagcactttgggaggctgaggcgggtggatcacttgaagtcaggagttcaagaccagcctgggcaacacagtgagaccccatctcaaaaaaaaagtatattaaa

SEQ ID NO: 231653 - DNA, 1052 bp, Homo sapiens
agaatatcaacagataggcattataaaaaaattctggcagagaaaagtataataaatgaaattttcactacaggggttcagcagcagatataagcaggtagaagaaagaatcagcaaacttgagatgggatcactgaaagcagaaacaacaaatcaagcctacatagttttaaaagatacatatcacacacaaagaagtgaagaagatatggtgcatttttgaaccacaacaggatgtagttagaaatcagtaacaaaaggaaaattggaaaattcacaaacttgtggaaattaaacaaaacactcaaccaatgggtcaaagaagaaatcacaagggaaattaaaaagagaaaaatgcaacataccaaaatttataggatgcagtgaaagcactgctaaaagggaaatttgtagacataaatgcttacattaaaaaacaaaaaagacctcatgtcaacaacctgactttgcagcttgagggggaaaaacatactaaatccaaagctagcagatggaaggaaataataaagattagaacagatataataaattgaataaagattagaaacactagagaaaaatcagtgaaactacaagttctttaaaagaccataaagttggaaagcctatgcctagatagactaagaaaaaaaggaagactcaattgctaaaataaatgaaaatgggaacagcactctagattctagaaaaatgaaaagggttatagaagaataccttcgacaatctagatgaaatgctcaaagtcctagaaatgcaaaacgtactactgctgaactatgaaaaaaatttaaaaatctcaatagaactataaccagtaaggtaattgaattagtaatcaaaattctcctggaaaaaaagcactggacctgatggttttcatttgtgaattctaccaaataagaagaaataaccccaatcccttctaacttttcccaaaaattgaagaggaaggacgctgcctaattcattctgatgctgaagccagacaaagatactacaagaaaagattacagaccagttattccttatga

SEQ ID NO: 231654 - DNA, 778 bp, Homo sapiens
acagctatgtctcacagtccagacttggagtacaagtaataagaagaataaaacttaatcccttaagtagattcaccataagttagctcagagcaattccagtgcaagtatggtctgtgatccagtagtatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagttaggaaattgaaatacagaaagatgaaaagtgatttgcccaagcatatagatcaaagctgtggcagaaccaggactggaacctatatctctctactaatggtttttttaaaaaaataaccttgtttcaaaaatattaaaaagtcacaagaaaggtaaacatgtggataaacaaaatgaagaaaataaaaattatccagtaataacatattggcatatgtctttctggtatattttcctgtgttgtcatcattatcatctccatcatcattatatccatcattatcatcatcatcatcatcatcatcatcattatcatcaccatagtgaacatgtaatgcttacctagtgccagatgctgtctaggcattttacatgtgttactggtaactcatgtaatcctcataacaaccttataaggtggttgctattatcccca

SEQ ID NO: 231655 - DNA, 785 bp, Homo sapiens
ggatcttaacatagacgtaagatcaaatgcaatagcatgtcaaacaatgtgtaactccagttatacaaacattactgtatctcattggggatacgaagctctacacacttgaagatggtgaaggaatataaaaattatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagttaggaaattgaaatacagaaagatgaaaagtgatttgcccaagcatatagatcaaagctgtggcagaaccaggactggaacctatatctctctactaatggtttttttaaaaaaataaccttgtttcaaaaatattaaaaagtcacaagaaaggtaaacatgtggataaacaaaatgaagaaaataaaaattatccagtaataacatattggcatatgtctttctggtatattttcctgtgttgtcatcattatcatctccatcatcattatatccatcattatcatcatcatcatcatcatcatcatcattatcatcaccatagtgaacatgtaatgcttacctagtgccagatgctgtctaggcattttacatgtgttactggtaactcatgtaatcctcataacaaccttataaggtggttgctattatcccca

SEQ ID NO: 231656 - DNA, 1194 bp, Homo sapiens
tcagagaacacatacaggagaaaaaccttacagatgttctgagtgctggaaaactttcagtcagagttccaccctggtgattcaccaaaggacacatacaggagagaaaccttataaatgtcctgattgtggtgaaagcttcagtcagagctttaaccttatcaggcaccggaggacccacataggggaaaaaccttacaaatgtaccagctgtgagaaatgcttcagcagaagtgcctacctcagtcagcatcggaaaattcacgtagaaaagccttttgagtctcccgacgttggggattttcctcatgaatggacttggaaaaactgttcaggggaaatgcccttcatctcttcattttccgtctcaaattcatcttcctgagtcccaaagcctggttggtgatggttttttcttccttgttggaccatgacaatttaggtattctgtgattgttgtgctataaagtttctttgatgtgtttgtcaaaacatttggaaaaagtcaacctcccagtttaaaggatgggaagaccccaatcaccaggttattggatctgtccagtgagagattcatccaccaaggatgaagaaaggaggacttttaaaaatttaaggtaagatagtaatagcttcaaaagaacacatacagagtaatcctgagagtaagcaaaggaaccatgagaaccgaagctagaattgctattgaattactttattttctcttcccttattgggtagagatacatcattactggcctcaggggtttacccaaagaaagggtatttttgagcaaataatgtgatttcctggctattttgtatgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtt

SEQ ID NO: 231657 - DNA, 457 bp, Homo sapiens
gaaaataaatatagatgtaatactgattaagttaaataagaaccctgtagagctgtacttaaattggaagtgtcaatatcgtttttaatcttttaattattgtatttcctagctatggccaatgaaaaggcctagcaatagtgaccatcgcagtagcgataagtaccactaatacccagaccatggtgtataaataacatttctcaccaaaaggaaccaggactcctcaagaattggctcattcaaaattggggctgaaaatgcacaagataagtctgagaacatcttgtcatatcagaaattcagaaagctttccaaaaattaatagggttatagtagagctcaaactgtcatgagacaacttgaagaggctccctgttgaacatctataaggaaataactacaacagattgaaacacatcagatatgtataagctcatgagtgcataatgatact

SEQ ID NO: 231658 - DNA, 1615 bp, Homo sapiens
cagaagctggtgttccaagaagctagaatgacagactcatttctcgctcctttctccttccctcttgaaggagaagccttgagttgtgcatcttctcttgattttactgaggtatggtagctatagcaaactgcctactgcctttttttttaacttttgctctcagtggctccaaggcatcgaaactatgctagttccatgagtgctccaagtgaggcaaaacagagactagtcccttgggcagccctctgaagagccagaatgccaacacatgctccactcttctccctccttgccaaggaagaaggcttaacttgtgcacttcctcccccaattgtgccatgctgtgccaaccatatcaagccacctgctgctttccattgtcctcagtgacccccagacattcaaattatgctagttctgtgggcacaccaatcaaggaagtaagagaccagtttcttgggcagctctctgaaaagctggaatgttggaggcatgctctattcttttctcccagaggaaaaagatgtgaagaggcattctgtcttggcactgagctgtgctaacttgggggagaggctgatgcaggttgaccttgctaggttatagaggcatgttctatcgtctttattaagaaggtgtttcactcttgttgcccaggctgaagtgcaatggcacgatctcggctcactgcaacctccgtctcccgggttcaagtgattcttctgcctcagcctcccgagtagctggaattacaggcatatgccaccacacccagctaattttccatttttagtagggacggggttttaccatgttggtcaggctggtcttgaactcctgacctcaggtgatccacctgccttggtctcctaaagtgctgggatagcaagcatgaaccgctgcgtctggcccatttttcttattcttaaacatcctactaaacattttggagctagttgtattaggaggtttattttctatgtggatggagcagtttaaaaaagctgaaataagtgaaatcttccaagtgatttaaaaaatttttaagcccatgtttctacctactaaaattcaaaaatatttactatagaagatgactagtcttctttatgacagttattttaatttaaaaggaattacaaggatataacttttcttgaaacatttgcacttaatcatgctgtcaattcattatatgatttggattacttgcttaatgtttctatttcttctctgttaatactaattactcctaataattataagaatgtgttattgtatccaatttagaaatcctgttatggaagctatttttatagtgtattatgattaatgcatacaatgtccatgtaaactttcaatttttaaatgtgacactacttatctattgaacacttaccatgtgctaggcactgttcttgaatgctttatgcataaaagcacatttaatcccatcatagccaataaagtattattaccttgattttacaaatgagataactcagatatgcagacatcgagtaacttggccaagtatacgtgttatggattgaattgtgtcctcccaatattcatgtgttgaatcactaacccctaatgtgactatatttgg

SEQ ID NO: 231659 - DNA, 1138 bp, Homo sapiens
cagaagctggtgttccaagaagctagaatgacagactcatttctcgctcctttctccttccctcttgaaggagaagccttgagttgtgcatcttctcttgattttactgaggttgaccttgctaggttatagaggcatgttctatcgtctttattaagaaggtgtttcactcttgttgcccaggctgaagtgcaatggcacgatctcggctcactgcaacctccgtctcccgggttcaagtgattcttctgcctcagcctcccgagtagctggaattacaggcatatgccaccacacccagctaattttccatttttagtagggacggggttttaccatgttggtcaggctggtcttgaactcctgacctcaggtgatccacctgccttggtctcctaaagtgctgggatagcaagcatgaaccgctgcgtctggcccatttttcttattcttaaacatcctactaaacattttggagctagttgtattaggaggtttattttctatgtggatggagcagtttaaaaaagctgaaataagtgaaatcttccaagtgatttaaaaaatttttaagcccatgtttctacctactaaaattcaaaaatatttactatagaagatgactagtcttctttatgacagttattttaatttaaaaggaattacaaggatataacttttcttgaaacatttgcacttaatcatgctgtcaattcattatatgatttggattacttgcttaatgtttctatttcttctctgttaatactaattactcctaataattataagaatgtgttattgtatccaatttagaaatcctgttatggaagctatttttatagtgtattatgattaatgcatacaatgtccatgtaaactttcaatttttaaatgtgacactacttatctattgaacacttaccatgtgctaggcactgttcttgaatgctttatgcataaaagcacatttaatcccatcatagccaataaagtattattaccttgattttacaaatgagataactcagatatgcagacatcgagtaacttggccaagtatacgtgttatggattgaattgtgtcctcccaatattcatgtgttgaatcactaacccctaatgtgactatatttgg

SEQ ID NO: 231660 - DNA, 1156 bp, Homo sapiens
cagaagctggtgttccaagaagctagaatgacagactcatttctcgctcctttctccttccctcttgaaggagaagccttgagttgtgcatcttctcttgattttactgaggtatggtagctatagcaaactgcctactgcctttttttttaacttttgctctcagtggctccaaggcatcgaaactatgctagttccatgagtgctccaagtgaggcaaaacagagactagtcccttgggcagccctctgaagagccagaatgccaacacatgctccactcttctccctccttgccaaggaagaaggcttaacttgtgcacttcctcccccaattgtgccatgctgtgccaaccatatcaagccacctgctgctttccattgtcctcagtgacccccagacattcaaattatgctagttctgtgggcacaccaatcaaggaagtaagagaccagtttcttgggcagctctctgaaaagctggaatgttggaggcatgctctattcttttctcccagaggaaaaagatgtgaagaggcattctgtcttggcactgagctgtgctaacttgggggagaggctgatgcaggaccaatgaccttctaagaagaggaagacacaccaggcatgcacacgcacagaaaagaagaccatgtgagggcacagcaagaagatggccatctgcaaactaagaggagaggcctcattagaacctaaccctgcaccatgatcatggacttccagccttcagagttaggaaaataaaattctgttgtttatgccaccaaatctgtggtattcgcttatgaaaaccatagaaaattatacaatacccaacaagcaaatagcagaatggaattaaacccataaaggatggcttcaaaggcaatgcttaaccactatactgcctttaaaaattgtcctaacagttcaacttcaattacagaaagtttataataattagatgttaatacttttatgcttaactttatatttctatttcaaatgcttatttccttttcaatagttaatattttctggacagcaattctggactattttctaaattctctgttttctaaattcttatgtcatgccctctgtcataagaatgtttataccctatgatcttctaaaaataaatccttaaaagatga

SEQ ID NO: 231661 - DNA, 1091 bp, Homo sapiens
cagaagctggtgttccaagaagctagaatgacagactcatttctcgctcctttctccttccctcttgaaggagaagccttgagttgtgcatcttctcttgattttactgagaaggtgtttcactcttgttgcccaggctgaagtgcaatggcacgatctcggctcactgcaacctccgtctcccgggttcaagtgattcttctgcctcagcctcccgagtagctggaattacaggcatatgccaccacacccagctaattttccatttttagtagggacggggttttaccatgttggtcaggctggtcttgaactcctgacctcaggtgatccacctgccttggtctcctaaagtgctgggatagcaagcatgaaccgctgcgtctggcccatttttcttattcttaaacatcctactaaacattttggagctagttgtattaggaggtttattttctatgtggatggagcagtttaaaaaagctgaaataagtgaaatcttccaagtgatttaaaaaatttttaagcccatgtttctacctactaaaattcaaaaatatttactatagaagatgactagtcttctttatgacagttattttaatttaaaaggaattacaaggatataacttttcttgaaacatttgcacttaatcatgctgtcaattcattatatgatttggattacttgcttaatgtttctatttcttctctgttaatactaattactcctaataattataagaatgtgttattgtatccaatttagaaatcctgttatggaagctatttttatagtgtattatgattaatgcatacaatgtccatgtaaactttcaatttttaaatgtgacactacttatctattgaacacttaccatgtgctaggcactgttcttgaatgctttatgcataaaagcacatttaatcccatcatagccaataaagtattattaccttgattttacaaatgagataactcagatatgcagacatcgagtaacttggccaagtatacgtgttatggattgaattgtgtcctcccaatattcatgtgttgaatcactaacccctaatgtgactatatttgg

SEQ ID NO: 231662 - DNA, 373 bp, Homo sapiens
tctgccgcccgcaccgcaccgcgcggcactccactgcgctcgcctgccctagccgtttcatgcaatatcagaattctaaatacttttagaaactctgcctagagatattatgtaattttgaaagaataataagcatttctcattcattttagaaacatgacaggtttaaagtaaaagaataaaagtaccatttaaaaatgattatatgcatacagtaagttgaaaaagtacaaaagaatttgtagtgaaaactgtcaggttgggcacggtggctcaggtttgtaatcccagcaatttgggaggctgaggcaggaggattacttgagcccaggagttcaggaccagcttgggcaacatagacctcgtctccaca

SEQ ID NO: 231663 - DNA, 616 bp, Homo sapiens
tagagtagggaatattgaatattaggtggttcacagagtcattgggggagtgctagagatatagatttaagtccaagcttctgggaacattgcctgaaaccatgctgcagaactagatttgagaaagccagggatactgaacactaaatactagacactcagtttgattgcagatgctactgttgttgcctctggtgctgttccattgacaggtactccgcattgcaatcaccgggaaatggctagcattggctgttgccatcatcaaaagccaaatatgtctgccgtcttgggactgagcaagaaatggaagctctgctcattgcttacttctaaagcaaagcaaagtctcctggagttttttcttttctttttttttttttttgagggagttttgctcttctttgtccaggcagaggttggagttagcagagatcgtgccagtgcacttcagcttgggtgacagagtgaggccctgtctcaaaaataagaaaaaaagaaaaaaaaagcagcagcctgaggtgagaggattgcttgagcccgggaggctgaggctgcagtgagctgtgattgtgccactgcactgcagcctgggtgacaagagtgagaccctttc

SEQ ID NO: 231664 - DNA, 366 bp, Homo sapiens
gagccagggtctcactttgtctcctgggctggaatgcagtgacatgatcgctgttccctgcagcctctaactcactcctgggctccagtgatcctctcgcctgagtatatatatagtactacagtatataatatataggactataggtgtgagccactgcacttggttaatttttaagtttttttaatttttttaaatttataaaacattgctatgttgcacaggctggtcttgaactcctgggctcaagtgatcctccctcctgggccttccaacgtgttgggatgacaggcatgagcctccgcatccagccaggtactctcctttgagtcatatcattgaggagggactcctgtggcattttcc

SEQ ID NO: 231665 - DNA, 325 bp, Homo sapiens
ctggagggcagagtgaaagcaggggaaagctgcagcctttcttcttcgtcctccttggggagctaattacaggccagcagccactgtgcaggtgagctgtggacagcagcagcccaaggacgctatcagggatgctctggaggagccaaaggcagaaatgtgaaccttacgctgaggccacggagagtgagggctctcagaggaacccctgctcgccaccatcccggggaggggcctttctctctcccagaatgaatcccttgtaacctcctgggatctttcttttcatcacaagaaccaaataaagaaacttgaagatcttcta

SEQ ID NO: 231666 - DNA, 294 bp, Homo sapiens
ttaagagaggcacaaagggaaaaacaacaaagcaccaacgatttttacttattagaggttgctattttagcatgtttcagttcgaatgtaaagaccagttattcccataattcttaacccttactgcataggcagaatttgacttctaaagaactccagaatgtaagaaaactgttctttgataaccaaaactcaaagcaacactaaatatattttcccaattgcacaatttgcatttttgagggaaaaatggtttgtgtgtatcaacaattcccttgttttaacttacgcata

SEQ ID NO: 231667 - DNA, 519 bp, Homo sapiens
cttccatggacctaaaacacatttgaggaactgattttatgtccagcatttgagttcaatgacatcttctccattcccagtgaaaacattcaggtctttttttccactcaaaaagagatggccttactttatggctcttcctttaatcaaaatataaaatgcctgggaaatgtgagttgcagggagtcagaatattccagaagatggctccttccattcttcacctcttgccccgtctgtgtaagtgtttatcaggaaagtgcctcatgaggccaacattcttcatgatgggtcacatcttgtccattgatcattggatctgccatgttggaggatgcagccggtgggctggtttcacggtggagctgtgctgggtgatcaggtgagccccagcctaagcctgctgcctgggacactcaccagctcctggaagactctggcccttcctggcacacagggggccatcactcctctgataccttcccactgctcgtcagttttgacttcagaaatagcaca

SEQ ID NO: 231668 - DNA, 431 bp, Homo sapiens
aaaccacaaagatgaggggaaaccggaacagagaggctgaaaattccaaaaaccagaacacctcttctcctccaaaggattacaactccttgccagcaagggaacaaaactggatggagaatgagtttgatgagttgatagaagtaggcttcagaaagtgggtaataacaaacttctctgagctaaaggagcatgttccaacccatcacaaggaagctaaaaaccttgaaaaaaggttagaggaatggctaactagaataaccagtgtagagaagagcataaatgacctgatggaactgaaaaacacagcatgagaacttcatgaggcatacacaaacttcaatagctgatttgatcaagcggaagaaagggaagaaagtgactgaagatcaaattaatgaaataaagtgggaagacaagattacagaaaa

SEQ ID NO: 231669 - DNA, 465 bp, Homo sapiens
ccattttcaccccttccagagcccacagccagatgggttgtgggaactctcaactctgccctcccctcatggtcccccagaaaaggcaaaaggaagagactgatattgtatggtgattctgtgcttttccttttttattgttttcttcttccttttttggggggatgaggggagagttccatttttgactaagaaagtgatgatgaagaaggtgaccatgtgtagtggtttgtagaatggaagatcataagctcctgttttagaaaacaagctctggctgctttgtggagggccacacccgagtgcagtgacacaggagccagctaatctgtacctggattcctaacctggagaaactgaaatagcaacgcatgttgatgtaagtgctaagtttgggagtaatttgttatgtaacaataaataactaataatacttattatttaggcaataaaaccatagaaaat

SEQ ID NO: 231670 - DNA, 304 bp, Homo sapiens
tggaaagtaatcttgatccttgcataatagctatagtcattaacttggccaggtagtaagtctgtttcaaagcaggtgatgctaaaaagtatttgttcaaataagctatactcttaaagggttgttgatgaagcatagaaacaaagtcccttcacaacacattattaagcctttagactttattttcactttagtttcctgaatttgcatgacaagaacacttctagtttgcctaattctgttgcctaatacgtaattctttaacagattttttaataaactcgtgaatgcatttaaaaactat

SEQ ID NO: 231671 - DNA, 395 bp, Homo sapiens
actataaaagtatctaattcaagtttaacatgatagaattttttatttgtttctgtatttttatctcttctcttaacactgaaaatctgggtccttaaaaacagtaacataaggccgggcacggtggcttacgcctgtaatcccagcactttgggaggccgaggtgggtggatcatgaggtcaaaagatcgagaccatcctggccaacatggtgaaaccctatctctactaaaaatgcaaaaattagctgggcatagtggcacgcacctgtaatcccggctattcgggaggctgaggcaggagaatcgcttgaaccagggagacagaagttgcagtgagccgagatcaagtcactgcactctggcctggcaacagagcgagtctctgtctcaaaa

SEQ ID NO: 231672 - DNA, 426 bp, Homo sapiens
agctcaatcttctctcaacaatttgtttttttaagctgtctttacatcatagctcacagaatgacgagctggaagagacacagacaccacctagggtaacattctgattttacagataaggaaactgggactcagagaataaggctttcttcctccttatatcttatagctagttttttggtaagctaaaacaagaaccggggtgtcctgactcatagattggtgctctttccgttatactcccattttccttttcccacagatcagatatcacatttaagaactaaatatgaaaacatagcacagctgattttttttttttttgagaaagtctttactcttgtagcccaggctgcagtctgagattgtgccattgcacttcagcctggacaacaacaagagtgaaactcagtcttaaaaacaaac

SEQ ID NO: 231673 - DNA, 628 bp, Homo sapiens
ctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcagggggggtcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcgagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacag

SEQ ID NO: 231674 - DNA, 471 bp, Homo sapiens
aaatatcgctcggtcaatgattagacactttcagtttctccaagaggccgccctctcagctccataccctcctacctcagatcctttacccagcggttacctctcctgggagccctttcccctgacccttctcttagttaaccccaactcaccctccagtcttctcaactgtaacctcctcagggaaacaatgtcttaaaaaactcttgcagcagcttgtttatggtaaatacaattttcataatgtcttgtaattacatatttatattacattatatttttctttcttgcatataaacctaaatgtgaaaaattacattatggtttaatacctatttgtgtggctgttactgaggcctgtgagttgtctcagggcaaagactgggtctctcttgccccctgctgtggccccagcccctagcataaagccaggtccacagccgctttcaaaaaatgattgttgaatgacta

SEQ ID NO: 231675 - DNA, 434 bp, Homo sapiens
ccaggcctgccgcaagagctatctatccccgcagcctttacccagccttctcagtggcaccttgttggggaccgtgagctggtgggtccctgccttcctccccaggcctcaccctgagctcttgggtgtgaaaggcctggtgggctcagactccacccaggaccagggagcttcctgtggaaaaaacctaggcaggcaggttccctgtgcacgtggtacaggattggctgggctaaggtgccaacagagatcaggagaggctggacagtaaggatgttccctccatatacctgagtctggctggtcttccacattcagggccctggctccctgctccatggcgtgcttgtgattgagagtccacttgtctggcctgtagcttcccctttcccatcagccgcatcattacttactcaagataactagttaagtaa

SEQ ID NO: 231676 - DNA, 397 bp, Homo sapiens
ctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccataaaatatgagtgtgaaaatagttatttgtatgaaaatttagtaaaattaaagaaatgaaagtaagtcactagaggaaatctgccattgaattagatatgattgagacaactgtgaaagattggg

SEQ ID NO: 231677 - DNA, 214 bp, Homo sapiens
ttctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacag

SEQ ID NO: 231678 - DNA, 159 bp, Homo sapiens
gtagagacatggtctcactatgcttcccaggttggtcttaaactcctaggctcaagagatccccttacctcagccttccaagttctgggattccagatgtgaaccactaaccttgaccatactcctgtatttcttcattgtgtctttcaaaacagaaaa

SEQ ID NO: 231679 - DNA, 418 bp, Homo sapiens
agagttgggataggatttcagaatgcttgtggtcttactgttggatagacctgtctactggaagctgcaaagtaaataaaataaggttaaaaagcaaatgactccacaatgctcccttctgaatgtaggaggggagttaatttttaaaacctgcttctctcctgaatttttttccaaatgaaagcccagggcttctgtcacaccagtgcagtccttgacagtgctgaagtgacatggctaagggtatcagaggacctgcacccacctcagttcctcccatcccctcctcatactcagttcatgggagggtcactcaatacaggtggctccaagtgatacgttcctctggttactgccctaagcatacgtgaagtctacaataaagtatgcacttaatactaacagaaggttctgtaac

SEQ ID NO: 231680 - DNA, 435 bp, Homo sapiens
agcaaaacatggcagggctttggcccaaataccactgtctttctactattcatctgagtatagttaaaacaatgaaagtaaacatggtcttgttcacgtcattcctagatccctaaatgaggaggggaaaggaagggtgggggaagaggtttgaatcttaaaaagaggcaattatgtaacaattatgtaacatttaaaatatttaataatttttttttttttttttttgagacggagtgaaactccatctcaaaaggaaaaaaaagaaagtttcatgaggccataactttatctattttgttccttggtgtattactagcacctggtatttagtagtttctgaaatatttattgaatgaatgaataagtgtgcaagatcagaattgccattgcactccaggctgggcaacaagaacaaaacttcgtctcaaaaaa

SEQ ID NO: 231681 - DNA, 841 bp, Homo sapiens
gacccaggtggctggggtggcagctgatcatgtcaggaggactcctctgcacaacatcacaagcacaggagagaatgctaaacttgattgggagctcacagaagacccctggaacccagagcaataagggaaatttggacccagagatacattcagagagaagatgatgtgaaggcacaggaaggatgccctgtgaacatcaggaccaatgcctgcaaacctaggagagaggtctacaacagatccttccctcgcagccctcagatcgaactgaccctgcaagtaccttgattttggacttctggcttccagaactgagcaacaataactttctgttgaagccgtccagttttgaagccacccagtctgtggtgcttggttaccgcggccctagcaaacttgcctgaggctttccaaatcacagccccgttttgtcacaggggaagaattctaagaagttctttatttggccaagtgagggatagaagaataatgagcatttccctcatcacagctctgacaactgcctcagccacacacggcttaggagattggccacttcctccgccttcagcttgcagggggcttcagtaataaatgtgtagaagtgtttggtcttctcaatgctgggaatccagggagtatggcctggcatacatggaaaccagtcccctaaagacctcattgacacaggcctcatttgggggtctcctcaggcacttcccccttggctcctgaggccagaacccgaccctgctgtgtctctcttccatgcatctttttgccatctctgctctctggaatctgcaacaatatgagggtgctcaggactttgatgttg

SEQ ID NO: 231682 - DNA, 664 bp, Homo sapiens
  misc_feature (36)..(36): n is a, c, g, or t
cgggctgcaggattcggcacgagcttttgacagatnacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctaaaatctgtttttcaccagacgacgccggcccttccggcttgtcgtgcagcacggcattatctggtacccaccatttgtatcccggcatcatttatcttctccctaccttgttgccaaggcacgtgtgggtccctaacggctggaaacaccaattattcaagacaccctaagggagaccagaaggaaagcgatatttaagaaatgcaggcacagaaaaatttaagcattttagactcattctccatcagaaacagggaggtctttgaagaggctgcttttgtccagcaattagtcaatgactctagaatttcagcgcagatccgatgagtatagaggacgccgtgtacgccctgtgttgccatggcaacgcagcatgcacatcctcctcccttgg

SEQ ID NO: 231683 - DNA, 385 bp, Homo sapiens
gggctttgtgggagagaggtctgtgtctgggcaaacaacctgcttgtagaggctggaagaggaaaaggccaaagacacctgaaaagaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacagagcta

SEQ ID NO: 231684 - DNA, 356 bp, Homo sapiens
gtacctctggtagaattcggctgtgaatctgtctggttctggactttttttggttggaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacagagcta

SEQ ID NO: 231685 - DNA, 381 bp, Homo sapiens
cttatagaaaatattttccatggaattgaacaccaacattaaaagtaaaaaggggttgggaagaagaaacctaaaaccaatgaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacagagcta

SEQ ID NO: 231686 - DNA, 415 bp, Homo sapiens
cttatagaaaatattttccatggaattgaacaccaacattaaaagtaaaaaggggttgggaagaagaaacctaaaaccaatgaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagaccgatgcggccaatttcctttcttccacctaccgcgattgttttcgctccgatct

SEQ ID NO: 231687 - DNA, 321 bp, Homo sapiens
gggctttgtgggagagaggtctgtgtctgggcaaacaacctgcttgtagaggctggaagaggaaaaggccaaagacacctgaaaagaatggggcttggcccccagctagacgcgagatggctcgttttcagagaacaaaggagagggaagaagataggtgttccttgaacatctactatgtgagaaacaccacccagggcactgcacctgcctgctcacaaggaagatacataatgtacagccgaatctacagtctcctattttgtcagctgcttgtgttgattaaaacttcaataaagatcctgtgataaaacagagcta

SEQ ID NO: 231688 - DNA, 487 bp, Homo sapiens
gtaaatgcacccttgtttcatcagtgtgacttgctgtctaagctactgaagtctggcatattccttccctgagccccacctagggtcctgttgactttcttatatcctcaagattaaggctgttcaggaagcatcaagtcaaagtcattgacatgcttatttctcaactcatttattggaaattaattgaactggtacttctatgccagatagaagagagcctggggagtagcacaggaactcagattgcagctcaggattcaggctttgattctggggataacatagggagaaccgttttcctttttgatagcgttgctttttacccacattctctcggaagattgtcaaggaagaaagcttgctaatttatatatatatatatattttctcaaataaaaaatatatttgttaggcattaaagcatgacaatatcctaaaatttttactttattgctttacgtaagattgtatttttgagtcatcc

SEQ ID NO: 231689 - DNA, 233 bp, Homo sapiens
ctaaacggtgattccccaagtcggccactggagggatgacttgggggaccagagaggaagagcagagacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtgga

SEQ ID NO: 231690 - DNA, 251 bp, Homo sapiens
gcaataaggcaagaaaaggaaataagagacatacagatcattaacaaagaaatgaaactgttcctatttgcagaggacatgattgtctatgtagaaaatctcaaggaacgaagggaaaaaaagcttttaaagctaagtaaagtttagtcagcttgccgtatagaagaaaaaacagacaaacaattgtatcatatgtcatagcatgaacatatggtcactgaagttaaaatacagtaccattaaaattactt

SEQ ID NO: 231691 - DNA, 278 bp, Homo sapiens
caattgctttgtgctaagagagtgtggtcgatacgattccaatttttgaaagatgatgagatgtgctttatgggctggtatgtgatgaggttttgtaaatgtctccatgaattctacagctgtggcaggtgtaacgttcgaggtacggcaatcacgtcaggatcacgggtggttctgttgatgccttcttcacacttgtctacttggcctatcactcatggaaagagaggtgtgccaagtttttgctataatgtctgtcaaattatctatgttttgtc

SEQ ID NO: 231692 - DNA, 193 bp, Homo sapiens
gttccacttgcttgcttttgaatgataaggtcttaactttctcaagtattggacacctagctgaaataaaatcacaggcatggatatgaaaaatctaccttagtaaacacttgattaaaataaaagataaatccttggtaaattattgattatgatgctgttattttgcctctgcatcacgacataaacagga

SEQ ID NO: 231693 - DNA, 203 bp, Homo sapiens
ttcattttttgattttgttcaaagaaattagagatagtatttcagaagtgtctatttagatttaatgaaatcgtttattttatacttatcacatttttactcacttaggatggtttgaactatcagtttggatagaatgatgttgtccacttcattgaggtttggcttagattaatttgaatagataatgcccaatatcgctt

SEQ ID NO: 231694 - DNA, 197 bp, Homo sapiens
cggcacgaggctcgttggcctaggggtatgattctcgcttagggtgcgagaggtcccgggttcatatcccggacgagcccctcttcttactaaaaatcgaacaatgctttgactatccctttctttgtaaaacccatctattttatcatcattaccatttaccttctctttgaataaaatattcttgattgttttta

SEQ ID NO: 231695 - DNA, 273 bp, Homo sapiens
gagatggagttttgctcttgttgcccaggctggagtgcagtggcgcagtgttggctcaccgcaacctctgcctcctgggttcaagtgattctccaggagacattttaaagtctgtatttataggcatttttcagatgtgaatttctctttaataatgatgatgatgataagagtgttgattggccattaaagccagtcatccctggtatacctcctgtttaatgatctgattgcctgctgaatctggaaagtcttattttgtaggtttttgcc

SEQ ID NO: 231696 - DNA, 1238 bp, Homo sapiens
tgcagagctgtctgtctccatttcattttaggggaaggggtggtagtggccatacccaggccccttcccatggaaggccttatcttctgttccctaggacctggggaggccttatcacaaaataatgtggagggtgcttttggcagggaagtacaaaaggaaccagagccagctgaaaaggcaggatggctgagagatggtagaaggaggagagcccttgattttggttaatacatagagacagggtctcactatgttgcccaggctggtcttgaactcctgggctcaagcgatctgcccaccttggcctcccaaagtgctaaaattataggtgtgagccactgtgcccatctgatttttttttttcttcaagacagggtctcactctgttgcccaggctggagtgcagtgatgcatcatagcctcaaactcctgggctcaagtaattctcccatctcagcctcccaagtagctgggactacaggtgtatgccaccatgcccagctttttaaaaaacatttttgtagagacgggggtctcgctatgttgcccaggatggtcttaactcctgggctcaagggatcctcccaccttggcctcccaaagtgctgggattacaagtgtgagccaccgcgcccagcccttgctaacatttttgattcgccaatatgttttgtaaactagaagaataacagaacactgcaactttagaggttttctctcttggtcctaccttgtgtatgtagaaagttaatgtaagcttttcttctgctgcttttaagtaagaccctatgcatcccctcctgtgtttcagcccactggggcattatgctgtaaaggcttgcttgttgcttttagttgagaacttttgcaagattgtcagtgtacattttttatgccacttggaaacttatgtgactattcacaattgttatcaggttgttggggcctttaccataatcttgtacttagaagcagagttctggttttgttggacttcagactggaagctgtgcctgtgttctgcaaggataacctccagaaagaattctgtgaccctgatggtcttgatgattttgtgccaggttgtaattgacatcactgtaactgacaatgcttcttttaagcagagaaatattcctgaggtggctttgtccagtcacaaggggatctgtgacacttttgttttctatacgcatgataaaaaataaaaaattgcctgtctggggaaaaaataa

SEQ ID NO: 231697 - DNA, 447 bp, Homo sapiens
gttgaaatgtttttgggagaactgctggctgcaaggtatggtccagaaatggaacaggtcctttacctcttaccatgttttagactagttggttggttggttggtttggttttgattggttagttagttggtttgtgggtagtggtttgtgctgtccttgaatgtctggaatacagaggactatgctgcactctttgcagcagtgcagtattctggtgagagtgcaggatggaagtaagaagctcatctgcattccagatccacctcctgtttgttcaagaaattgggcaggtcacttatctcctgttgctcttgattttagcctttaaacattgtgttaataatactgtactttcctctctgaggttattttgaggatcaattaacataatgtgaagctgatatgaaggaaagaaaaccacaaattcacagtgactgtaaagataa

SEQ ID NO: 231698 - DNA, 505 bp, Homo sapiens
taatcatctttgcaagagttcccattgctcctcgccactttggatgcttgcttttgtggtgttttgcttttggtaaagatgcagtatcatcttctgaatcaaaagatcataagcattccaaaggcttgaaagcagagttgctctttagtggcagtcaggcatctgtcctgcaaagtgagatgtctgcaatggagtcagtagagttccaggagagtctgaaatcacagcatttcagtcgtcagttgaaatgccactaacacagaagttctggaatgcaacctgaattatttcctcttaaatagaaagtcccttgtctttttgactcatgactcttcaacaagtagattttcatttgctctagactaaatgtagaaccttcttccacatggctggtattgttctgttgagtttgttacaatagaaagtaaaaatatcacttaattaaaagaaactcccaaaattgaaatgagtgatattttctctttaaactcattctcctttattt

SEQ ID NO: 231699 - DNA, 441 bp, Homo sapiens
ggccaccccactctttctccacccatacacactggcacatattaaaaagcaaggattttttgctgtgcagaagctctttagtttaattaagtctcacctatttatctttgtttttgttgcatttgcttttgggtccttggtcatgaagtctttgcctaagccaatgtctagaagggtttttctgatgttatcttctagaatttttatagtttcaggtcttagattttaagtgcttgatccatcttgagttgatttttgtataaggtgagagatgaggataagactacaaattgggtgcagtgtacactgcttgggtgaagggtgcaccaaaatctcagaaatcaccactaaggaacttactcatggaaccaaacaccacttgttttccaaaaacctatggaaataaaaaaattaacataaaaataatacacttaaaaaaaa

SEQ ID NO: 231700 - DNA, 420 bp, Homo sapiens
agagcaggaactcttggatgatgaatttaaaaactataagagaatgtgttttcatgaagttcccatgagggcactcattacatgaaagctgggggcggtgactcacgcccacactcccagcactttgggaggccaaggcaggaggattgcttgagcccaggagtttgagaccagcctgggcaacacagcaagatcctgtctctacaaaaaaattttaaaaattagctggcatggtggtgtgcacctgttgtcctagctcctcaggtgactgaagcaggagcattatttgagcccaagagtttgaggctgcagtgatctgtgatcgtgccacagaactccagtctgggcaacagagcaagagcctgtctctaaaaataaataaataaatatatatatttttaaaaagtgccttctttgtga

SEQ ID NO: 231701 - DNA, 464 bp, Homo sapiens
ttggtggtgcttgctgcccccccatggtgctgagacagcggaagggtgcccatgagggccagaacgtcccgcctggcagagcagggtgaggagagccacagcaggtgaccaggagctgatccccagggcttcgcgcccagagcaacccccagcagcctgcacatggagcccgtctccatctcggcagcggaagctgtgctacgatgaccagaaggagcagcaccagcgttggccacatctctcctgattctcgcagctgccaggggcaggagggactggagatgtccctgggacaccagggagggacctgatcattcccggaggtgcagagggttcaggaggctgcagtgccctcaggacatccgtgggcagagcccagtgagtcccgcccaagacccctgaggccccagctccacatccgcaggccagaatccctgcagcccatcggcaccggcacccttcca

SEQ ID NO: 231702 - DNA, 1506 bp, Homo sapiens
cagcttgggcaacaagagtgaaactctatctcaaaaaaaaaaaaaaaaaaaaaaaaaagagttagaggtataaagttaaatggtgtttgaggaattgtgaatagtcaggtatgggtagagggtagcatgtttcagtgggattgggaaaagataactgaacatgtgagaagccccatcactataggccgtaggatgttttggggcattgttaaactgaactctctaatcaggtgaagtgacatgaccagaagtaggttttatgggaatattactggccactgtgagaaggatatggtgtaagggaaaggaacttcagtaccgatgggtagatagcaatgcatgaattttaggatagaattctgttcctaccacttactagatgtgtgatccttgggcaagcaagcatctttcagagcctcagttttcttatctgtaaagtagaagtagtaatacatttcccgcagactattgcattttgtgttaggggaaaaaatgtaaagtgtgtggcattgggcttggtgcatgaaaggtgctcagtataagataatatcttggataatggtaacgtcttggaagagacgagtttaaactaaggctgtggtttaggaatggggtgagatggaggcagacttaagagctcttgaaaaaggccttttcttggctttcataacatccttgctactttgactttgtatctgacaacatctcagtctttgcaaggatgctgtgttttaggtcctctttactcaccctgttcccaatttacatacatgtttgactgcctacttgactaccttggtatcttgaaggtatctcaaactgaacatatgcaaactgaatttataattgtctttaatattccttgtcttagtaaatgtcacttaccactacccatgccagaaaccttggaatagttgttgacatctctttttctcaattcctaatcacccgacctcatcatttctatttttttttttttttggagacaaagtctcactttgttacccatgctgagtgcattgggcgtgatcacgtgctcactacagccgtgacctcccaggctcaagtggatcctcccatctccagctacgtgggactataggcttgtgccagcacgtgcagctaatttttttttttttgtgtagagatgaggtccttctttgttgcccaggctggtcttgaactctggaacacaagtgatcttctggccttggcctccaaagtgctgggattacaggcatgagccgttgtgcctggcctacatttcaaatctcaaatccgtttccctccatccccactgcccccatcctaattgcagccatgatattgtctttgacttttgaaataccttcatgcaattttttgaatataggtatacttgcacatagtacaaaattgaaaagtgacagaaaggatggtacagtgaaaatcaccctctgtgcttgctttggcagtacatatactaaaattggaacaatacagagaagagtagtatagccaaatatt

SEQ ID NO: 231703 - DNA, 301 bp, Homo sapiens
ctaaagggtataaatgtaaaattaagtccttttactctctccagttgaactacctagagaaaaccattttaaatcacaatttcagaagattttaaaaattcatctctacctaaagacatcataaaatggctcattattccatcatccaggctcccctgtttctcaggcctccagactgaagctgaattataccaccagctctcctcagtctccagtttgcagacaacagatcatgggacttctcagcctccataatcacaggagtcaattcctcataataaatctgtctgccccctgctgt

SEQ ID NO: 231704 - DNA, 994 bp, Homo sapiens
  misc_feature (830)..(830): n is a, c, g, or t
  misc_feature (841)..(841): n is a, c, g, or t
  misc_feature (849)..(849): n is a, c, g, or t
  misc_feature (851)..(851): n is a, c, g, or t
  misc_feature (856)..(857): n is a, c, g, or t
  misc_feature (860)..(860): n is a, c, g, or t
  misc_feature (867)..(867): n is a, c, g, or t
  misc_feature (872)..(872): n is a, c, g, or t
gcgcgcggttccagggcatcttcttagcgtcgggcagggctgatgagtcaactagtgacagtggcgaggaagtgggggcgctgagcaagcgagaggaaggctgaagggagctaggaaaagggcgctgatctctgcagcctgggagggcttttgtctcccggaggaaggccagaagagatggggtcccgagggcagggctcacacagcaagaaaacgaggagcatgcctgtcattttgagcccacagagaacggggagcggagccactggaggaccggctgctcgggcttattcggtagccgaggcggttaaacagttcagggctggaccagccgggactggagcagggtgcagtctccagggttgctgggcagcaccgagaccctttgagcaccgaacgaataaactacgggagctttccacacttgcacattgttcccgcgagttgcagacgcaggttcctgatgctagcgctcattccttggcagtcaccctcagtgaactacacagttgccgtgaccttcaggatgaatgcttggattccaggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcacctgagaangtttggaaagntatttacnancaagnnganagattgnacgangaaagacaagaattagctccagatttggagaacaaatttcagtgcgtaaaacacgggctttgcgaaagggaaatttcatccgatttgaaggaatttgctgcatgtggggacattgtttatag

SEQ ID NO: 231705 - DNA, 941 bp, Homo sapiens
  misc_feature (777)..(777): n is a, c, g, or t
  misc_feature (788)..(788): n is a, c, g, or t
  misc_feature (796)..(796): n is a, c, g, or t
  misc_feature (798)..(798): n is a, c, g, or t
  misc_feature (803)..(804): n is a, c, g, or t
  misc_feature (807)..(807): n is a, c, g, or t
  misc_feature (814)..(814): n is a, c, g, or t
  misc_feature (819)..(819): n is a, c, g, or t
gcgcgcggttccagggcatcttcttagcgtcgggcagggctgatgagtcaactagtgacagtggcgaggaagtgggggcgctgagcaagcgagaggaaggctgaagggagctaggaaaagggcgctgatctctgcagcctgggagggcttttgtctcccggaggaaggccagaagagatggggtcccgagggcagggctcacacagcaagaaatggaggaccggctgctcgggcttattcggtagccgaggcggttaaacagttcagggctggaccagccgggactggagcagggtgcagtctccagggttgctgggcagcaccgagaccctttgagcaccgaacgaataaactacgggagctttccacacttgcacattgttcccgcgagttgcagacgcaggttcctgatgctagcgctcattccttggcagtcaccctcagtgaactacacagttgccgtgaccttcaggatgaatgcttggattccaggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcacctgagaangtttggaaagntatttacnancaagnnganagattgnacgangaaagacaagaattagctccagatttggagaacaaatttcagtgcgtaaaacacgggctttgcgaaagggaaatttcatccgatttgaaggaatttgctgcatgtggggacattgtttatag

SEQ ID NO: 231706 - DNA, 489 bp, Homo sapiens
aggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcactttgggaggctgaagcgggcaaatcacttgaggtcaggagatataaaaaaattagccgggcgtcataatgtactaaatgccactggattgtacaatttaaaaacagttaaaatggtaaattttatgttatgtgtaatttgccacaataaaaatgctaaaaaca

SEQ ID NO: 231707 - DNA, 523 bp, Homo sapiens
tgctcgcttccccacctgtaccaccacacaatctagtataacccttatgtaatttattgacctacgtttgtcttccctactagacctaattccttatgtggtcaaggactgttttttttaatccacactcaactagtgattgttgagtgaataaatgaacttaccctcacctccctgtcttcgctaatagcagcatgtcttcgctcttaagtcggttccttcaaccagtgttcaagatcccatcccctcgctagtctattaatagatcccatgggaaaaatgaaataaatttttaaaatcccatcccctcagttattctctgtgtgtatgtgtgagcgtgtatttatttatttttctttgtcttgcccccttcagctaaaatatattttagctaaaatatccaaaattctggccgggcgtggtggcttacttctgtaatcccagcactttggaaggccgaggcgggcggatcacgaggtcaggagatcgagaccatcctggctaacacggtgaaaccccgtct

SEQ ID NO: 231708 - DNA, 392 bp, Homo sapiens
ccggccgggcacgggaaggaggggcgaggcggggttttcatccaagaatgcgcatcggaacttttgctttttccttttttttcccccgcccctccgtcctgctgtttgtccgtggccgtgtgtgtatgtgtctccttctctcgctcttgcgacgctgacctggggggtgggtgggcaggggccgggggccacgtggctgggagtctgcaaccgcgcagggtgtgtgcgctgttgggtttatttaattctaagatttgtacaaatctccaatcgatctccgcctcagctcaagagtgaagcttcggtacctatcttctgcggtcgtgaatgtctgtatccaataccgctttttacgtgtttaaatatatactttgtaaatagagacatgtctt

SEQ ID NO: 231709 - DNA, 475 bp, Homo sapiens
actgctaccttaaaccccaagctcaggtgatcctcccacctcagcctcccaggtagctgggactacagatgtgcaccaccacacccttttgtatttttcgtagagatggggtttcaccatgttgcccaggctggtctcgaacgccactgcactccagcctgggcgacagaacgagactctgtctctaaataaataaagtaattggtagggcaagtatattaccttatttcttatgaaaattaatcatcttaataaatcaggtaatagtatttgtatccagtagctattgccacaatcaagtaatagaagtacaactatagctaaaatgagaaaagtaaatattaagtggggatatcagctgggcgtggtggctcatgtctgtaagcccaacactaggggaggccaaggtaggtggatcacgtgaggtcaggagttaagaccagcctggccaacatggtgagaccccatctttatt

SEQ ID NO: 231710 - DNA, 441 bp, Homo sapiens
ggaagctttgttctttccctctttgcaataactcttgctgctgatcgctctttgggtccacgctgcttttatgagctgtaacactcacggtgaagatctgcagcttcactcctgtgcccagcgagaccacaaacccaccagaaggaaaaaactccgaacacatctgaacatcagaagggacagactccagatgcgccgccttaagagctgtaacactcaccgcgaggatccgcggcttcattcttgaagtcgatttccatggggaaactgatgtagcaatgtgttaagaaatctgatgatatcatataataaagatttcctggactctgacctccatttctctaccaggaagaaaatacttcagggatcttaacccaaaagcatggaggtccacaccatcctccaggatactacagttgacaactgggatcccatctcctg

SEQ ID NO: 231711 - DNA, 477 bp, Homo sapiens
ggaagctttgttctttccctctttgcaataactcttgctgctgatcgctctttgggtccacgctgcttttatgagctgtaacactcacggtgaagatctgcagcttcactcctgtgcccagcgagaccacaaacccaccagaaggaaaaaactccgaacacatctgaacatcagaagggacagactccagatgcgccgccttaagagctgtaacactcaccgcgaggatccgcggcttcattcttgaagtcggtgagatcaagaacccgccaattctggacacgctttcatctatgtttccccaacccgttataagatagtagtgtgagtcttagcagattgcaatttatcagtgtcatattttattgcaaaatggtttgcattcacctgttgtttaatctttacaatacactcatgagaacataattggttttcttcagtacgtggaagaagaaataaaaacctgtggtgcagtca

SEQ ID NO: 231712 - DNA, 403 bp, Homo sapiens
gtctaccattctgcacagggccaacttcagggcagctgtccggggctgcagatgctccctcacaggccaggtggggctttcagctgtgacaaagtctggatgtccacccctggtgaagccactaggaggctgtgggggagccgagggtagtgtccaggagccattgagtccatctcaaggctctctctcctcttggatagtgtgtgcccgtgtgcatgtgtgtgcctgagcatatatagggtgccctcagagagtgcattgggtgatgatgactgatgtgggcagtcttttctttgatcaatggaagcaaaatcatttatggcccacgctgagcttccttctctggtttcctgttaaacacagcaaatgtgtgtctccaataaaaagctacacagcaacttaa

SEQ ID NO: 231713 - DNA, 587 bp, Homo sapiens
aaatggtgttaggtgattttgtcattgtgcaaacatcataggatgtacttacgtaaacctagagggtagagcctgcctcacacctaggctccatggtatagcctgttgcttctaggctacaaacctgtatggcacattactgtactgaataccattggcaattgtaacacaacggtatatcaaacatagaaaaaacagtaaaaatataatattacaatcttaaggggccagtcatatatacagtctgttgctgatcgaaatgtcattatgttacacatgactgtatatgagcagaaatcaataaaggacaaataatagagaaaatcagcaaagctagaagttgattctctgaaaagattgataaaattgatcaagacaaaaaaaaaagaaaacacagactaccagtattaaaatgaaagaagcatcatgataacgtacgctacagaggttaaaaatacaatgttgaattttatcagatactaaaggaagaaataagacgaattctagacaaactcagaaaatagaggaggagggaacacttcccagctcattttttgaggccaccataattctgatacccagtcaag

SEQ ID NO: 231714 - DNA, 441 bp, Homo sapiens
ctctttggagagcatgtaacatgctgcatagactggtgaacccaaggatagacagaagaaacattatcctaatttattcaggtaagaagagcttttaaaatcatattcacgctatgtatatagagagtctataacatgtagggcagagtggtggacaatgtgttcacagaaataccacagtaacactgtcttgattcattcatgccactagcgctcttagaaatagcttttatacatggcttttagagggcatatagcacagagtgcttgatatgctttggatctatgtctgtattagtccattcttacactgctataaagatactacctgagactgagtaatttaaaaagaaaggaggtttacaccatggcctgtgtatacctttgtaacaaacctgcccgttctgtacgtgtatcccagaatttaaagtataataatta

SEQ ID NO: 231715 - DNA, 219 bp, Homo sapiens
aatgagtctgaacatggcttatggggttttgaaggatctggctctagtctcatcttgacatcctttttctcttgcttactacgctctagccactccagtgcttttcatgcactggggctgttgtgcatgcttttatctttgcctggagtagttccctggtatccatctcctgtttattttctggtcctcagtgtaaaagccccttctccttatcttcgc

SEQ ID NO: 231716 - DNA, 286 bp, Homo sapiens
agatagaatggtcttgtttaacatcaataccacaacattcaggaaggaaataaatattaggacttcagacttggaatcaaaagactccacaactctttggacttagaattaaagactccaagagatctgagtctcaatctcctcttttataaagtgagaatacaagaccttgctgacaaggtcattgtgaagataaatacaagtaatgtacaagtaattgctacatagcaggtgctcaaactgtattttctccctccctccctccttctttctttccagaatcaca

SEQ ID NO: 231717 - DNA, 1520 bp, Homo sapiens
attggaggctcccattccatgttcatgaatactgtgaaaatgtgacatcctgcattgccaaggtagctgtctgaattatatgaatacaaggagatacagggtttaatgatcagcggcaatgtcaaggactggaatcatgacaggaacaagtactgcttcctaaaacacagtgtaaatgatttatagttgaaaatggcaatcacttcaatttatattgatgaaaatagaattcttttagaaagtctctatttaaaaaaaaatatgcctctttcagtgatgatagctacatgactaccccatattaccagttgaaaattaacattaaaatacctttcacctacataatctttggaatggatgtggaaaatattcagattaccaaaggttgtaaacacttcaatcgtaatgcttttttttaacttggctagtttcttatacttaaaaaaataaaaataactaaaaatacacttaaaactgtctatattttataaacattaattaggtaaataggggaggcataagaatagtggaaggctttgtacagaaagattcagtgctcttagtaaatgtcagtaaggtataatgagaggagagcagtgttacaattgagagcagctagattcaaatcttcatcaccatacactagctgtgtggaattacgcaaatcattgtatccctttgaattttactgtcctactcaaaaagttgagatgacaaatagaactattggttaaaagtttctagaagttttcatgtcattgtaaatgtaatatgctacgtagattattttaaagcactgcgaaactgttcaacattttcattaacaatattagctaaaatgtaattaatttatcaaggaataaataaaatatgttaaacccagtgtgaagtccacagtaggtcttcgataatggtgataaatgaaagttgtattgaatatgttatttattgtctttatttttcattaaaaaatctgctaaatgttgaatgatgagtacttcaattcatgtaaacaaagttaactggtcaaataaacattaaaaatattaagtgatattgatgctagtaatatttgttcaatgttgtagtggtaatgtataagttgtagtaataataaaaatttatattaatgccttcttatgagaactcaattcaacatttagaaagagtcaatcaaaaaataacctgggattttatctatcatggtttatcagatattgtttgttttatacaggaatatatatgtgtgtatatatatataaaattctgggaaagagaagaatcttgattttgttctctttgatttcccctgctgcaaagataatgtgagtttagggtactgtgtatatattttattataaattacagtcataagctatgtataaaatttttgagaaaggaaaaagtgattaatgcatagcataaaatgtacatatacaattattttatatgtaatttatagttacatataattgctaatacatatacagttgaagccatttcatagtctagctctgttg

SEQ ID NO: 231718 - DNA, 571 bp, Homo sapiens
atgtactactgtaataattatatacaggttgagtatttcttatccaaaatacttgggaccagaattgttttaatttccacttttttggattttgtaatatttgcaatatatataatgagatatcttgagtatgggacccaagtccagacacataatttacttatgttgcatatacatcttatacaagtagccagaagataaatttatggtaatatttttaataattttgtacatgaaacaaagttttgactgtgttttgactctgatccatcatataaggtcagatgtgaaattttctacttatggcgtcatgtgggtgcttaaaaagttttggattttggagcatttcagatttcagatttttggattaggggtactcaacctgtgttagtaaagagttcagtgtccaaagatgtaaagatttcttcctgagtgtatcagtaatttaaatccaaatctcatcaaatctgtcaatttagaaatgattttggaaggcctataactaaaataagacaattagaatctatgcgtatgtgtgtatatgcaatgaaaacatgtttaatgaaatttt

SEQ ID NO: 231719 - DNA, 355 bp, Homo sapiens
gggaccctggctctgaggctgcgggcccggagtggggaacgagggcagagcgccctggaacgcagcggccgcgcgcctcctcccttgctgcgtggactgggcgctaacggcgcaggaggcgcacggggccagggatgcggggaccgttggcgcggacaagggtggcgcccaggccggtgcggggggtggtggagacaccaagcggggagcgccgaagggctctcccggcaaaactgatggagtcaacctgaggcttccgggcttgccaggtgaagggctgtgctgcatcgcacgcgcttagcgaagcagggctatccatggctaaaagagaaaaagaaatcaaaagtattcgatt

SEQ ID NO: 231720 - DNA, 1014 bp, Homo sapiens
ctacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtg

SEQ ID NO: 231721 - DNA, 98 bp, Homo sapiens
tgactcacccaggttgtgtgtaaacagagctctgattcaaagtgactttgacctgttggaaaaatagttcctggccgggcacagcggctcatgcctgt

SEQ ID NO: 231722 - DNA, 460 bp, Homo sapiens
tctaatcaatcaagaatattttttgattctcttaagcagggtgatgatgcaatcagatttggaattttcaagttatctttgcagtagcacaattgaggattggatgggagctctgaggcaattaaaatcaaccagtatcctaaggaagtggcaggaaatagggaggaaggaagagacttaaagaatattttccaaggtagaattgacaggttagtgatagatagaatatagtagtgagaacgtgggagaatcaaagaaaactgaggtatttaatttgggagactgcataaaaaattctgcaagtcaccaagggctggaagatagtgtggtagagtgataaggaaaatgagcttttgaactagatgaacctgaattcaaatcctagaaccagcttttcccacctgaatgttcttgggcaagttattaactaacctctctgatcctctacttcttatatata

SEQ ID NO: 231723 - DNA, 386 bp, Homo sapiens
gagaggttcccagtgactgtcagtgaatgatatccttggttgatttgaatagttcttcatgtttatgaacattgagaagctaatattcatagccaaaagcactgggaatgttttttcaaagtgttttctggcttgcactgtagacggctttgcctaggatgatatttcccttgttatttgtcaaaatgcaaagataactctttcatagataattgccctatgtttatttatgttgtatgtttccatgtttgatcactattgatgagtttgctggctctgagttgattttcattcagatttttaatgctaaataaaataccaaaaataaaataagtaaaataagggatggtttaaattttggaccttaaataaaccaatttaagaac

SEQ ID NO: 231724 - DNA, 101 bp, Homo sapiens
attcttagtttttcccattgttgattttctgcttctacttcctttcttccagaatgttattgctaatgtttcttctcgtattcttgtaaggttgtacctga

SEQ ID NO: 231725 - DNA, 641 bp, Homo sapiens
gcttagggaggcatctgggtcatgcatgttaatatccttgggtaattccagaaatctctatgaagggaaactcctgttatttatctagacttcctgattgcaaggggtttgggcatcatgatttaggggtcttaataaaattattattttatttttactaatagataatgtctgtgcctatcagataaaggcaaaccagtgctcagaggaacccaaccatctctgaattgagaccagagagctgtctctatggattgtccttagagaaggcatttcggaacacagtaaacagcagcctggtgactccggttagtaaacgcagcaaagactttcatagggatgtttttcttatatgcctgtcagtattagccagtagccaatctggtgtgaaagtgagtaagtttaggtagcaaaatgtggagggggtgatatatagttttttgctgctctggcttaatccaagatgacttttaaatgaatgaatcaacattcattgggctgtccttccataaatatgattcttctcaatcaagtgtttaataagtcttaagtagtggtaagttgaaattttactagttgtatctggaggtcagccattctttatatcgcatgcattaagcttttatagtcagctcaattca

SEQ ID NO: 231726 - DNA, 391 bp, Homo sapiens
cagagaaacacaggtcatatgtgtcttttccacacatacagtggacaaggggtactactgtatactctgtttgaactgcccgtcatgttttggtcctgaaatcatgctcttcgacactgttcattcatcacacctgttctgctaacaataccatttttagtcaatctcacagggtttggctaggataacttgtatactgcggttcacttgtagatatcaaattttataaatttattcttctttgcatttaataaatacaaagtaagggaagtaagagttcttactgcattaattatctactaataggtataattaatattaattctaataaggtcccggttatgctcccaaaggaatgctatataacaaagcatcagtcgtatgctttaaa

SEQ ID NO: 231727 - DNA, 645 bp, Homo sapiens
gaaggcccacacacctgtggttggaacactttgggagccgggagtcccagaccagcctggacaacatggcgaaaacccacctctacaaaaaatagattagctgagtgtggtggtgtgcgcctgtgtcctagctactggggaggccaaaggacgagaattaattgcctgagcccaagaagtcaaggctgcagtgaggtgtgattgtgccacagtactcaagcccaagtgacagagcaagaccctgtctaaaaagatttttttaaagtcacagaagctgggcgtggtggctcatgcctgtaatctcagctctttgggaggctgaggcaggaggattgcttgaggccacgagttggagaccagcctgggcaacatagggagaccctgtctctaccaaaattaaaaattagctggatgtggtggcacatgcctgtagtgctagctactctggaggctgaggcaggaggatcacttgagcccaggggttcaaggctgcagtgagctatgatagtgccactgcaccccagactgagcaacagagtgagaccctgtctgtaaaagaagtgttattaattgaaaaaaagatttaacaggctgggtgcagtggctcacacctgtaatctcagcactttgagaggtggaggcggg

SEQ ID NO: 231728 - DNA, 360 bp, Homo sapiens
aaatacttaataaatactcatttttttcttttacccccagtgattccatttttactgatgcccaatacactttacctcaaggacctacttttcctctctttacccaaactctgctcttttaaaaaaggtaaagatagctatgcatataaaattacgcaaaagcctctggcagaaccacatggcttttagtaacttcttagttgttgttgcagattgtagaattaaggaagtcagcatatagacagacttgatttgctaatcagacaagttcatccaccctggtaaaaatgtcaacttaatttaatgctcttggtgctcccttttctgttgaaattttaacttctctttgaaaaaaactat

SEQ ID NO: 231729 - DNA, 472 bp, Homo sapiens
  misc_feature (27)..(27): n is a, c, g, or t
acagaaaaaaattcatgaaatgtattnttatcttcttttttcttaaaatggaacttaaaaaaaatttttttaactccaacctaccttttacaccatctgcagagctttcctctcccaaatcaaagctactcctgttcctacctccaggatggaatccccaccttcgtatgcaagggtcttcatgatatggcctcagccaactatcttagctccaggtcacggccccatcttccatatcctatgctgcttgcacaggaagcagctcgctaaccccaggcacacctgctttcatctggagcgtctgcccatcatgattcctccccctggtcccttcacctggaaaactcctattcattcctcaaagcccagttcagatggcacctctccatgacttcatcagattccctacagaggtgctgattttctggtctcttgtgtttctgttgtaacacttaacatgctgtattataat

SEQ ID NO: 231730 - DNA, 305 bp, Homo sapiens
cggcacccacagtgaactcataggaatgccatgggggatttcaccaaagacatacaaatggccaataagcacatgaaaagatgctcagatcattaggcagtaaggaattgtaatgaaatccacaatgagacaccattgaacacccactaaaacagctgtaacaacaacaggggcagaccaaaactaatgctggcgagggtgtggagaaaccggaacctcgcacattgctgatgcgactgtaagcctgtgcactttgggaaacagttggcagtttctcaaaacaatcaaacataaactgccatcag

SEQ ID NO: 231731 - DNA, 351 bp, Homo sapiens
gatactcctcagtgtatgatggagttatggtccaataaacccatcatacattgaaactatcgtaagtggaaaatgcactttcgacttagaatattttcagtttacaatggatttttcagatggaattatcaggacataaccccatcataagttaattgagaagcttactgaatgcatatcgctttggtaccactgtaaatcaaactattgtaagttggggactgtctgtatttgaaatgcttagtttaagaataatgtttttcaaccataactatcatggctttataggacatcagcattcaaaacaggttgtttttgaatttggagtcggtacagttggtgcaggcccca

SEQ ID NO: 231732 - DNA, 194 bp, Homo sapiens
cattataggcagagtgtgcacaggttccagataaaactgctcaaagcaaatggattaaaaaaactgtccaagagagtctaagaacttgttttatgaagagtcttggctctccaatggtgagtcccagtctgaatttattcaagactgaaagaagttggagcatgtctgtgcaagggtatttttcaagagatttt

SEQ ID NO: 231733 - DNA, 219 bp, Homo sapiens
tcctaaataaggtaaagtctgtggtgaactgaatgtcactaaagctcagatctagatcaatataagagtagattgatcccaaacaaaatactaatggcctaatagaagaaaaggtattctcatttttggacattgacataatttacttcagtttctgttcttttacacatagtgacttgccttcaagtagaaattagataaacaacaagaaaagactta

SEQ ID NO: 231734 - DNA, 188 bp, Homo sapiens
taagggaatcaatattgtgcctgctcccaagactaagacatacatacatatcacagtcatagggaataatcaaataattttcacaatgaatgatcagattgtcctataccatcagcaaatgggtgttaattatgtagtataaatagtaactgtaaaaagagagaaaatggagtttgctagagtcacca

SEQ ID NO: 231735 - DNA, 385 bp, Homo sapiens
gttggggctttttctctttacagctgttgtcatttatgggttaccatcttctttagttctaattctgggatatatgaaccaagaagaaaccccagaaaactcaccgttatgttgtttatcaggtcccagtgtcctgaggaagtttttttcttcacatttcggagtcgtcttatgtttgttttatgtataatgtcttagggttttaagttatacttaaaatgggaagaatgggaaatatatctattccttcttcccagaacttgaagtctccagagtaagcttttaaagtataagtctgttgaggtcacagcttcaacatacctatcttcagtggatcctcattgcctccaggataaagtagaaatttctcaattctaatacaagg

SEQ ID NO: 231736 - DNA, 461 bp, Homo sapiens
tagtcttacaggaaaaacctgatcacagaggggaacactatagtgaagcaccaatacttttcatcaaaaatgttcaagtattggcaatttcatgtgtttcaacataatactactagccctcacccaaccacaggttacagagtgcctggagctgctagaataggcacaactgttctcaccatatgcaaggctcatcctcctccaaccttctcaatacatcattaccaattatcaaatcattacatctttatgaaaaagacttggcttatatgacacaggcagaagtgccaccctttcacaacattatgaaacgatgccaaataaggctagcacacctgccaccttttgcatttactgaagagctcttatgcatggacccacttggcctgtctcttagtcacagaagggggcatggggcagcctggctcggaacacctgtgcctgctgatagcagacgtgcc

SEQ ID NO: 231737 - DNA, 520 bp, Homo sapiens
atcttccagcctagggctttcttctttgcccatatttgctattttcaccttgctccttaaatgaggagacctagcagtgcaatcaagctattgtctggtaaaaagaaccaaaaatattcagcatttgtgagagaaattattgctccactgttgaggtttagaatgcaggattcatttggcctattttccatcctcaagaaacgacagcactcacagatttacatacttgattcttgtcttaaatttcctggaaaagtaaaattaatgattacattgacatcatcgaagcagcatgtttctcacaagattttatactaatataccaaaggccagattttaaagctgtagcaatatttttccatatgcgcaaagaaagcaaggtccggcatttgaaaacaaaccaaaccttccctcccagagtaggaccaacaacagcccttcacggtcagccacagagctcttgctcttgctgccaggaggcaacatttacggttaaatctggagttgtacaaagcggccg

SEQ ID NO: 231738 - DNA, 855 bp, Homo sapiens
cataattttctatctatggtacccttggcttctgcctggcttctgaggcttagggaagggaggaagggacctacaaagagccagggtacacctgcctcttgtgctgagggcacgtgccagcttctctgccagtaagccttttgctagctaacatttcccaccctcccaaggcccctaacctgccctcccctctccactatgttagtatatctacctctgtttctgactctgaggaagggtcaggccacacggagggaacagtagtgggtaccagcctcccctctgctgtccagtccaccacatcaatctcttcctcttcagagctggcaggaagtgagcctagtagttcagagtgaccagatacctccttgcctgccttgggagaagggtataataactcatctgtagtcaaggagacttccagcccagtctccacccagtttgagcagggaggtgagaggtccccataagacctctggggagtatcaagggagctgacatggagaagtttgtcttcctgaccatccagtggctgggagctggtaatttcaaggtctggtgtccaacggcctcctactgaaagcacttcactcacctcagagggcatgacaagggggctaaggagctcagttggccctctgttctcaccagcaggttccttttccaattctgtgagctccctgggccagagttccatgtctggtagacaccattcttccccttcaatccagttctttcctgtttctgtcagatggtaggtaggcgttctgcagccctcagcccctggactctccagagaccctataggtggttcaatgtctgagccacagagcatgaagtccaggatctcctcca

SEQ ID NO: 231739 - DNA, 458 bp, Homo sapiens
agagggtctgctggacacacacacattaggccacctctcctagggatgtcatgtgtaagactcgggggttggtggttggtgtcctaacctgattcttaccttctggatagtcatctggcttctgcagaatatatgtagttatgtagtctctcacagcagttggaagagttggcttccttaattttattattttaatgaaataggagtctaagcactacaatttctgggaggaagaaaaacaagttatgtgaaaaatgtttttatttgttgttcacttaagcaaaggctttttttgagttttaaacattttgatggatttatagggcttctgttcttaaaataaactaagtttggaaaggtactcttaccagcagagaacattgctcccagcctgctgccattgcccttctctctgaaccttctgtgctgctgaaccaagatcactcctcatacccctg

SEQ ID NO: 231740 - DNA, 362 bp, Homo sapiens
gacagttcttaggaaaggcaaatatcccataaatcctatttgcctctctttctcctaacctctggctccaccaactccccaacaggcctcctgcacacacaataggagtcaggagggaggaggcaggactgtgctacacaagggagatgggattataggcatgcaccaccatgcctggctactttttgtagagaaaaaaatttaaaaaggtctcactatgtggcccagagtgttcttgaattcctggcctcaagcaatcttcctgcctcagtttcccaaagcactgagattacaggcatgagccaccatgcccagccatgcggttgatatattaagcctgttttattttttattttttcttc

SEQ ID NO: 231741 - DNA, 482 bp, Homo sapiens
actgcccacgtccatccaccaactcagccctctaacagggccctgctgcctatgctgcaggtgaggcgtgaagacaccagggggctggggagaacagaagggagggaggctggagtgccccatgatgtgaaaggtcgggtgatatctgagagctgaaggaggttaagcggatccatgccaggctgacaaggggaacaggtgcctctgccctggactggagcctacgcaaccatcttctgctttatctagctgctgtctgtctcctgtctctgcgtgagtgtgtgtctactgagggctctgtagagccttgtctttaaaaacttatctgcactaaagcataaaatagttttgctgatatttgccgcatagagattaatttggcaggagtttcacaagaattattacacttttcagatttttttttcatgtttatttctctcccagtggaaataaatgtctctttgcatttatatgtaagagta

SEQ ID NO: 231742 - DNA, 463 bp, Homo sapiens
tgctgggcctactacattaatgttatgggtcactgatgggttgtagatatcagcagtctgcattatcaataactgccaccttaaacataatacaagtgaccgtgttatctgctgaactgtaatcttacctcattcaagtttcaagtgtgggggtggggaggaacagatgtatacatatacgcacacacactcagatcatagtgaggttatactcataatttgttacatgaatagggatcctatcatgtaactcttgctcacttaactcatttggccataaacacttgaaatctgtaaactcagatctcatgttaaataaatgaagattgaacttactgtaaaatagtgtattagcagtaggtagtaggtgcctatatgggtccatgccctatgtgcttgtatgcctgtatgggtagaactcaacagctgtcctttataataaagaccacttcttaatcattta

SEQ ID NO: 231743 - DNA, 421 bp, Homo sapiens
cagtcgtcatctgtgctggattacattggttcagctgaccatggggaggggaaactcctttagtaaaatgaatgtatggttttaagaagctgcaagtactagttggggccgtccatccttgctctttggtgttttatagagcatcggacaaatttcggcagagaagctctgctctaggaggacaagattcccagttcatactggactctttgtcaaagtcctcccaaactaacttatctcagttaacagatttccagtctgaggagagctaggaaggataaagatacttttctaaagtgtagatttgcctctggtttgacaaatcttcacagggcatcagaaggcaagcgtcaaaagtaatggtttggggtgaacttgacctagttacactagtaaagagaggactagcaatagaagggga

SEQ ID NO: 231744 - DNA, 123 bp, Homo sapiens
ttctaaatctcccaatatgcatgcttcaacaaccatacttctgggctaagcctgccagtcttcaagtcacacttgccaacctaattacaccaatcgccctgttctccctcctcacgtgactgt

SEQ ID NO: 231745 - DNA, 512 bp, Homo sapiens
aaaattctttgaactgaaggacaatagtgacacagcctatcaaaacttctgggatacagcaaaggccacctttcctcctaagaggaaagttcacagccctaaatgcatacatcaaaaagactgaaagagcacaaactgacattctaaggtcacacgtcaaggaactagagaaacaagaacaaaccaaacccaaacccagtagaagaaaggaaataaccaagatcagagaagaactaaatgaaattgaaacaaacaaaaaaattcagaagataaaaacaaaacgctggttccttgaaaagataaataaaattgatagaccattagtaagattaaccaagaaaaaaagagagaaaattcaaataacctcaataagaaacaaaatgggggcagaaatacaaaagatcattcaaggctactatgaacacctttacgcatataaactagaaaacctagaagagatggataaattcctggaaagatacaaacttcctagcttaaatcaggaagaatta

SEQ ID NO: 231746 - DNA, 292 bp, Homo sapiens
aaaccaagatgaaggtcacatagcatctgcagactgggaaggtaccactgatgaagctcagaaatggtctggaagtcatggccctgaggatcccccatgaggcacccaagaataggacagttatggttctgcaaccaaacagattgatgctattactgtgtgactttcagcaaatctcttgacccatttgagactctatttccacatcagagagccgaatgatgtgggctcaggccaggctcagtgcctcatgcctgtaatgtcagcactttgggaggccgaggcaggtgga

SEQ ID NO: 231747 - DNA, 417 bp, Homo sapiens
acctagatggtcatcagtggtgggctggataaagaaaaagtggtacgtatacactatagaatactatacagccataaaaagaacaaaatcatgtcctctgtagcaacatgaatggagctgaaggtcaatatcctaagcgaaataatgcaggagcagaaaaccaaatattgcatgttctcacttatgagaaggtgctaaacatagagtacacatagacatgaagaagggaacaatatacacaagggcctatctgaggatggagagtaagaggagggtgaggattgaaaactacctattgtgtactatgctcattacctgggcaatgaaataatctgtacaccacatccccacaaaacacagtttacccatgtagcaaactggcatgtctaccactaaatctaaaataaaagttgataa

SEQ ID NO: 231748 - DNA, 579 bp, Homo sapiens
gatatttcattccacctgccacctccctcccgcctcggtcgactctctcctctgctactttgcttgtccccactttaacacaaagagacagctctgtgttcacagcacctaacagtgttgaaaaagaatgctatttaaaacccgagttgagacatcacctttccaaacccatgactgcttcctggctcactaaacacgaaccagaaattaatgctgcaaagagcagagacaagagattcgactgtgttagccaggatggtctcgatctcctgacttcgtgatctgcccgcctcagcctcccaaagtgctgggattacaggcttgagccactgtgcctggcttcaggctgggatttttatagcttattatggcaagggaggagacggagagtaaaagaagaaggaagagcatacacagtcaccccttgtgtgacaaatatgcaagaaataaagataaatgtgtacaattcttacaattttacttttctgaattttgctattgcactgaatgatttgtgataagacagatggggatgaaaaatatacttattaaataaacagctattaaaagcccctaaaa

SEQ ID NO: 231749 - DNA, 528 bp, Homo sapiens
gacagtggggggccatcttcgagaacctgaaagacacgcgggggttcctggtctgtttcatggcccttactgtccagtgcaaaggcaaacaggcctagctgggggaggatggttggtaaactggcccccaggataatactctgtgactatccagttaaaaaataagaaggtgacaatgacccatcaaccccacttcacttctttcaggatgctgtagggaggaaaggtgcttccatgacctaacctcggcctctcctttcttccctcttcactcacacacatagagctaggcctttatactactgattttgaaggacagttttcaatgtctaatcatctgtttaggtgtgcagtggttgaaaaaagaaagctgagtgctagaaggaacatgaacctcaaccgttacttattgttctcattgtaagatattttaaccctgtataaatgcaacttttcctttagcttaatggcctggggtggaatattaaaaatatatattaaaaatacagtaaaaatccagaaaaatgt

SEQ ID NO: 231750 - DNA, 725 bp, Homo sapiens
cgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgcgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagttccagctcagagcagtgccagccccaccgcaactgcacggccctgggcctggccctcaatgtgccaggctcttcctcccatgacacgctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacg

SEQ ID NO: 231751 - DNA, 1271 bp, Homo sapiens
cgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgcgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagttccagctcagagcagtgccagccccaccgcaactgcacggccctgggcctggccctcaatgtgccaggctcttcctcccatgacacgctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgcacagctactgggagggcagccggggacacctgagccgcccgctgtgcccagatccctcaggctgcctgccatcagaactgctgcccggggcttcccctacctcagacagaccctccctgggaggatcagtggggagtgccacctctgcccccagtggctgtggcacgtggcaggggcccctgaagctcagcgagggtcagggcctgggagggtatcattgctggaagaacaggatggggctcaggccagccctagtcgccggggcccacactaaccccccacttatgaattcctcccactcccaactcacaggggatttcccgagaggggacctgccaaagacctcctccaggcctcccatgcttcccgggaagtgaagcttctccccctctggggcaggctctgaagcctcccgatgc

SEQ ID NO: 231752 - DNA, 494 bp, Homo sapiens
acagggtgcagtactgaagtggtgagagtcactacaagaactccagagatctgcagaagatccttgtcatgtttacagtagagtactaatcagtatatgaatatgagggagctacccaaggctaggaaaagaaccactgaaaaggtttagaagagggaagactgtacgcagttctcacaggaataggaatagtgccttttgccacctaccagactagaaaacctcactatttatggggcattgggtacaatgttttaaaagatcttgcatcaatagtgtggaatccttagccctaaacttaaatggtcctgtggttctgtctgacatatcttaaaagcaagacctgaaaggattaaatcgtttccaatttaactgcaacccagaaaaaaagcccaggaatctttatagtaatacaaacatgttcagcacctcacaagataaaattcacaatatatgacacccagtaaaaaaaactagcaggcatggaaacaagc

SEQ ID NO: 231753 - DNA, 487 bp, Homo sapiens
cagctggaccctgtatttcctctgccatccagactgactttctttgggaaaataagaaatgtgatatgaaatcctgagtcccaccaaaaacagttcatctaatttcagtgtgatcaaaatggagtagctaaattcagtctccttcagcattcagtgcaggatttgagcacctgctatgagtcaagtggaaactatgtcaggatgccaaggatgaggagagaaatagacagattattataatacagtacaataacagctctcattgtgtctctctagggacagtggagacagatgaaggaagggcagaaaaagaaaaaaaaaaaaaaaaaaaaagaatttattcttaaatatgaaaaactcaaaggtgagcctagatccacactgtccaatatggtagacactagccacatgtggcaattgggtacttaaaatgtggctagttcaagttgagatgtgctcaagtgtcaaatacataacagatttccaa

SEQ ID NO: 231754 - DNA, 599 bp, Homo sapiens
cagctggaccctgtatttcctctgccatccagactgactttctttgggaaaataagaaatgtgatatgaaatcctgagtcccaccaaaaacagttcatctaatttcagtgtgatcaaaatggagtagctaaattcagtctccttcagcattcagtgcaggatttgagcacctgctatgagtcaagtggaaactatgtcaggatgccaaggatgaggagagaaatagacagattattataatacagtacaataacagctctcattgtgtctctctagggacagtggagacagatgaaggaagggcagaaaaagaaaaatatactgtggaagagcactggagttggatcaatgggaatgtgttgtatgaccaagagttgaagatgtttcaaggagaggcccagcatatacaaaggcatggaagtatgaaaatggtaaataagcaaatacagctgcagcatacactggggtgagggagatgggaaatgtgactgaacaggtagactgaggggatattgggaagagaggtcttgtgcaggttgctagggttttatgtagtagaagacataatacgaatttcacaaggtaactttcagcagtct

SEQ ID NO: 231755 - DNA, 485 bp, Homo sapiens
gtacatttctagccaaggtatacgagagtcagtgtgctcccgccagctcattcttccccagctcatcacctggaagtggttacaggcaaaagatgcaaacagaataaatctctgggtcaccatctggataggagaggctctgaaaagtcatcccatccatggtatacctaattaggttacgctactgatacttgagtttgtgtgttaccataattatcatagtatagcttacactaatctcactaatgtactctctaagcattttatgtgaataatttccttttcagggagatcagttttgggaaagtagtagcaacatgagaggtgggaagagcaaagtattgttagagttaaagacccatgtgccaacacatatcctttcttccctcaaataaatgtctacaccttgtcgaactgccttcctttttacacagcttagctagaatgaggcaagacccttcttctgagtttctgaaggttttatt

SEQ ID NO: 231756 - DNA, 387 bp, Homo sapiens
gagcaatgaagtttaatatagaaaagtatgagttcactgatatggattcaactaattttttacacacattacaactaatttttcagaaactgccatttgtctaattttgatgacataacaaagaagagtatccaccatgatctaaaaaggttattaaaatactattttttccaactccaaatctgtatgtagctggatttccttcatctacttcaatcaaaacaacatacacaacagactgaatacaaaaacagatacgagaatccaactatcttctattaagccaaacattaaagagagttgcaaaactataaaatgatactactattatctacatttttttgttgttttagagaagacagctgtttttataaaaagtatgttggc

SEQ ID NO: 231757 - DNA, 439 bp, Homo sapiens
tttaggtgtgaattattcaaaatgcataatgtcattataacttaaaattataaatacccaaatcaaatatacctacaattttcttagaaacagccaaaattgaaaaatatagtgtcttaaaaatatttttattttttgtaaataaaagatagaaaggcaagcattggcatatgtctttgcacttaaaacacattcttcttgccccactgaaaattaaaagtgtaagatcttttctgttacacaaaataaattccttatcaagatattctattaaaatacctgtcaaccaacttcaaagatccacaaataaaatttgttctggtgttggcacttctattctgaggctacatgatatttgttttccttcatgtaagcttcagtacatcaaaaggggctggggggctagtaactaactagccaactagcttcaggacaaaaa

SEQ ID NO: 231758 - DNA, 421 bp, Homo sapiens
agaaaattgagttgctttttcagaggaggatatcatgtttggatggtattatgtatcaatcaaatgaatcttcatttatagcaaaataaatgtggcttgtctttactcttttaaagaaaagtaaaacaggccgagcatggtgcctcatgcctataatcccaacactttgggaggccagggtgggtggatctcctgaagtcaggagttcaagaccagcctggctaacatggtgaaatccagtctctactaaaaatataaaaattagctgggttcggtggtgcacacctgtaatcccagctactgaggaggttgaggcaggagaatggcttgaacccgggaggcggagatttcagtgagccgagatcgcaccactgcactccagcctgctgacagagtgagactctgtctcaaaaaaaaaaaa

SEQ ID NO: 231759 - DNA, 450 bp, Homo sapiens
cagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacaggtgtgttatgtatgtatagtctgattcgtgtcagattaatataaaccttataataccttaaaaagtttatacatgtctacaaatgtattaacactttgaaataaacttatcaaaaatgaaagta

SEQ ID NO: 231760 - DNA, 513 bp, Homo sapiens
tcagtctcccaaagtgctgtgatcacaagcgtgagctaccatgtgtggcacttaaattttcattttctaataatttattgtatgttataaaattatgaattgaagtcatgatgaactggaaatttgaaaaatcaccatagatggtttgagaagcactactcttgctaacatcctcactctctcctccagaaacacttcttgaaggtataccttgtttttttttactactacatatcctatttagtcctcaacccactccaatctgaattatgctcccaggacatgacaagttacctcatttgctgaacccccaatccatatgctgaagtcctaaccaccagtaccacaagatgtgactgtatttggtaattaagattaaattaggtcattagggtgggtcctaatgcagtatgacctgtatccctgtaagagaaaatttggacatggagatggagaccccagacacatgcacatgcagagggacaaacatatgaggacacagcaaggcggccg

SEQ ID NO: 231761 - DNA, 393 bp, Homo sapiens
gttttaaacagtagctcccaaatattagatgtaaacaagtggttagtgcactatggttggtcacagtagggaagaaatgttaattccagtttttcgttttaatattaattaaggataagggggcctaacatttacatgtgtagataggtgtttcacctgttttctcattttacaggaacttgaggtttgtcgtagtcccattttagtgtatgtagcactctcccatttccccatatggatttcaaagaacttaagtcttgtaacttccttatttatttatatgctctaacttcaccgtgtttcaaagtggagttagcttatagcagtacagagtcagggagttgaggaagggaaatatatttgaaggattcagaaaaatacttttttttttaa

SEQ ID NO: 231762 - DNA, 788 bp, Homo sapiens
ttttagaatgctctttttgtgtctcactcctctcccccttgtgttctttgctgttcccactctcagtgcctcatgtggaaccatattgtctcttccctacactagggcattaatttctaactgttctccccacctccagggtgtgtatggccagattagtgttactgaggcatatatttgctttctcacttcactgaaaatcttgactggtttcggagtcatagcagctcaaactaaagtccttacaaaacatactatagaagggtttgtcataacctgactacagtctgtttctatctttaattctcattcctttccttcagtccagccaaactgtataaatgccttttcccatggtccttctataagttggtgcaaaagtaattgcagcttttgccattaaaagtaagggcgggccaggcgaggtagctcacgcctgtaatcccagcactttgggatatgatggtttgtgactggtgtactttctagtgaaaatacttaagaaaggtgagagacattagcatgtacacaatattccactttaaaggctgaggatcacgaggtcaggagatcgagaccatcctggctaacatggtgaaaccccatctctactaaaaatacaaaaaaattagctaggcatggtggcaggcgcctgtagtcccagttactcgggaggctgaggcaggagaatggtgtgaacccggcaggtggagctttcagtgagccaagatcgcaccactgcactccagcctgggtgacagagcaagactctgtctcaaaaaaaaaaa

SEQ ID NO: 231763 - DNA, 277 bp, Homo sapiens
ctaagtcaaaataaacatgggatccaagcagttgcccttttaaaagacttcgtttcacacaatgtagataaaacaacctccaggattgccagataaaatgcagggccagctaaatttgaatttcagataaacaacggacaattgtttagtacaaatatgtcccacgtttcagataaacagtgatttttttttaactacagtaagtttcatgtaatatttaggatatatttacaacagagaatcatttcattgtgtgaaataaaataattcaaactta

SEQ ID NO: 231764 - DNA, 654 bp, Homo sapiens
ccttaggtattgtggggatgtaggtaaggatctctattttatgtatagaaagactcaagcaggctaagatacaaaattttaactctgagtcatagctatgacaaaactctcaactttcattgcagtattttaatttgctagactaactttccagtaaactaactgaatttatatccacaaggaataatgatggcagatgagatgaagttatgaacctgtgagtgctgatgattgatgtggattcctttgatttcagtgcattgacatctgctttcatgtgttggcatcctgttctttcctgggtttgtctaccaaagtgagaagctgaaatcaatcatgtctatgtaattatttttttcatgtagcaaataatgatatccagtgtatattattgaatatttgttttatgatggtgaagcacatcataattccaaattgcagtggctcttcttcaaaaaagacttaaagacgattaataaacatgtattagtgacccaatatctaaaagtttcactgaagcttcttatcagtagaattcatcagttcttcctaagcatcgctctttagaatatccttttgccaacgtaaacgttgataacatggggatggtatgggagttcaccagggaagaacccaggtaatgttgggccagct

SEQ ID NO: 231765 - DNA, 495 bp, Homo sapiens
atgtatgttaggcttgaagatttcatgtcagtaggcagtcgtgtaaataggtatgggacttaggtgcaatattttgccttgaggtggggatctgagaaaaattaaatagaaaaaagagctaaagatgaaatcctgtgaaataagatgtacgcaaagaaaaagggggcttataataggagtctgaaaaaattagagagttaggaaaacccagaagaaagtagtgtcatggaagacaaggcgaaaatttccagagggaggaaatattcaccgtggtcaaataatgtaaagcaccctttggatttagcaaagatatcagtgctaatcctgataaaactggttttaaggaaggtggttgttgaaccaaacttgagtggactgaggaatgaatagaaaacgtggatatatgtagaaagctgaaactggatcccttccttacaacttacacaaaaattaattcaagatggagtaaagacttaaatgttagacctaaaacca

SEQ ID NO: 231766 - DNA, 285 bp, Homo sapiens
cctctgactccctagttcaagtgattctcctgcctcagcctcccgagtaactgggattacaggcacatgccaccacgcccagctaatttttgtatttttagtagagatggggtttcaccatgttgtccaggatggtctccatctcctgacctcgtgatcctcccgcctcggcctcccaaagtgctgggattacaggtgtgagccaccgcgcccagccgggaaagaagtatttaacattttcagcttccatagtggagggtggcacaacagaggaggattagaaat

SEQ ID NO: 231767 - DNA, 596 bp, Homo sapiens
cccaggaggcagaggttgctgtgacccgagattgcgtcactgcactccatcctggggggcagagcaagactccgtctcaaaaaaaagacaataagtaaaagaaaatgtaatgcaaactagaactactgtttcacacttggagatggttttccaaactcgagcttaacgctcttacttttggcctcctttccacatctcttccctcatctttttctggatgtaagacttaatctcattgtttatttattatttttttttcaggtggttaggggaaagcagaaacacagtttgcccccaggcggggttctccctttcttttgacacctctgcctttctgagaaaggaaaacgcctaccaggagatagtgtccagctaatgtcactccagctctctcacagaagtttccttttatctctcagatcttaagaagtcagagtgcatggagcctggaggtggacctgccctgccagttagggtcctttgcctcttgcctgccaaccctgtgtttagactgactgcaggagttggcacaagacgattttagccttaaggctaaaagttaaggaacttttggggagggcctcaattgggatgga

SEQ ID NO: 231768 - DNA, 438 bp, Homo sapiens
gagagcgccagtgcctcgctcgctcttggggagtcgaagaagagaaagaaccgaagagacagcggcggcggcgcagagcccggggccgcgcgatgaagctcccacatgcccgcagctgcccggcccggccggcgagctaatcatccaccccacgggctcggggttcgccggcccccgggacgcagccctcggcggccgggcgcccgctctgtctgcgcgccccctccgtgcaccggggaaggagtttgtgtggctctcgctccggctgtccgcggaggttgcgggcttgagaggggaccctcggctgggagagagcctcgggaggacgaagaggaggacggtttggcggagaagccacccctggccctcgcggctccccctacctattccatcgctcccgctccgaggcggaaaggggaggacgtggaagaagaaaaa

SEQ ID NO: 231769 - DNA, 469 bp, Homo sapiens
ctggcaccgagaggctgcatgggcgtgtgtagcatgtgtattttcagagcccgacacttgaggagactgttgctcaatttaagaaagcacagctattggaaagccaggaaacagacccagagaggcggatgcatgtgggagcaaagagctttgggcagcctttaaggtaggcattggcgtctgaaatcatgttattgccttttgtttatttgttagatggattttgtattggttttatgctttgttcggtttagagaattttcctttgatggagctgccaatatcaatagatttggttttgaaatcctcgggccgggttcataggataggctggagcccacggtgttagtgtagatgcctcaaagtcagaagagatggatacaaaactggtgatgattttcaaaggagattcacttgcaaatctcactgcaatggagacttgctgggagtcctggtgcctgctgaggca

SEQ ID NO: 231770 - DNA, 216 bp, Homo sapiens
acaacaggaaaagtctcagatttttcttggctgccataaaagatcattagccctttcagagggatttctctgtgacaaactgttctgggaagcaattgatgaggattgagtagttgtcaggctcttagtgccacagagttggttaatactgtcaccttcgacagttttatcaacctactctagaacttctgatccctctctctctacagctttaag

SEQ ID NO: 231771 - DNA, 147 bp, Homo sapiens
ccacccccactccccccaaaaagtcgctcccgggctctgtctgcagagagccagggtgagagcgggcaaggcaaaagagcgacctcggtcgtgggcaagtagcttgtttttacgtccctcaataaaatttttatgaggatcatttga

SEQ ID NO: 231772 - DNA, 447 bp, Homo sapiens
atatatatttattatgtactgataatacataacaaaggtgaaccctcccctaatgaaactgtattcacaagtgaacacacagagatttgcacacacatacacaaagactggttgtgcagcttttctcctcctgagccaggacttgtcaaagacaagcaaaaggaagttgttagagtaaaaaataagagaaagctagtatttttaaaaactccttactgtggaaaatgtcaaacagaagagcagaatgaatttccagaacttcataaattgtcaacacttttcagtcttgtttcatctatcccctaccaccatcttccagaccttattttctttgctagaatattttaaagcaatgggtattacatttaaagtttgacttgtttaacctggactacttttaggtaaggaaaattcagtatttcttagaaaaccctttccccaaccaaa

SEQ ID NO: 231773 - DNA, 330 bp, Homo sapiens
cagcaactttcaaatgggtctctgctgatacaaaacatacttcattccagacaccacaagccagatgagggactttaccaatgtgaggcatctttaggagattctggctcaattattagtcggacagcaaaagttgcagtagcaggtcctacttagtctagtctcatcttggaagactgatcagaataactcattttcatcaataacaggacaattgggcagaatcaccactccttcatgcactctcctagtgagggtctgagaaagttgaaatctgaaagatgtgattttgtcaggtggtgctataaagaattacatctcatagatatg

SEQ ID NO: 231774 - DNA, 430 bp, Homo sapiens
tattgcttgtgaccagtatcttgagaactgtttttccatatttatttggattttttagttgtttcaggcagatgtgtaaatctgtttttactccaccttggccagaagcaggagtgcttatcattcctcaatttaaaaacaagaaattggctgggcagggtggctcacacctgtaatcccaacactttaggaggccaaggcgggcggatcacctgaggtcaggagttcaagaccagcctggccaacatggcgaaaccctgtatctactaaaaatataaaaattagctggccatggtggtggctgcctgtaatcccaactactcagaggctgaggcaggagaatcacttgaatcaaggaggcggaagttgcagtgagctgagatcctgccattgcactccagcctgagcgaccgagcaaggctccgtctca

SEQ ID NO: 231775 - DNA, 496 bp, Homo sapiens
cagaaggatcacttaagcctagaaatttgagacccacctaggcaacatagcaagaccccatctctacaaaaaaagaaaaacttagccaggcatggtggtacatacacacctgtggtctcagatactttttgggggctgaggtgggaggatcacttgagcccaggaggtgaaggctacagtgagacacgaatgtgccactgcactccagcctggctgacagagtgaaagtgtctcaataaaccaataaataaatgctccaggaaaaaacagccacattcacacatccagaattgagcctcctgtatgcactggcctgagtattccttgcctgctgttggaggggaccctcgctgtgttcaaatcctccacaaatccatatgtgagcaaggaaggccttggaaactcttctcctttgttaatttccacaggtttctcctgtcaactcccagcctaaaactttgaaatataagccaatttgtttattttttactttgag

SEQ ID NO: 231776 - DNA, 345 bp, Homo sapiens
ttctgagtgctcagtaaacaaagaattattacctgcctaatcccaaaacccctggcctgtagacagtgctaataagggctgctacttcatactgcacaatgcctgcctaggaaaagtcacacctcctaccattgatgggattttttgggtgcctattaaaatgtcagttgatcttagagtggaagttctttctacatcatttagcacaacctggaaggtcagattaatgtggcagccagctttcccttggcagttacttccttattacttccctgcccctcacttgttctcagaaatgttacatcacaataaatgtcgttaaaaagagcaaacaaaccactgcta

SEQ ID NO: 231777 - DNA, 352 bp, Homo sapiens
ttatttgtggtgactttttgtaggaaagatggaggggggaagtgttcatttgggtcagatgaataatggggtgtgtctgctctggttttggctgatgcagcctgtttcattggctgtcctgtagttgacactttgtttcagaggtgcagaggctctctccctctcgtcctgaaaagtgatttagtcggttttcttctctattatccactctcctggtagtagcagtaacaaaggttatttagttttgttggtctttttgtgatgaaaccatttttattataggaatttaaaggttgtcagtatgcattcatgcgtagacacttatgtgaaaatctggggaggacagggaata

SEQ ID NO: 231778 - DNA, 413 bp, Homo sapiens
ctcaagcgtcattttaaagtcgtttcagttggcgtcatccgtcatagctaattatcatgtccgaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataa

SEQ ID NO: 231779 - DNA, 158 bp, Homo sapiens
gtattactgactgttacctctggtcaagtctttggcttccatcagccggatctatttttctcctgacacttccttggggttctctctgaaggttattaataggcatggaagcatggctttccaaatagcgtcaataaatgttagaagccttcagggga

SEQ ID NO: 231780 - DNA, 910 bp, Homo sapiens
accacgggggaccttgtaattgggaggcaggagagttggggcagaacaaggagtgcaggaagagaagccaaggtggagtgatgtgatagaaacacacggaaataaataatctgctcttgaatgacatctgggttaacaaggaaatcaaaatggaaatttgaaaattctttgaattgaatgataataatgagataagttatcaaaacctccaggacacagaaaagcggtcccaagaggaaagttcatagtgttaaatgcctgcatcagaaagtctgagagagcacaaactgacaacctcatgtcacacctcaaggaactagggaaacaagaacaaactaaatccaaacccagcagaagaaaaaaaatagcaaatatcagagcagaactaaatgaaattgaaacaaaagaaatacaaaggataaatgaaacaaaaacctggtcctttgaaaaaataaaatctgtgtagaccactcacaagattaaccaagagaagaagagagaagatccaaataaactcaattagaaatgaaactggagatattcatccaccaccacagaaatacaaaagatcatttaagactactacgaacatgtatgtgcacaaacaaaacccagaggaaactggtaaattcctggaaacacacaactctcctagattaaatcaggaagaaatagaaaccctgaatagaccaataacaagtagcgagattgaatccataatttaaaaattgccaacaaaaaaaaagcccaaaagcagatggattcacagctgaattctaccagacattcaaagaagaattggtaccaatcctactaaaactattccaaaatattgagaaagaagagatcctcatagaatgaagccagtatcaccctgataccaaaaccaggaaaggacacgagcaaaaaa

SEQ ID NO: 231781 - DNA, 632 bp, Homo sapiens
ctcattatcatgcatttcttggagtttccattattccagccagagagagaacatttaccattcagcagatggctgcatatgcacatttaagacttttttgagaggatacagtgcaccagggagactactgttgtggctaatgactatgaggatgataataccaagagtttggagtatgccccttagccagggtccccatgaaccaaaccaactgaaatcatttagatcaaataatgagccagatggggaatctacctgttttagccaagcagcctgtttgttcggtttatccatgtgcaacaagaagcattagcaactgtgcagattatttcctgttcggctagaaggtggcatttctgttacctaccatcccatgactaggtttggcatgacagatccgtttttttcatcaagtctctgtagaagctactgattgtgcaattccggcaatgtagcattatcctgccaagtgaaaaaggtaggcataagcaaggatcaagaggagtcagagcctcattatgatgaatcttgttctgatgtcttgggcctgtgattataacgtccggtgtttgggtgaactctctgtggcccacatatcaggtatgagacctgtccctcattatacatgggtt

SEQ ID NO: 231782 - DNA, 528 bp, Homo sapiens
agtgttctacgtgtcctctctggagggaggctgagctggagatgggagggagtctttgctgccagcgccctgcagggtaatccaaccatccttggtgacatcatgttttctgagtggatgtttgcttcagaagctgcaaaataatctcaactttcagccccaacttctccccaggagggcagcatcctgtgaatttggccaaaacggaactcacaccacagctcattaagggagcaatcagcgagggtaccaaaatgctgcctccctcacactttccaccctgcatcccccatcaaaactctcatagcctgtgtctctctgggtgccagagggagagaaaatgcatgttccaatggggtattgaggaagggagaggagaaagaggggcaggtcgaaggagcctggtagagaaagggggtgaccccacctggctccctccagggctggggtctcttgtgacaggcactgggctgatggaaagcagctgcgggaccttggcagacccaagtggggccagctggagagaga

SEQ ID NO: 231783 - DNA, 414 bp, Homo sapiens
tcatggggtgggggatgtggggcctgcctgctcatctgagcactgctccctgagggtgtgatctgcaggcttcctgaaggagggctgtgagctcttctgcgaggccctgagcctgtggaacatagctgaggccaagcccatggggatttgtgtctacttgcacctccttgctcatctcagtacactacaggtgactgtgccgaggtgggccttgagcatcccctgggctgtgtcagcaaacggctctgggcctggcctggcattgagggatggcaaaaaaggagcctggggttgcattgtcatcccctatggtagcataaaatgagagagtccagacctgcaggactggaaccctaacaaaggggttaggagactgctcactttccctcaggaacccatgtggaggagctgagg

SEQ ID NO: 231784 - DNA, 632 bp, Homo sapiens
attaaatgaatttagaaaaatcacagagttcaaggtcaatatgaaaaatctctgtttatataccaataagtgattaaaaatgatattttaaaaattatatcattaacaattatatcaaaagaccaaatatctagaaataaattaacaaatgtgcaaaactctacacaaaaaatatgaaacattatttaaaaaaatttcaaaagacctaaataaaaggaagacattcaataccataaacatgtatattatttttaaattattctataaagagtatctccaatactgaaggaaataatgtatacaatggcccatggtccatttccaagacgaagtgccttaaatagacttacgttagcaaactacagaagaaacagaacatactaggcccctgcttggatagcccatgcctgcttgttggcctccccctcccccactccgcctccacaaccctgtttccttgccttcaccagaaccaaagaagtttagtctaagataaaagtttactagcctgcaaaatagttcgttttgtctgtttttattagcctgcccagctacttagctcataagtaaatacttgaagagcccctgagctaactaggattgcaatgcattgtgggctgcaacaaaatgcc

SEQ ID NO: 231785 - DNA, 340 bp, Homo sapiens
actgttcatggtggggggacaaacgtgggggctttcagagaggaacacagtctctgtggtctttttaatgtgtggccttgtcagggtgctaattggtgccaatttcactggcagtaatggaggaatctgttagcagaaggaagactttgaagtctaaaagcattacagattagttccctagaattttcctacgggaagccttatgagccaagtccactcgaaggtaccacaggtttgtaaggtagactttccttctgaggagaaattcccagctattcaggtgttcagcctgtaccaagagaaccaaaccagaaactctaaaacatcactgtttttctga

SEQ ID NO: 231786 - DNA, 478 bp, Homo sapiens
caggctggcacgatcatggctcactgcgcactgacgtcctggcctcatggaatcctctcacctcagccttgtgctttcctttatatgtaaggatgacaccacacagcatgcttaattatctacttattgctgttggcttttatttggggtttagggagtagatcaatcaatcacattctgtagattaagttttggttttctgttgttgggtatttgttctttggggtctttgtgtttgtttatttccacaaagaggcctgtcagtagggattggagtcatttcaccaactgatataaccaattctgatggaatttttttaataggattgaacttaaatattctgattcattgcattataactactgacttacaaggttacaatttttattcatgaggaattgaatggataaactattgctctgctctagatacttgccagtgaagtattaaatcttttcattaaaaaaaaataaagat

SEQ ID NO: 231787 - DNA, 388 bp, Homo sapiens
tagagacagggtcttactatgttgcccaagctggtctcaaactcctgggatcaagtgatctacccacctccgccttccaaagtgctgggattacaagtgtgagtcacctcacctggccgataatgtcgggtccaatctccaagaagactttaattactagaaagccatcaggtttacaatggcagatacaagttttctaaaattccaattttcaccccaaagctcaaattttatccttagcaacaaatactgttcgttttttctttgagacatcactcgttttggacaaaacgcctgccacatgctgagtctgaaaactgtcctccgtctgttgttctgtcagggacagacagcgtttccgagaccactcggctcccagctcaatccc

SEQ ID NO: 231788 - DNA, 384 bp, Homo sapiens
agaaacacttggaaaagtgaatgatacggactgtgactccttagtgttgaagtctagcattggtggattagtctggagggtagagaagacaggctccacctcatttctgtgagttgtagccacaacagctctttgcctttctttcatatcctaatatttacagtccctttcctggctggaaggcaggtggtcaggtttgaattctttcaacaggtatgtttcttatgtggatgactggtgaaagtgtaagctgcgtgtaatgtagtcacagattcacctattccatgcaagatgttcaaagaaaatataagttcattatttcctgtaattgatctgatattctttgtgaaatacatcaccagcgtgggttggtttcacttttaa

SEQ ID NO: 231789 - DNA, 484 bp, Homo sapiens
tatgcaaacaaatggatgtggctgtgttccaataaaaccttatttacaaacagatttgaatttcatctaattttcagatatttgtgaaatattcttttgatttttttcaactctacatgaaagtttaaaaatttctcaacaggctgtaccaaaacaaaactcaactaaaaaagcagcaggcaggatttggcccatgggccatagtttgccgacactcgtcaattgaaagggtattctccaaagtccttcccagaaatatccactaatagaaaaccatggataggagcccctctgcttattcttctgctacgttgggtcctattcctagaggaaattcatgaattctattgattaaacttttctttgtttagatcctggattctgctccctgggatacagatgaatgcttagagcctgcagtgccattcgactgtaactctggatttaaagtttttaataaaaagaactgggcatagagaaatct

SEQ ID NO: 231790 - DNA, 411 bp, Homo sapiens
ttccatagcatcctagataggtgatcattcagcctccactgggatgctcagagtgactgctaatcaccttacaaagctacttgctccatttttacccagctgtgttggagagagcttcctcctttaatcattaacatagtcatttattctaaatcagagcttgtgttgccctctgtgtctccttctagagatgttcttcttcaggtggagcctcacctttggaaataaacactctgcctggccccatcccactctccaccccccagttttgggagagaatcgttttcttagagaaatctagggaagcagcagcattagggcaaaggtgtggtaaaattcactcattcattcagcacatgttactaggcacctagtcagtgctaggaactgggcgtagagagtttaaaaaca

SEQ ID NO: 231791 - DNA, 454 bp, Homo sapiens
cagcacccagaattaatgccaggggtcagtgacttggggattgcatttctagagttagcaaatgctgacgaaccattcctgggactttgacctcctcaggctctaccaacagcagacggtcagcaagacgccacatggagcatggaggacagcgggtcatcagctggcagagcgagccccgaggcccaggccacaaaaccacactgggagtttacagagaatactgcctccactgtcagcggcttccagaatcaacgtggagtcagcttgtttactagaatttcaataatgaactctcaaactccacatctgactatcagagagagtagatcagaaatatctaaaatcaatcatctaagcttccaccttaggaaactagaaaaggaaaagcagttaaatccaaagtaatcagaagaaagaaaacaataaaaattagagcagaaacaataacatt

SEQ ID NO: 231792 - DNA, 464 bp, Homo sapiens
atagagtgtaatcccatttcaagtctgtcagcattcctttgatgattacaaatgagtcccttttcccctgcaatgtgggggaataatctggataaaataatcctttttgtctgcaaaggcccatgcgatgcgtactcgtgacagctttcagagtagtgtttcagagtctgagagaagagcacactgtcctaccaagttatctcctttctttctcttgacttagaagatttttcactcttttcatgttcagtggcttccgaaattctcaggcttagaaatcataaatcatcgtactgtactgaggaacaagagaaacccaggtcaccagctccttttccctccctgcctgctcaacaggagatgacaggtggaaatgggaatgtatgatcttatctagaagtccaatttgtacagctttggagggatatacttgaagaaattcacataattttacagtctcaagt

SEQ ID NO: 231793 - DNA, 227 bp, Homo sapiens
tcccaaagtgctgggattacaggagtacgccacagcgcccagccaccaaattaatttttaaagatcactatgatcgctgtgtggaaaatgagctgggagtggtggtggatacagtttttgtttttgtttcagtctttccctactccatgaaacatttgcgctatatatgcggccaaatggaatgtttctcttttctcccctcctcttcctcttgggaagtcaccaaa

SEQ ID NO: 231794 - DNA, 426 bp, Homo sapiens
atttcttttactccccattatcctgaatattagctttcaatgcagtcactatttgacatttccaaaggctttgccgcattgtcactgcccaaagacaaacaaccactggaaatgatggctttcctgcttgaaacgaagggggccaggtgcagtggctcaagcctgtaacccctgcactttggaaggctgaggcaggcggatcacttgaggtcaggagtttcagaccaacctggccaacatggcaaaacctcgtctctactaaaaatacaaaaaacattagcagggcatggtggtgcgtgcctgtagtcccagctacttgggaggctgaggcaagagaattgcttgagcccgggaggcgaaggttgcagtgagctgagatggtgccactgcactccagcctgggcaacagagcaagactgtgtctca

SEQ ID NO: 231795 - DNA, 304 bp, Homo sapiens
gtggaccattccctagctctggggagcatatctgcctggacaaaagataaccagtaggtaaatcttgtgactctgcatgcctagaattaagaaatttcttaattctaagctaacacaattgagagcttgactgttaatagttcttgagggtgaaaatcatgatggtatcatggatggtattactgtcttcaagctttcactgtcactgtttagaaatttaatgtcattctgattctacatcatttaaatgtgacatgctttttttttgagatggagtctcgctctgtcacccaggctggagtat

SEQ ID NO: 231796 - DNA, 209 bp, Homo sapiens
agtgtaatctgatttcacatatgaatcaagaaacattattttagtgtcatgattttaaaagtgtgagcacatttatccttacatcttttgctactgctgttttgaatgcagcagtgcgtaatagctttatgaaaggaacctgattttgatctcttcgctttcacattcacaaatgtgaaaagtgagagtcaggtgtaaactaaagtttt

SEQ ID NO: 231797 - DNA, 344 bp, Homo sapiens
ccaaggaacagcagtcaggctgaactaaataacctgaaacatcctggaaccaagcacctaaaactgggtgctgtgtgaaatacagcaaagtgtaatgctctgcacaaaagtaagagggaattcccaggcatctgaagaagagaagagagctgaaaatgaaggtgctaaccattgtgagcctctgtgtggcagcataaggacttgagcaaggtaggctggccggtaggggtcacacagaaaaggaaacaaagccttacacctggctgggaggggctgagagctgacgtttccatggaaacctggaagacagaagcctaaatacccttaagtgtataggtgaactg

SEQ ID NO: 231798 - DNA, 373 bp, Homo sapiens
attcagaagcctgaagtacatgtgaggagagaagatctgtgccaaaacacagcatcatgaaatttctgaacactggaggcaaaaatcctacagaatagcaaagaaaaaccaaggttacactcaatcaggcaccaacaaggtaccccaattctcagcaacagtggtggaagctggaaagccattgagcaaacacccgaatattctggggggaaataactgctctctagaattctgtatccagacaaccatcaacgaagtgtgcgtgcagaataaaatgttttcagacatggaaaatctcaaaattgtgacttttccatactctcccaggtggttactgaagaaaatcccccgccaaaaccagagtaaacgagga

SEQ ID NO: 231799 - DNA, 419 bp, Homo sapiens
actaaaaataatttaaccattttttattgaatttaatttcaataataagaggaaactaagatgtttaacatattttctttcacttcccccccaatgactcataataatgtttaagtcgaaataattattatctgagcatgcagagacccctttgcagagctgctgttaggagagaaggccaaaggataaatgtatgccttagggctgaaggagaaccattgcctactcccccttagctgctaccatcactgcatcaatacaaggaatacaccagtcctaggagtgcccagacataatctataaaaagatttatcagctaatcaaaaggctttattaattaaggttgtatctacttacttaaaacatggatactgcctaaatgtagcatgtccagatcaaatggcccagggtagaaagaa

SEQ ID NO: 231800 - DNA, 493 bp, Homo sapiens
cttcgccgtgggaaggtgggaaagaaaaataaatcaggagtcagaaacgtaaaaggcagcctgcatgtctgtacagtctagagttgtaagctgatttattttcttactcattttgagtaaactgccaccactgccttccaatgtaagcagctaggggcaaatactgagtttgagtttctgttctgcatacaaactagcacattttaaatgtatatgaagtttaaatagcaacatcctattcttatttcattggaaaaatccttttatattagtttccaccatatcttagactctgccagatcttgccctaagaaaaggtaaagtaaatgtgaattgaaaaatagcaatttgcggcctggcacggtggctcatgcctgtaatcccagcactttgggaggccgaggcagtcagatcacctggtatcaggagttcgagactagactgaccaacatgatgaaaccctgtctctaataaaaatacaaaattagccaga

SEQ ID NO: 231801 - DNA, 324 bp, Homo sapiens
gggctagggaatcagggcaataggatgttattgcttaatgtgtacagagtttctgtttggggtgatgaaaagcttttggagacagtggtgatagttgcacaactttgggaatgtaatcagtgcccctgtagtctacatttaaaaatggtcaagatggcaaacttttaaatacatattttaccactataagaataatgaggttggctggatgtggtggcttacccctgtaatctcagcatttgtgggaggccaaggtaaaaagactgcttgatgtcagtagttcaggaccagcctgggcaacatagcaaacctcatctctactaa

SEQ ID NO: 231802 - DNA, 761 bp, Homo sapiens
actttgtaagaaacaagaacaccattctccaaagtagttgtaccattttacattctagctgctccatatatccttaccaatatttggtatggtcacactttcagacattctaatagccgtgcagttgtttgttacgtgggttgaagtttgcgtttttagatatggatatttaattgctccagaacgacttgtcaaaaagactgttttcttcctccatgaaaaagcctctgaaacattgttgaaaaataaatttaggtctatttctggacgttcccttctgttccattgactatttgtctatcattacaccaatgccacattgtctggattactgtagctttgtaataagtcttcaaatcatgtaaaggtcttctgatttggtttttaaaatccacgttggtttggctactctagtccagtgcttttccatataaatattagaatcaacttgactttaaaaaaaacttctgaaattctgactgaattacactaaactatagattattttgagtagaatttatatttaacaatacagagtcttctaatctatgaacatgatatatctcccatttgggtcttcttaaattttttcaacaatgttttgtagtgttcagtgtatacatctttggtctggtttatcccaaagtaaatactttgttatactttttgatggtattggaaatcgtatttttaaatttctggttgtttcttgctaatatagaaaaatacatttgagatttaaattttttattctgtatgct

SEQ ID NO: 231803 - DNA, 493 bp, Homo sapiens
aaacccaaatccacctgaccccaaacttcatgtatcttgaactacaggctccatctcactgttcacactctcacccacctccacccatcaaaggtgcctctagacctttgcttgtgttgtttgttctctgcctgacatgcctccccctcagtcgctctcagttgaaacctggcttagtcatcaagtgcctgctcagcagcaagacctcttctcttcacagagcctttgttgagccccaccactggaattaacctcttccttccagaccagtttggtggtgcccctaatccacagtttcccaacctcagccctactgacactggggctggataatctttgtcgtgggggctgtcgtgtgcactgcaggatatggagcagtacccctgctttccacccacgagatgccatggcaccctcctcaagttgcaacaaccaaaatatgtcttcagacattgccactgtcccctagggtactaaatcacctctatggaga

SEQ ID NO: 231804 - DNA, 544 bp, Homo sapiens
gtttttatactcttggtaaaagatgaagtattgaaaattttaaaatgcccccaaaatagctccaaatattagcttatctctttagtttatggtaaaacgatgttattatgagcactaggggaactgaagctttccacagtggcttctgtctggtaggactgagccagccaggcaagcaaccctgagaagaggaaggagtaaattaaggtcaaacattaaactggaggaatgagtggaactgtaaaaactagctatacgcagcatttccaacagaaaactgttgacaaggcgtttaattccactgaaatttaataatctattgattcatatttgtacctcttttagataattttgaaatcaaatttttcatatatatgaatgtaaatttatttcattcccttttaaaaatatttaaaaataatttataaagattgactatattcagagtataaaatgtgattatttgatatacattgtattatgactaccacaatcaaattaattaatacatccaccatcactcatgatgtagttaagatccctg

SEQ ID NO: 231805 - DNA, 198 bp, Homo sapiens
taaatatgacttttttttctctccttaaagcacagctggtagatttctccattactccctcagctaagatgagcctagacaagtatgttttaatcatttctttaactgacaacaagaaagatgatttgataatttgcctaaaatgagcagatgctcaggaggacacgtctccatcctatgtcccttctgtctaatttc

SEQ ID NO: 231806 - DNA, 405 bp, Homo sapiens
cgcctcaaaaaaaaaaaaaaaaaaaaaagaaaagataactttgtgttatgttaaatcacaaaatttgtggtcatttgtcacagtagacatagaaaactaatacagctatattggattatgtctgcttccagtcaaataaccaccatctttgattcatatgctagttttttttgttgaagtgattgaaatagcttgctttggtgtttaggccagactttaatttagaaatttatgataggcattttaattaatattctttgatttttataaaggaacttcctattttgttttgtgacattaagggccacctcagtaccagatactaattgttgtaagtgagagatcccctagaatcacctgtcaaactctttcattttttgaagtgaaatagcacatctccagaaa

SEQ ID NO: 231807 - DNA, 260 bp, Homo sapiens
cttctccatgcagcgcaatcccaggctctgcagcttcaggttggactctccttgccaccttgccaccacttcagagaatccattaaatgtcttcatgaccaaccgccacctcttgccaagcacaaagctctccatgttagccagatgttttgacgtgctgatttgccaagcatggcaaagcttgacaaatcttcctctgaacaccccaacttctactctttcgctatgtaccacaaataaagtgctaagagttatgaaac

SEQ ID NO: 231808 - DNA, 901 bp, Homo sapiens
aaattccttgctgctgcaaaagaaaaaaaaatcaatttctggttgcttcctgtctttaaaaaaaaattgttctttcatttacttttctctaccctattcctccttccccactttgccatactcagtacgaagaaaaatctagagatgactcaaaccccttaaagaacacagaacaaaggcaccactcaccccatttgggggtgttctgttttctttgtggagtttcaagagtcatgggcagattcttcttaggtctaaagttctgctttcctgtattacattacctcacctctttggcttttgtgagtagcagagattaccttgtactgtgagaggattttaccttgatgtgtgtactggcggatgagagctacaaagttaaagctgactgaggacagtctacaggaagcagtcttcactgttttgttttttccacctaggaagttgtttaggatcctaattctaattcagaggtgcattctacagagtcttctccattgcctttcctctcaaaattaatcttgattggcttctctgggcatttgcgtgaggaactgaaactcattttcatagataaatgagagaatgagtttcctcagctccctaaagggcattttgcttctcccagctgaaaggctcccctggattactaggggctaagtgggagtgtctagtgggttgacccccagcaacgtgcagcagccctacagggaatccccaacaaaattagttttaaaaggcttgtccaagaaatgaatataggagctggtcattccatgctttgagccctcctggaggtgctagacctctggagacaaaaatgactcagtggataacacgctatggagtcctgccaataaccagcacacttcaacccattccactaaaccctaggccttta

SEQ ID NO: 231809 - DNA, 539 bp, Homo sapiens
tgagagtgcatattcttcctgatacaggaactgtctgcggactcgtttctaaagcaatggcccagacacactcccttgtctacagagtaggaaatttaggtctgacaaggttctctgtctttcataagagagacagaactggcagcctggcttcagagctgaagatacagatttcagtagtgacccaggtcagcaggaaagcaagatttgcttggttatgttgtgatgtgcagctcagcatcacagtctgcctgggggcatataggatgctagtctctgcttttccacttagtggcaggatgctccccagccaggttgcttaacctgcaaacatccctgtttcttaagctacaggatggtgtagagattatatcctctacctcccaggaatgttgtgggaaattcatgagatagaaaagtaccagcgttcaggaagggtgagtccccacagctccgtgaggccagagatactgcccttctgcgggactttgttacaatcaccctatgacaatgcacaaataaatggtcattcaattaca

SEQ ID NO: 231810 - DNA, 589 bp, Homo sapiens
tccacctcagactcaaaaatcttttttatttctcccattccttaagttccttcaatgtagatggattgcttttggtcaattgcatcaattgcattaatctgtcacagagggtctatcatgcatggccattgtcatggataaagtacgttaattactttgctcagtgccttgcccttagaaagtgctcaggatatcttagttccctcctcccagttcattcctacttttcctgaggcttccgtcttgcaatttacgttacaccacaggagggaatagagtaagggtctatcacctccatgtaagtgagtttgttggttggttccttgaacaaatatttatggagtgactaccctgtgccaggcactgggactatgttcctgaatgaagtccctgcctttatggagcttacaacaacgtaggggacagagagacagaaaataagtcaacaacccataaaataatcacagactgtgataacactaggatggaaacaaggtggggggctgagactgggcagctggggaaccctgtatgactgatgatagctgcgaatgaggaggagggaagggaaggctggagaggaatgaga

SEQ ID NO: 231811 - DNA, 589 bp, Homo sapiens
ggcactagcaagatcctgcccgggctgtgcataggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattatgaagttctgggcctttctcagaagactgtaatgtacctgaagtttttgaaatattgcaaacccacagagtttaggctggtgctgccaaaaagaaaagcaacatagagtttaagtatccagtagt

SEQ ID NO: 231812 - DNA, 2311 bp, Homo sapiens
  misc_feature (2149)..(2149): n is a, c, g, or t
ggcactagcaagatcctgcccgggctgtgcataggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccccggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggnaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatg

SEQ ID NO: 231813 - DNA, 668 bp, Homo sapiens
gagagagagaatttgaactttgtgtatgtttgtacaatgtgtttttatactccctgctgcagaaatctcaaatcctggccagaaactttgattcttaacacatctggaatgggttccttcaagatgaaccagagtgggattaaaaaaaaaatagccacataagaggatagtcacattgcttcattactaaggagcatactgatttaatctgtttgattttgttatgtttatttggtgtccatcttcctgctgaattcctcaccctcctgcctcgtcttttcacctgctgtgggtcagctgacagccacttttctccgaagtaaatatattgtcaagactgactgtccccagacttcctgtgcactgctcttcctctccagagaggatgggctgttcaacaccaaagggcctaatcataactgacttggaatgtcaacttaatgtagtcaaatggtgtgagggaggtagagaatttcagcagcaaattctctgaggttggtagctcaatatttccctcccactgcaatacttctttttgacatttcctatggtacttgaaccaaaattggggcaaatctaaagtaattcaagaactaaagttttaagagcaagtctaaaccttctacacagcaattcatataagaagatgccccttgactttggattga

SEQ ID NO: 231814 - DNA, 615 bp, Homo sapiens
gagagagagaatttgaactttgtgtatgtttgtacaatgtgtttttatactccctgctgcagaaatctcaaatcctggccagaaactttgattcttaacacatctggaatgggttccttcaagatgaaccagagtgggattaaaaaaaaaatagccacataagaggatagtcacattgcttcattactaaggagcatactgatttaatctgtttgattttgttatgtttatttggtgtccatcttcctgctgaattcctcaccctcctgcctcgtcttttcacctgctgtgggtcagctgacagccacttttctccgaagtaaatatattgtcaagactgactgtccccagacttcctgtgcactgctcttcctctccagagaggatgggctgttcaacaccaaagggcctaatcataactgacttggaatgtcaacttaatgtagtcaaatggtgtgagggaggtagagaatttcagcagcaaattctctgaggttggtagctcaatatttccctcccactgcaatacttctttttgacatttcctatggtacttgaaccaaaatcttctacacagcaattcatataagaagatgccccttgactttggattga

SEQ ID NO: 231815 - DNA, 628 bp, Homo sapiens
aggaaaatgggctgtagggtccatgcgcccaccctcctgtttctagctccttgttctttaaaccaagagaaacagctgttttgaaccacccccactgcctcttcctccacacaggactgctgcctgggcctgaggaatgctcctgacttagcttggggaaggacaggaagtattcctgggacagcctgggtgggaccagttagggtggatgcagacatgattctgcccttgcaaggctgagggagggtggagaacagggcaggaggtagatactcattcaacaaacatttattgtgtgtcaactggttgccagatgccaagcattgggaagatacaaacaggacaaggtccttcacctgaaggggatgcggaattacatactggttgaaagcacagggattgaaatcagcagaattaggaggtttaaatccagttcttctacctttagctatgaggttcccattaagttagtttgttaacttcttaaaaatggaaataatgattgtgattacctcataaggttgtggtgaggattaaatgaaataatgcacattaggtacctaacaccctgctgagcacatattgctgagtgctagcttctgttcttaagttcacagttgagtatatc

SEQ ID NO: 231816 - DNA, 452 bp, Homo sapiens
ctacctaaagaaagtgtaagcacctgtgcacattttataaatctaggtctctgtctcttagctattattttggagaatgaaaaaaacactcgagccttccttggaaaatgtctggcattagcactgtaagctgtcgctgaatgagaggaattatgtttctaaatactgtgtcatacagcatttcccttgtgaagatgcagccttggtttcacatgacataatcttaatacaagtgaggtactagaattttacattgcaattacaaacatgtcttctttagataattttcatttaactcacagattgttcttgaatcaagactggtactattaagaacccaggagaaatatctggtattctgcagtcacaaatctgttatcaaagaaaaaaaaaggactttggttgaaattatccaaattatgtatttttataaataaaattcactaaataac

SEQ ID NO: 231817 - DNA, 755 bp, Homo sapiens
agccagaaaaggacggggcaagggggggagatgtgtatgtgtcgggggtggagtaggggaagtgaggaggagggagggagatggagagaggaaggaggagtgtgagaagaggaagagtggggcttaaaaggacagtttattccctcatggttctggggccaggagcctgaggtcaagcgtggggaggcagtggctctggggatccgccctgcacctccctcctgtcacagtcctgcccttctcagcccatggacgtgccctccacctctgctggtctccctccaggacacgccactggactcagggcccaggcaggcaacctggggtgaccttatcttgaatcttgagatccttaactcgatcacatctgcaaaggccttcccgaggttccaggtggacgcgtcccttcccgaggttccaggcggacgcatcccttcccgaggttccaggcggacgcatcccttcccgaggttccaggcggacgcgtcccttcccgaggttccaggcggacgcgtcccttcccgaggttccaggcggacgcgtcccttcccgaggttccaggcggacgcgtcccttcccgaggttccaggcggacgcgtcgcttcccgaggttccaggcggacgcgtcccttcccgaggttccaggcggacgtgtcccttcccgaggttctaggtggacatgtcttttgagagggcctcaggttaacccactactgtgtctgaatctgtcccttccccaagcagcagctctgtgt

SEQ ID NO: 231818 - DNA, 445 bp, Homo sapiens
aagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatcttaaaaaaaaaaaaaaaaagatttgttatgggttccttttaaatgtgaacttttttagtgtgtttgtaatatgatcaaatttaataaatatttatttatgactgttcagcaatcacatctc

SEQ ID NO: 231819 - DNA, 129 bp, Homo sapiens
agtactaatgtttgaatgaaagataaaaatgtaaactttcgatactaaggcacaaaattatcctatgtctttgtgttatttgaactcacaaaacatatttgagttcatcatttgaattcacaaaaatca

SEQ ID NO: 231820 - DNA, 388 bp, Homo sapiens
gcggtggccgggctggcggcgggcggggactgcggaggaggcagcttgcgccggggctggggcctgcttcgggggactagcggcccgggaggtatggaggtgccgctccgggggggcgaaagaaacgtggaaaggtcgcccaggagggagcctgtcccccagggtttccaggggcaacggtggcccgtgtccctggaggacatgcgccagggcagcagggagtggtccccgcaggctcccaggctggggccggctgccttctggggcgctcagacctgtctgctgcagtttgcaaacagtacgcccgaattcttttcattgtaaaaaatttctattaaaaataactcgtaaagcctatcatctcttttaaataaaggggaagaaagag

SEQ ID NO: 231821 - DNA, 453 bp, Homo sapiens
tcatgctgctcaggtgggtctcaaacccctggcctcaagcaatcctcccacctcgacctacaaaaatgttgggattgcagacataagccacagtgtccggccattaaagtaaaaaacaattaatggaactctcttcatctggtagtttaccatctgtatctccttttaagaaaataataccataatgggtacaaatatacagttagatagaagaaataagtttagtctttgagagcagagtaaggtgactgtagttaacaacaatgtattgtgtatgtcaaaatagctagaaaagaggacttacagtgttcccgacacatagaaatggtaaatactcaaggtgatgataccccaaataccctgccttgatcgttatacactctgtgcatgtaacaaaataccacgtgcaccccataaatatgtacaaatatctatcaataaaaataaatacct

SEQ ID NO: 231822 - DNA, 458 bp, Homo sapiens
gactggaccacagatggacactgtaccatgcagattacttcttccaggaacttggattgagaccaagagactcatggcatcctcttctggctgcaagacttatatttttatatttaggcaatagaagaggggcagcagatgcctaccttgtggaacagaggaaggcaggcagttcacagagaaagaggactagacagtcggacagaggggagcaggcttgggagcttcgtggagccaatgtccatctctgtccttcctttccactcgatgctcctgagtccctgccttcaacccccgcttgtttgcttaaactggtttgagtttgtttctgctgtttgaaaaacaacaacaacaaaaccccaaacaaaacaaacatcaaacaaaaaccaaaacaaaaccattaactcactcatccctgtgattgtattttgagaaataaaggtgatttccttcagaaa

SEQ ID NO: 231823 - DNA, 830 bp, Homo sapiens
gtcccctgtctgaggagggaggaggcctctgtctgaggggggaggatgccgctgtctgagagggtaggaggaggcctctgtctgttgggagaggaggcccctgccaccacgttgacgcgcggcgatctcgatccccatgacagcaccgcctgagagacaccgccacgccaagcgatcctagctccccaagcacacatccgccatacctatccgtacagcaccagacgccccaccgccatagcgcatccctctcacccagctccccaccgagtcccaacacacccctactcctcatctcccaagcctctccaccccgctaccccactccaccacagcctgacccactccacatctcctgcacctctactactcctcctcatccccatctctcactcttctacttcccccccctacgtctccccttccacctacctctcgacccaccccctccaccaccctcttctccccccgcgcctcatccacttcacacttactcaccccacatcaccaatctcctcccctcctctctcccaccccctccaccactactcatccgtcaccccccaactcctccttccccaccctctcttactctcctccactcatccgtcccgccacactaccctctcgtcaacctcctcctatcgtcacactctcccctcgcctcctctcctccacacccttcccacggtccgtcaccacttcacgctccttctcctctccctccctatcccagctccccctcgtctccccctctccctcctcctctctcctctcattcctccttccccccactcacccgctccccactcctccccttctccccccct

SEQ ID NO: 231824 - DNA, 512 bp, Homo sapiens
gtcccctgtctgaggagggaggaggcctctgtctgaggggggaggatgccgctgtctgagagggtaggaggaggcctctgtctgttgggagaggaggcccctgtctgagggtgatgccgatgaggtgatgccctgccagcgtgaggtagagaagacccaggtctgaagaggggaggatcaagtcagagaagcgtagatgcccatctgagatggaggaggctcccgtccgaggggaggggacactcctgtctggaagggacagaggccttcagatgaggagccaggaggcccaggcctgagggaggagaagggcctagtctgatggggagaagggcccttgcctgaaggcagagcagtttcctgcctgggaaggtcatcccagccccacccatcagtctgaattggacatcaccagtgcccaggacattggaggtctgagggaaaagtctagaaagatgatggggctggtcacacactaattaccaatgggaaagctaaggtgagttccaagt

SEQ ID NO: 231825 - DNA, 447 bp, Homo sapiens
  misc_feature (430)..(430): n is a, c, g, or t
cacagatttggattcttcagagaatatgggggatgaagttggttagagccataagcaggcatttgagaattaacctggctcttatggtttcatctaactatttaaagctcttcattcacttctttttcttcattcataatctatattagaaaatcacaatctatttttatcagaaatagcacacctctgctaatgaactaacttgaaagtgtatgagatatgagaggaatgctgcttataccttcttcctcctattagggcaggagagtcagagcccaaatatggccccaaatagttattatatgctttatgagccatttgttggtctttggtcccaccactttacacatcaggtaaagagaacaaggacatttactgagcaatatagtttttttttttttttttgagcctgggtgacagagccagaccntgtttcaaaacaacccg

SEQ ID NO: 231826 - DNA, 378 bp, Homo sapiens
gcctaggcaacatagcaaacccttgtctctataaaaaatacaaaaattagcttggcgtggtggcatacacctgaagttcctactcaggagctactcaggtggctgaggtgggataatcgcttgagcccaggaggtcgaggctgcagtaagctgagattatgccagtgcgctccagcccgggcaacagagtgagaccctatcttaaaaaaaaggaagtattagttactcatttaaatgtttgtgaagactatttaataagagaaaatacatcataaataaaatcaaggcataaatttaaacactacagcctcaaacatgtaaataaaatgcataaaaacaggtatgtactgcctttcaaaccatgagatacagttattt

SEQ ID NO: 231827 - DNA, 464 bp, Homo sapiens
ttcataaagtagtatggaaagttttcaaaacaatatagcagctctcatggtacagattgtacaatgaagcatacttaccaaagactagccctgggccttccttcaaaatactacctagagcaagcctcctacccaaacaattcctcatgttaaagctgccctcacatgctatccactgactcattttgtgacatgtcaaatttcaactgttatttagtagcaaaaacatactgcagatgagttaatgagagtgtctctttatctttttagagtgtatttaggatttatcggaagcagtgtgccagtaacaaggtttcaaggttgttggaaacgccttaaggaagaattgctttatgtgctttaatgaatacataagaatgatgtcattaccctgccaagcatacagtgtttgtttttatacagtctgaataaaacctagcctccccactctctacaatctaggc

SEQ ID NO: 231828 - DNA, 429 bp, Homo sapiens
accaggtaacacgcaggccctcccactcagggtctgagtctacgtgggtcctggacattccgttccgacctgcaggggtgccgagagggttggggaggaaggtggaagctggttcttgttccggcccagcacctggccccctggccaccccacccaccctggaaacccccctcctggctcccttctttcagagtgggacaggcctttcagggctaggaacggagggcctggatttccatgtcaatggcgaggcaggcccgcctggtaagctgcttaacaagcctccagccccattggggtgttaactcaggccccattctccgggcccagtctcgcggttgccatggtgccctgcgtggccctttgggccgcggctaatcccttctctgggcctctcatcccggctgtcccacccccgggctggtcgct

SEQ ID NO: 231829 - DNA, 367 bp, Homo sapiens
gtcttcagccctagaccttccctctgacagagcctacccaaatgagaaggaaacagaaaaccaaccctggtaatatgacaaaacaaggctcttcaacaccccccaaaaatcacactagctcaccagcaatggatccaaatccagaagaaatccctgattgacctgaaaaagaattcaggtgtttagttactaagctaattagggagggaccagagaaaggcaaagtccaatgcaaggaaatccaaaaaaaaatgatacaagaagtgaagggagaaatattcaaggaaatagatagcaaaaagaaaaaacaatccttcaggaaacattggacacgcttacagaacgccagagctcatagcggtctttg

SEQ ID NO: 231830 - DNA, 383 bp, Homo sapiens
ttggagtgtatctaataaagatacagttgagatcacaacacccacatcctttcaaatacctggaaagccttcccaagggtgggtacaaacaagcccaggctgagaagatggtggcagcttgaaatcagccatggaagatttgcaccatggaaatggcaaacactacagaacagacttctgttccctccccgacagagagccccttgtgtaacaacagcactccactgccccatccctgagcagagcgctgtgtgttgcagcagagtgggggcaggtgtcttctcccttgggctacagaatacacattttttttccctcagcacatggatcattctcaaggatagaccatatcttaggtcacacaacatgtcttaaaacattag

SEQ ID NO: 231831 - DNA, 402 bp, Homo sapiens
aaaaaataaagaaataaagcaaaacaatagaacagaacatttcagttgttgtcacagattcctccatgaaatagagatacccatcgtttctgttcttgataaatacaaatagaacattttatctgtccaaagttttatcattattattatatatttattaattacaataacagcatccaatctatgaaaactcctacttagacctgcaatagaaccatgtgtatgttggcaacgtggctagcatctcagtgaagttgtacattgctcttaactaaggtagaataaactttaatttaacaaagaagtttagcaaaataaataactgtttctctaaatattccaataattctaatgtacatatatattttttctttctaataaactggatttttttctcattac

SEQ ID NO: 231832 - DNA, 405 bp, Homo sapiens
aggactcgacaagaatggcattagtctctccagtcttacttcttcccataccctatacttcaagcaaaaggactctattgctggaacatgcttcgtgttttagctcattctgtttcttctgtttgcactgtctctccccacacatagttgtaaaaatttctatccgttggtggattccaacactatttatttcatatcacttccttggtgttgcccattgagcaatctccctcccctttgtacctctcatagtacagaaaatattctgccttatgccatggttatctggatacttggcttatctctccaccccgataggctacaaactttttgaaggtaagaactaagctaccggcctgggcaatatagtgagtgagaccttgtccccacaaaaaattagccagg

SEQ ID NO: 231833 - DNA, 439 bp, Homo sapiens
gtaagattgttttttggctgaattctaccttagaccatgataagaactgctaagcattagaggaggtacttaaattatgacctgctgtcatggtcaatataccacacggtcctttacgttcaacagggactctgaaccctcaacttgctgctacctgacttgagtgcacaatattgggacctctgataccagtttctcacatttaatatctatattgtttctgctgaaccttaaaaagcactttccacccatttccactgtcacccacactagtaaaatatccctgcttccactctttttaatcctctattattgtatcttaaacagtgatgtcacatcaatcatccttttttcactctgtcacccaggcggaggttgcagtgagccgagattgcaccactgcactccagcctgggcgacagaatgagactctgtcttt

SEQ ID NO: 231834 - DNA, 476 bp, Homo sapiens
ctcccaggttcaaccagttctcctgcctcagcctcctgagtagctgagactacaggtgctcgccaccacgcccagctaatttttgtatttttagtagagatggggtttcaccatgttggccaggatggtctcgaacctgacttcaagttcttaaagactgaagaccccagacagcagacagagctggatggagctgtcatgcctgaggatgggggtgtgggcaggctcacctgtggccacctcaggagctatggccagggcaggaccagactccagcatacccactcctgctcccaccttcctctgcctggcactgccacatctctgacagtgttctctgcatggtccccaaccctcagctgagactgcatggccagctccacccccaggattgctgctctgcggggaaatgtgggagctgccttggggagcctgcctggccctctacaccccacccagggtacctggcccaggtg

SEQ ID NO: 231835 - DNA, 384 bp, Homo sapiens
cgggttcacgccattctcctgcctcagcctcccaagtagctgggactacaggcgcccgccactacgcccggctaatattttgtatttttagtagagacggggtttcaccgttttagccgggatggtctcgatctcctgacctcgtgatccgcccgcctcggcctcccaaagtgcgccttttctttttttaattgccacttaaccctgcctccttcttgcaataaaacatattcattcatgtgttagtgaataattggggaaaggaaatcccatacatctgtcaagagatacattttcaataatatttttatttttctatttgatatctatttataaaagtgtttcaatttttgtgataaattttataaaattataaaatagtaa

SEQ ID NO: 231836 - DNA, 470 bp, Homo sapiens
ttagtcctgacctccaacataaagccagtcctttcatttaaagatggaattggttggaacacaaaggaaacaccagtacaattcataactacggaaacctccacagagcaatggaacacagctacattcctgcacctggaatgtctggtttcatgagcatccagaaggaagcgggtgtgaaactgatcaccaacatgtacattctaattaaattcagtcacattgctaaagctgaggactcacagaatggttataatgtacttatttaaaaaataaaattttattctaaaataattcaaatgagaaggaaaccaggcatatgactgtaagttagtacttagcaatctaatgagtgaagagttcttaaatataacaatagtcaaaacagaaacaatgaaaaacttagacttttttgttcatatttgtcaattaaaactgatcataaaccattttaatcttctaaccagtgt

SEQ ID NO: 231837 - DNA, 354 bp, Homo sapiens
ggaacatatgctcactcctgttaaggcataaaacatttctaccatccagaaagtttctttctcagtctatcccccccagagccaaccacttttctggttttgtttcactatagatagttttgtcttgtgtagaacttcatataaatagactcatataatatgcactttttcataattggcttcttttgctcagcataatgtctatgagactcatctattacatagaagcagatttttcccgtttgttgctaagtagtattccatattataaatgtaccacagtttgtttatccttttccctggatttgagttgtctccagtttgactgttataaataaagctgctataaatatt

SEQ ID NO: 231838 - DNA, 301 bp, Homo sapiens
atggggttgtattggtgtagtagggtcccctaatgcaatttgaccagtatacttacaaaaaggggaaggaaggtccagacccccacacagggaggacaccacgggaaggtgaaggcagaggggctgatgcttcttcaagccagcggagggcaagggttgccaacaaaacactggaggctgggagagacgtggaagagattctctctcacagcccctgaaggaaccagccctgctcccaccttgatcttggacatctggcctccggagcggagagagaataaagtttggctgctttaagtca

SEQ ID NO: 231839 - DNA, 349 bp, Homo sapiens
tgggagagaaatagttcagaaggaaaaagaaaaataggttttactagcggggaggttgcattagttggagttatgatctcctgtgagaaggactcccacaggtcctgatttgtacctctgtaatacggcctctcagaaatgccctggtattcccattaattgtgtgcctgatagtcgccctttctctgttctgggtaaattgggacagagactatatcttgtctttatatcactccccaatagcatcttccaaatgggtcactggagttcaatacacatttgttcaattaaacaccacatttattgaattagagtcctatatgcagaagtgtaaattttgttgttgttg

SEQ ID NO: 231840 - DNA, 885 bp, Homo sapiens
catcttccttctacattcttttttatttattttctattgaaagactctctcttctccagctttcttttttctacccatatttccgtgttagcatgcagattaatatttaaatttaaatgcttggtgttctttcccttgtgtagggcctctacaatgaaggtgatttttgttgtgcttgaatatgtgtcttttaattgtattggaaggatgggaagatgtacttccttgagtatgtccaaagtgttagggccctcttaacagagcatataaaataagcaagccagggctgatgctggaagacacacacccaggttgtggggaaaatgtcagggcccaggtgctctcgttatgctggagatcagtctttccagcccaagagtctttgctcatgagtctgaatcatgtgtttcctctcttcctaacactgacattgactttacaatctgattttgaactctgctcatgttagggtgcaaccatttcacacagacaacattttttaactgcaaatgcttaggcccatttcccagattctggtttaccactggagatttggtgaatcagcacgtgaccctgtgagcattactttactcattcaataagcagatgttgtgcatcttctaagtgccaggctgtgctctaggaactgggaatacctcaatgaaaaaaaagaaatgaaaatccctgcccttagagagttgcatcttttgaagagagaaagacaataaatagaaccattgaataaaatagatagcatgtaagaagtaataagagctggccagacgtggtggttcatgcctgtaatcccagcacttagggctgaggcaggcagattacctaaggtcaggagttcaacatggtgaaaccctgtctctactaaaaata

SEQ ID NO: 231841 - DNA, 528 bp, Homo sapiens
ttaggccaaccaggccatctctgtgtttttttttaatatcatgatttattcctttcagaagaatacgaacaaatgcgaaaatgaattacattcttttaagttttgtactggcaatggtagcatgtttctttgtcgagagacaattagaagagcagaaaaactgggagggaggggaaatgcaggtatttcatttatttatggctcatgaattcagaatttttttgttggaaattgaagtcaggtcaaattaaactattatttataagaaaattgtcagcctgggaaacatggtgagaccatgtatctacagaaattttaaaagttagctgagcatgatggtgtgctcctgtggtcacagctgcttgggaggttgaggtgggaagattgcttgagcccaggaggttgaggctgcagtgagctgtgttcatgccaccacactctagcctgggtgacagagtgagaccctaactctttttctaatttcctctctttcccctggccggatgaaccatccctttgcctccccaa

SEQ ID NO: 231842 - DNA, 1173 bp, Homo sapiens
atcccatcgttggagcatcctcttactttctggcatagcaatatgttccaggctctgaatagtgttttgaggggagaagtggatgagaaagaatgggttcattaagagcttgtatgagaaaaactttttacgtctcttcctgagtctgtatgtagtactttcaggtaatcaaagctgtgaggacttaccagtttcttatccaaactattggctagggtggttaccactgtaatacaactgcttaggacacttgaactacagttgatatgttatttaagctactcagaaagacttttctgacggaagatttctctatttctcattctcaactttagctcctctgagtgttcctccaaatctgtcttttggagtagacctagaaatcatctgttactaaggtgtactatgcatgtggaaccattgatttaagagttgagtactcttaagtattctaaatatttggtaattctgtctcccactgtaaaacgaaacaaagtacacagaaactctatccaagaaaatgtggaaaacttactgttgccataatcctgtaccagaataaagctcttggtatctctgcaataattaacacacgtttaagcacaattctttttatacaaagttacaaggtatgtgaacaaagtatattttaaaattgtagctcactgtgtttttttttaatatcatgatttattcctttcagaagaatacgaacaaatgcgaaaatgaattacattcttttaagttttgtactggcaatggtagcatgtttctttgtcgagagacaattagaagagcagaaaaactgggagggaggggaaatgcaggtatttcatttatttatggctcatgaattcagaatttttttgttggaaattgaagtcaggtcaaattaaactattatttataagaaaattgtcagcctgggaaacatggtgagaccatgtatctacagaaattttaaaagttagctgagcatgatggtgtgctcctgtggtcacagctgcttgggaggttgaggtgggaagattgcttgagcccaggaggttgaggctgcagtgagctgtgttcatgccaccacactctagcctgggtgacagagtgagaccctaactctttttctaatttcctctctttcccctggccggatgaaccatccctttgcctccccaa

SEQ ID NO: 231843 - DNA, 190 bp, Homo sapiens
ggcaacatggtgaaaccctgtctctacaaaaatataaaaattagccaagtgtggtggcacgtacctgtagtcccagctacttgggaggctgagacacaagaattgcttgaagttgaagttgaacttgagttgaagttgaaatcgcttgaggttgcagtgaactgagattgtgccactacactccagcctg

SEQ ID NO: 231844 - DNA, 533 bp, Homo sapiens
gagttggagggatttgtctagaagagcaagcatggtttcccttgaagctgggtagaaacacaggagcagggacatcattcatcaacttgtcagagctcctcatgaggcaagggaagaaaaagggggccacaagtgtaggagattggtcagagtggtgggagaagctatagggaaaggagcaggccttctgaaaggttggaaggctctgcatagctttggaggagaatagctaaagacagctgttctataaccctgaggcagagggcaaggagtaggtacgagggagtgtgggggaatttatcttaaacaggcttgtttacttctgttgaccaggaactgacctttgatcatctacgcccatgaccttccctgaaaggggaacaataaatgttaattacctccagtgtttgctccaggcttttggcattgtgcctgcactgaataaaagcaagcagctccagcttctcagggctgcactttggccacttgagctgggcagtcccctagctgctcttacactgcatacctgtgtc

SEQ ID NO: 231845 - DNA, 583 bp, Homo sapiens
ctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggattaggtacgagggagtgtgggggaatttatcttaaacaggcttgtttacttctgttgaccaggaactgacctttgatcatctacgcccatgaccttccctgaaaggggaacaataaatgttaattacctccagtgtttgctccaggcttttggcattgtgcctgcactgaataaaagcaagcagctccagcttctcagggctgcactttggccacttgagctgggcagtcccctagctgctcttacactgcatacctgtgtc

SEQ ID NO: 231846 - DNA, 813 bp, Homo sapiens
aaatgtgatactaagggaagggacccactactctttatgtggactgagaccaagactgttgatacttgggaccaattgagtggaagctccttgaaggcagaactctctttcattaattttagtaaccttctaagtagtatagtgtccaccatttactaagtgcttaataaaggttttctttgaattgaactcttactgtgtttaatttagacataaatacagtaatatgaacaaaaattgcatagatgagaaattacatttactgttttagtggcactggcttatatttaccttttttattttcccataagtatttattcaccccatcctttacttttgtgtttgatttttttgtgcctaaatgtaagatttatatttatgctagttaatttagacccattgtttctgtctacacagattttttttttaatcctgtatgtaaaccaatgataaaaatgttgaacaaaagaaaaccctttgatatttttgcaggttatgttgtttattgaacaagtttgtatatagaaattttacagttgaggctgggcgcgttggctcacgcttgtaatcccagcactttgggaggccgaggtgggcgaatcacaaggtcaggagatcaagaccatcctggctaccacggtgaaaccccgtctctactagaaaatacaaaaaattagctgggcgtggtggtgggcgcctgtagtcccggctactcaggaggctgaggcaggagaatggcatgaacccgggaggcggagcttgcagtgagccgagaccgtgccactgcattccagcctgggtgacagagcaaga

SEQ ID NO: 231847 - DNA, 349 bp, Homo sapiens
ggaatagctcctttatctgtaatgtggtttgtagtcttaagagatgtgttaaaaattctttcatagtatggcctccagatacttgaaggttccatatgataataatcacaaaataaacttctgtgttcctctaagatgtcagtagagataccggagcacggtttgatgaaatatgtaaagaggcttattttgggcagggattggtttggcttggttgggtcaggggtgaaggcgctacttttcttttttctgagggattatctgagaagggctctcgaggagtgaagcctttcgcctggacagcagggccggctgtgtgaggagccctggaggggagctgggaatcctt

SEQ ID NO: 231848 - DNA, 336 bp, Homo sapiens
actgttacagaaacaaactataagctccagccctgtcaacaaaaatcactcttggtttgttttggggaaatccacagaacgggatgaagggtaaagagatccctctgtgtgctgcacagtccatttcctaagtgtcatacgttgtaaattagaaaatggcccatgtccctcctgcatcattcctactattaacagacacttaaaagctgactgtagtaagatttttatgaaagaagctcatgcttctatggtagataaaacttttttactccttgattttgtgagcttgaccgttggctcctgattttctttaaaaaaacaaaacaaaacaaaaca

SEQ ID NO: 231849 - DNA, 486 bp, Homo sapiens
ccagtgggagtgaaagctctagtgcccactggtgttgtctgacaccaccccgcaggggactcgggggtccttgttacaggctggcgagggtggggggtccttgctgacatggtgggtggagccgaggtctggtgtttgcggggagcagggcgattcctgtcgaaaggtctttcctcatgttgggctgacccttccctgggtcttaggccagagagagctgcttccatgggctcttttttctgcatctgttgtcttttccagcctgctgccttcttcagtttcaaaatatctgaggtgaaaagaaaagcccccagggagctctgcgtggcacagtctgtccttgcgtggcacagctccccagaccccgagggcccggccagtctgcccttgtgtggcacagctccccagaccccgagggcctggtcagtctgtcctcctcgctcctgctttcagagtcttcccaggtgtttatctcagtgtcttggg

SEQ ID NO: 231850 - DNA, 599 bp, Homo sapiens
atgggccctggggcagaacaatgggagacaattcaaggtgtggtaacaacaaccaagttgccctcagtctgggcagaaactgaactctacccctctcccaccccaatcttgcccgccatcccaccagattccagacctaaagggatcaaggatgagagcgaagggagaagggaggggccccaagaaaaccgcacccaagcgagcactgtctgaagagaaaaactagctccagttctccgaattctggcagagcgtctgggaaggcgatcagtgcttctttccatggcgcaaggcctgggttctgggtgtgcttgaagaaagccactggggtgtggggtgacatcgccatggctgagaaggggctagggggtccggagggaaggagccaggaccggaactgcaagggcgttgctgcccaggggtgtggatgattgctcatgtccagctcagaccagttcaagaaactaacctccatttattttcttggtgagtcctttttttttttttcagactgttaacagaaaaaaaattttaaaaagcagaaaactgaaaaaaaaaatcctggtacatgaaataaagattttttttttttatagctt

SEQ ID NO: 231851 - DNA, 435 bp, Homo sapiens
gcctacatcatgtaggttaaactataaagtatatataaagtatattaaaagcttgttttcgcaaaacaaatacggttctttctgaaaaacatgtcagcaaataataggagagatacaaatgaacaaaggaatttagcccattgttctccctttggatgccctcaagacattttggtatgggtatgctcttagtacacaagccagtagagcagatgaatggttaggaatggggagatctgtttactaagtgcctttaatgtacatttgttattcactttatctcttatcccttacctgtcaattgtggaaaatgccacctatctctctatggactgttagaaatattgagggatataggttatttagcaaagggcagaaaggagacaacagggaatagtaagagttgaaatataagtaaaattgatatgatcacta

SEQ ID NO: 231852 - DNA, 443 bp, Homo sapiens
ttaagcaagtttatttaaatctttcaagatatgtgtcctcatatacaagacagagataatgagataatatttgaaaaaattcacacacactgcctattagaaaatttatatacttaacatgtagtaaatttatcttctacgagtatatcaacacgtgtttctactacttttaatgttccatagtacttgtattctgttttagttatgtcagtgaacttctcattcctttcttcatgtattatccaacttaaaagcagaaaattaatattgagatcagatgcagtggtttgcacctgtaatcccagcactttgggaggccaaggcaagaggactgcttgagcccaggagttcaagaccagcttgggcaacacagtgagacttttgtctctacaaaaaatagatcaggccactgcactccagtctgggtgacagagacactgtct

SEQ ID NO: 231853 - DNA, 458 bp, Homo sapiens
gaaacagaactaaatcagagaactaacaataccagatttcaataattattataaaactacagtaatcaagacaatgtggtattgatgcaaagacagacagatagatcaacaaaatgaaatagtctggaaatcaacccacacaacctacagatgtttggtttttgataaacatttaaatgactttcaggaaagtgaggacagtcttttcagctttgtaacagttgatcatccttatacacacacacaaaaaaggatgtttattcatactgcatactatatacaaaaatccactcaaaatagaatgcagacctaaatgtaacactgaaaactatgaaacttatggtagaaaacctaggagaaaatttatgtaaccttgggtcagcagagatttctaagatacaacatcaaagcatgatctgtaaaacaaaaaattagtaaactgaattcgtcaaagttta

SEQ ID NO: 231854 - DNA, 439 bp, Homo sapiens
aataatctaattaaaaattttaaatataaaattgtattgaataaataagtcggaaggggaaaaagtcatcatcctcaatgctaataagggagttttgaagcaaacagtctgcatgtagaaatgtaaaaccacagggatcttggaaaagcagtctacagttttatgagaatccagacctatgaggatgctcagatattctgcccaggattcccactctagggtatgcgtctcagagtaataatctggagtatggagagtgacaaatacacacgggcccaaaaaaccagaatccagttaatcttcagtgttaaattaggtcaattaatagtagtgaatactctcaaccacatagaatgcagggcaaaaaaggaaagaagctgtgaagatcacataggcatttagaatacaaaatgtgaaccacagcatgtgagacaatttg

SEQ ID NO: 231855 - DNA, 416 bp, Homo sapiens
ctaaaatcgttgtaagaataggtcagttatgatcagacttcttatacagagcctgttggaactgagtaccccccttttgaagtggaatatcagtaaaatgcttgaagttgatgtgcatcatatcagtttgcctgggagatgtgatgaatgatggtccattttatttgggagacctctctcaatattgcctgagtccatgcactaatagttggttagaccagatgaaatactgattgagcatcttgcagtgaatgggttcccctaatgcattgcctcctcccttgctgatggtatatacggtgcatatgtgtctaaagaactgacttgtaaaggactttgattgtgaaccaccatgagaaatacattttacatcctgacatagtatgcacatataaacacacacaacattttcatgt

SEQ ID NO: 231856 - DNA, 414 bp, Homo sapiens
gttatttatttttgtgtggatcatgagtctgcagcaaattgagaggtgggcagagacctgccaatgtccaaatcacctgcccctgcaaagaaaaccacacttctgtaaagaagagaagcacaccacaccaaaaaacagacatctcccagtgtttcattgtcctgtgtcccacccagaaagaaacactagcagtcctctgcagaaacccctgaatttacatcgaatttggctcccagctgagcggttcttcatgtcatgatggggcactcctcctttgtcttgggatatcatcctgggacatagaatatgagcagggagaaattcagatatgggtgaggatacaatctggtgaggagtggatggggctctgcaaattcatctgcaaaaaaaaaataaatacaaatgacaaagatc

SEQ ID NO: 231857 - DNA, 232 bp, Homo sapiens
tcttttttgaaaatttactctaagaaataaggctgaccttgagcacactgctgtgtcaaaactctgtcagaaatacacataaacttacataacactccatactttttttgtggtgaccctttccacatgacttttccttcttaatagtactgtgaggttcttgaaaaaaaagctgggtctaattcgtacatcgagtaatcaataaaagcattccagctgtgacccaaaaaaa

SEQ ID NO: 231858 - DNA, 539 bp, Homo sapiens
tgaaaaatgtggcaggtattattactaataaagaagtacccaactatgggaatgattgttccttccttatgaatgagagcagctctctgttcaatacgattcatactcaagttctaataaactttctttagcaagagagcaaagagtatggtacagtcagtccacccaggttgcctgttaacctggtgcttgaaggaaaaaaagtaagaatttgccctcatctaattcctcacttgccctcaaacatgtcatactacttgacaatggggctttcccacatttgtcccacatttgcatggtctgccttatctcttacctggcgaactcctacactccttcaagacttgctccaaaatgcacttgctagatcttctgacatcaactgccaccttgggctataagttacgtgtgtctcttcccccactagacaattacctgatggaagaatattgttcttaagatgttaagatggtgtatgtgtggcatagtatttgttcctaaatgtaaaagttattaaacaagttttctgaaaaaaaaaa

SEQ ID NO: 231859 - DNA, 550 bp, Homo sapiens
ctaggtggacacacaacttggatatcaacagggagcagaaaacaaacccactagcaggaccaaaaggcagacccatcagcagaacacaggcggcagcttccacaactttgaggtacatcaacatcaataacagatcaatggacccacttaatggagctcttaattgagtagaaaaaaatatttaagagttttgccgctctacggcaggaaagctaattttcctaaactgaaatatccttcacttcccttggggaaaaattttcatgaggactaaggtaatgggaaaacctgttgcttagaacttttaacttggccttgaagatggaaactcatccaggatggagaataatgtagggagactagttaaaaatagacatggaccagtttactttcctgcttatttacaagatgccttatttaaatgacactttgatccaacatcttactaaacaagtgacaacaggaaaaaataagaggcagttggtgcacctggagatgtgatattgagcccagtcaggaggcctgaggttctaataaaatttccttagat

SEQ ID NO: 231860 - DNA, 511 bp, Homo sapiens
gggtatggggagtgtttccaattgttacagtgagataagtctcgcattagattgcactttgatttcttttctttgagctccctagttgccaactttattttgtgtcctaggagtaaggaatcctttttaggactcctttgataatctaactaaatttgaaaatgcatttatccttggtaaaaatctgtcttattaccaataacactactatttgtctctgtctgtccttgtcattttttgttgtatctctgtaaggggtacgttcataaggaaaaacatagacataggcctcagtaagtattttgcaagctggccctgaaaaccaagtttcaggtttcttgtaagactggtgtcctttagataaactttaccctggtcattgatcaacctatgagaaccttccttgttctctttctgttttgttagtgagagtcttgctatggaagaattataataggcaccctgaggaatttttgatatgaacaaaattgtttatttaaaaggagcctga

SEQ ID NO: 231861 - DNA, 547 bp, Homo sapiens
gtgcagtcctgctgcccagcttgttgctcctgcctgtctccttggccctgcctggaagaccctcactttcccatgccctgtgcagagcctaccacctcctctgccatctcttccacagagaggccagggcttgagcacataggccagaggttgtcctctggcaatgcccccaggtgggcgctgtttggccagcccaggcttttaaaaataacattggatttcacataaaaattctacattttgcttccctgaaaaaaaaaatcaggtcggcattgcagggccacacacccacagggcactatcggcagagctaccatgggactgccaccttctgagtcacctggttccctgcagttcccactcatgtgccagctgggccctggcactctggagcttgccaccctgcttagacctgggttcctgccctggcatcctggctttccctgatccgaggcagattctatctttgaagctcatctagtaaatgtcaaaactgagaaactgattccaaactgggtcttagtgttttctgagaattctccaggcc

SEQ ID NO: 231862 - DNA, 2274 bp, Homo sapiens
agggcaatacagtttttgtaaaattttacaaaaattggactccccccattgaaacactgtactttgaaagaaacttcaaattcagcatattttttaaaaatctggatgatgactcgttttctttctttcaaaccttttaatttcgacaacatttagcttaaggcaaattttatctttgttatagctatttcagaacagcttttaaaatgcaatttaaaaaatggcatttagcaagcaattgccttttcaaccttaaccatagagcctcttccatggattccattatattttattaacataagttaaaataggagtgttctgggtttcacaaggattaaagttcctatctaatgtgcatgtaactaaacgcacgtttacgtacataatagctattggtcacagtttgtatgatggtctttcagccagaaaacagggctgcagttcttacagtagtccttgaataatgacgttacattcaacgtcttttcattattgggttatgagaaaaaaatttgattccaggtgggtgcccctgtctgtgtggaatttgcacattctcctcaagtctgtttgggttttctctggatactacagttttctcccacatcccaaacacacgcatcgcatgttaggtttatcggcttgtttaaatggtcctacttttgagcaagtgcgctgtgtgtgtgtgtgtgtgtgtgtgtgtgtgtgtgtgtgtgtgtgtgttagtgcaccctgcgatgggatggcatcctggccagggttggttcctcctttgtgccctgagcttctgggatgggctctggcaacccataagcctgaactggaataagcaagtaaataattattttgctttgtttatttttcttaaatgtatgtatagctcacatgcttacatgtacttcattgtttgatattagaagtgtttttgcctttatttagaagttcggtgatatttctgtaactagaaataagccataagaacttaactcttgtttattatatcaattagcctatggtaaaattgattttattatactacatcatttctcttaaagtcacagtttccaagaacctatcaaggatgttaggtaaggacttactgtatactagttcaaataccactgggctggtattaagactaccccctcactcagcagtgtggggctactcaggtgcagctgtcagcaagccttgctgattggttccttcaattggctgcttcagattccatgcaattgacaagtttgtcttcagagaggaaggccttttaactgaaaactgcaatcaaaattgttccttacattgcacaaaaacagcattttaagagtgcaatagtcattcaaattgaggactacatcctgtaaccttttccagctggactgaattaaatatgtaacatccccaggagtaatttttgagaacagcactcggctttaccttgactactgaatcattaaaacacatgtggaaacattccacattccttccatctgaccctttggcgataaatggccacctcctggcaatttatattgaagtctatttctaaaaaaataatgtacgcccacttggtcagcccttaggcattttgctgtgtgcttgaaaacattgtcatgtgttcctggatttatagaatatccacattctcctttgagtctgctgataccaatttcttattctttcatctgcataatagcttaatgttaataacttgaaaagttcagttctgtggatttaaagagggcaatataagttgattgccctttaattattgaacttttaaatattcgtcttttgtctgtttcctaaatgagcagagaatcaaaatggcatagttttcaatagtcctggcttagaggaaaactaattgcagacattcctttctttctagaaaccttctttattacttagagtgtagaattccatatttaatatgtatttataaacatatactcctcaaaatgaacaaagcagtcatgtaaatactggacttggatcaataaaatgctatgaatgtcgtatatatggatttcagcctagtttttgataaagtctctgatgatatttctgttgtaagaaggtgaaatatggcctatcagtaaggacagcaaaatgcactggacctcttggtggtggtgaacagcctcctattccttgtctaggttattgtcaggttgattctgtaataatctctggtctcctgctctcccaccgactccttatttttagactcttattgtcttatttcaaacaatttcttacttaaagtattac

SEQ ID NO: 231863 - DNA, 308 bp, Homo sapiens
attaatgctcttgcgtgccctcagatggctgcgagggtggagataggctagaacaaacaatgacaaatcaatgacattgcaagggggcggggctttcaacagagaagagttcaggcgacaagccgaggtcctgtgtccctagtagctcgccgtgatcgtatagtggttagtactctgcgttgtggccgcagcaacctcggttcgaatccgagtcacggcattgtgaggacaatggcacggcaaggggagtttgttttattgtaccaatccgtttttaatcctgagttcacaacattgtggaaaatgga

SEQ ID NO: 231864 - DNA, 509 bp, Homo sapiens
gaaaacatggaaacaatgtttcatcttaggttatatacctttctaagcaaaacccaaaacctttcaaagaaaacttgatgaaatacctaaaaattaaaatctgttgcctcacctcgtcccctgcaaaaattataatgagagtcaaaataaaaagttaacatgaagaagggggagatattgatatgtaaagaccaattttcttaatttataatgggatctttaaaaatcagtagggattggccgggcgtggtggctcattcctgtaatcccagcactttgggaggccaaggtgggtggctctctcaaggtcaggagttcgagactagccgggccaacatggtgaaaccccatctctaccaaaaaatacaaaaaaaagtagccgggcatggtgccacacacctgtagtcccagctactcaggaggctgaggcgggagaattggatgaacctgggagacaaaggttgcagtgagccaaggtcacacctgggcaacagtgagactctgtctca

SEQ ID NO: 231865 - DNA, 491 bp, Homo sapiens
caatggtaaagttaggcttttttttccccaaccaaaactttacttaggcagcaataccagatgctaccaaaaacctccagaaacacatttaaaattttgaacttccaatttataatctattaattatttctgaccattcaaaagccaatgactactaattcttgatactgccacagaattcagagctttcactggacaagttactgataccagcctcttttttggtgagcaaaaagtttttaaaaatgtgattttagctgaattggaaaaagaaagttagcaccttttttccctagtacagtgcttataaataaagaaaatactctaaattctaagtttttgcataagctaaaagataagttggcttagacatgtgacaatttttccaagaagctttcactaactctcaaactggattagaaaacctctccatggttctccggcacatggtacttatctcatggtaattagctgtgtgtactataaatgtc

SEQ ID NO: 231866 - DNA, 480 bp, Homo sapiens
agccatggaatattgctagctgagagcacatctttcctcatctggccagaaccctgcctactcacccagggcaacaatccctgcctatatacactgggctcccagtcagcctgtctactgtttcattcctaaacatgaaaggaaaacaaaggattaccagatattaggaggaaagtctgagataataaaagagaggccaagataaacaacaggaacacacgacctagaaggaacacagaattcagggaatagaagaaaaaagaatttttaaaataaaagaacaaaaatcctcgaattggtatttctagcaacatttaagaaaatatgcataaaaccagaacagaatactctgagaaagaatacttggaaatttacaaaaataatagtatataaaaatccaacagaagcactggaagaagagggtatggcaaggtctcagaatataacacacacacacacacacacaaaacaaagaaaccg

SEQ ID NO: 231867 - DNA, 479 bp, Homo sapiens
ctgtttatagtgaataatcctgaagaaggaatagctttcaagaagggaacgatcatcagagacaaacactgtagacagagggtttttctcttgtactcatgtctacagacaagatgttattctcttggaacagaagaaaaatggaacagaagacatgtgtagagagcagggaaatttgagctacagaatattatacaagcagtgaaatgcatgtcattttctaattgcttcgtgatgtcaacacctcttcacaataccttgcaaagaaagtctgcaaatttcaaaccacctctttgcaaagtgatttctttatgtcactaggctgcacatactcacagcccacgctctttcagttgctaagtgcactggattgccacagtatgttccagaggctccagattgctctcaaatgtgaaagatgtgcttctaatcggaagcaaagttcttgcctttcaaatacaatattatctaaaaacaaa

SEQ ID NO: 231868 - DNA, 220 bp, Homo sapiens
tataaggtgtatatgaaacataaatgaattttatgggtcccatcccgaagatatctcataatatatatgcaagtattccaaaatccaaaacacttccggtcccaaggatctggttaagggatatattcaacctatactctccataaaatgctaattaatgatttcttctattaataaccattgtgagctttctttgcagtttaatttgctttgatgttgg

SEQ ID NO: 231869 - DNA, 151 bp, Homo sapiens
tttttgctcttagagttctatgagttccttatatattttagatactaacttcttattgaatatgtggtttgcaaatattttctaccattccacaggttgccttttcattttcttgattgtctcttttgctgtgcagaaactttttagtcga

SEQ ID NO: 231870 - DNA, 486 bp, Homo sapiens
tttaagacagcctggctgtctgagagccaccggagtcgagactggatgcccggcctggtgcccgtgggccagcaccgcctgaggaggaggggtctctggaggccacaggcagagccactgagagggatctttaagcagagggccccacacacctcctgggacccacgggtgtggctgccatgcagggtctgggagctacagagagtcgggaaccaagggcggtggctcacgcctgtaatcccagcactttgggaggccaaggatcacgaggtcaggagatcgagaccatcctggctcatacggtgaaaccccatctccactaaaaatacaaaaaattagccgggcgtggtggcgggcgcctgtggtcctagctactcgggaggctgaggcaggagaatggagtgaacccgggaggcggaggttgcagtgaacccagattgcccactgcactccagcctgggcaacagagcgagactccgtctcaaa

SEQ ID NO: 231871 - DNA, 445 bp, Homo sapiens
tcggcctcccaaagtgctaggattacaggcatgagccaccacacctggccaccttatcccctctttagggccatcacaggccattttcccactgtattgactcagtttaaactctattcagttgatacttagacgctgacaccatgtagcctttttccaggcacttaacgctaactttttctttttttggacacagggtctcagtcccctaatccaagctggagtgcagtggtacaatcatggcgcacttgtgcagcctttacttccccaggctcaatcaattctcccacctcagccacccaagtagctaggacttcaggtgtgtgccactacacctggctaattttttgtatttttagtagagaagaggtttttgccatgttacccaggctggtcttgaacccctaaactcaagcgatccacccactttggcttctcaaagtgc

SEQ ID NO: 231872 - DNA, 355 bp, Homo sapiens
ttattaattccgtaagtcggaagtcattagtcctgattgatgccttgtggggaggagggaaacacacactacttgtaacataataggaagatggagcttttcctgggctgtgtctctagagagttatttttaaaagggtgtttttgttcttccagtcttgggatcaaaacttcataaaactattttattataatgtaggtattaatgtggaaaatgaaaattccctctgctaaagaagctttttattccatccttttcctgaaaaatccaaaagataatatgatgtcagtaacattaagtggcaggaagaaggcaatgttattatactaagaatcttttcagatgaatgacaatt

SEQ ID NO: 231873 - DNA, 269 bp, Homo sapiens
agggcagaggaacactttgaactgcatcttgactatgcaagcagctaaatccaaactgagggaaactctacaacccagattcttcaacagataaattgtaagaaaaagaaaagtgagaggccgggttcagtggctcgagcctgtaatcccagcactttgggagggcaaggcaggaggatcgcctgagcccaggagttcgaggttgcagtgagccatgatcgctccattgtattccagcctaggagatacaggaagaccctgtgtcttaa

SEQ ID NO: 231874 - DNA, 513 bp, Homo sapiens
aagacccatgctcagagaatggtaacatattttccagtctatgttatgcaccatggatgttaggcaatgtgtgctattgccaacacatggtatttgttgaaatacatgttgctttgaccttacctaatggtgcttttacctaacttgaagtgctttttgtgttcccaccagcaaatcattctaacagcaggctaacaatggtgaagtaaaatgaacatttttgggccgggcgcagtggctcacgcctgtaatcccagcactttgggaggccaaggctggtggatcacctgaggtcgggagttcgacaccagcctgaccaacacggagaaaccccgtctttactaaaaatacaaaatgattcaggtgtggtggcgcatgtctgtaatcccagctacccaggaggctgaggcagaatcgcttgaacctgggaggcagaggttatggtgagctgagattgcaccattgcactccagcctgggcaacaggagttaaattttgcctcaaaaaaaaaaa

SEQ ID NO: 231875 - DNA, 444 bp, Homo sapiens
tgggtaaagtattttccaaaataatgtatcccttgtcttcatctttggtgagtatgtgttctatttcctcagggaaactcttcactgaattttatgtaatggacagtcatttttaaccccataaatcccaaatacatcatttagacaaatggccatagtatcttctaggaattaatctcagggtttaagaaggaaaagaggaggccaagacagggtggaccacttgaggtcaggagttcaagaccagcctggccatcatggtgaaatcccatctctactaaaaaatacaaaagttagccagacatggtggcatgcacctgtagtcccagctactcgggaggctgaggcaggagaatcgcttgaacccaggaggcggaggttgcagcgagctgagatcgtgccactgcactccagtctgggtgacagagcaagactctgtctcaa

SEQ ID NO: 231876 - DNA, 355 bp, Homo sapiens
aggtgcatgcaccccaagagatggagaaacagagaccagagcgagagacacgcacgcggacagaccagaaggctgcagagagggcgagggagaaaaaagtgtcgaggcggggagtggcgggaagcggccgggagcggggcgggcgcagcagagcgggcgcggcgccgggagctggctcgtaaaagccgcgtcgagcggggaaattaccgccagaatcgctgagctccacaaaacgccgcccgcgcggcccgccgccgagcccgctccaatctccagcctcatcgccgcgcgggctggttatgcatttaaatgttatttaattggattgcggaggagctgggggccagagcggccg

SEQ ID NO: 231877 - DNA, 530 bp, Homo sapiens
ataagtatctccttttttatattgtcttacctattcactaattataacacatagaaacaatataaaacgatgaagtttaagcagtaattgttttgagaaaccattctgttgataatttacatttatgtttattaggaaatattgttattattacttagaccaaagttgactgaaaattgaaaactgtgggctacccgtaaggttttttgctttgaaatattcaatacctaaaagccattttgattttaaaaatgaagttgaccagtcatcttgtatgatgacctcataatattttataagtttgaacttaaaatagttagaagtagacagttttagtaagcttttgtttttatttggtctagcctaaaagacattgatttatctcaaagatttttagcagtgtgcaagggacaaatgagtatgacatagcttcctagacaagcagtgttcactcaatgccaagtaaacttttctaagttcaaaaatatttttatattaaaacacataccaatgtattgatgaacaaaatt

SEQ ID NO: 231878 - DNA, 481 bp, Homo sapiens
cggtgagcacttgggccatgtctccttccagctgtttgcaaagttccaaagacagcagaaaatgttcattttgtgagcactggagagaaaggatttggctataagtgttcctgttttcacagaattattccagggtttatatgccagagtggtgacttcacatgtcatgatgacactggcacaagtccaactactgggagaagtctgatgatgataactccatcctgaagcatacaagacctggcaccttgtccatggcaaatactggacgctacacaaatggtttccagtttttcatctgcactgccaaaactgtgtggttgggtggcaagagtgcagtctttggcaagacaaaagagggcttgaatatcttggaagccatggcgcactttgctttctggaatggcaaaaccagaaagaagaccacgattgacaactgtggacaactccaataaatttaacttatgttttgttttaaaaa

SEQ ID NO: 231879 - DNA, 356 bp, Homo sapiens
ccattctcctgcctcagcctccctagtagctggtactacaggcgcccaccaccacgcccggttaattttttgtatttttagtagagatggggtttcaccgtgttagccaggatggtctcgatctcctgacattgtgatccgcctgtctcggcctcccaaagtgctgggattacaggcgtgagccaccgcacccagcctagcctggttccgtttatccacagcactgaggttccttacctggctgatgcctttgtgtgcctggtcatagtctttctcccctgcagagagggttgcctgcgtgggaaccttctgtgctgtttaccctgcatctcagcgcctagctctgtgcccccact

SEQ ID NO: 231880 - DNA, 273 bp, Homo sapiens
ttctgtgttctcttgaaagtagctttacatgtattaagcaatcctggctttagatattagggacaataaaaatatctgcaattttcccagttttatatagccattgtttgcaagtatgaaaacctgtcttttgttactgaaatattatcttttattttggcttttttgataacttttatgtttgccttgagcaagtcacttatcttttctatttgtgttttctatttcagtttatttatgaaagacagtaataatgattgtgatgtaccttac

SEQ ID NO: 231881 - DNA, 318 bp, Homo sapiens
aagcaaaggagtgttttgatcatgtggggccttaagaagaccaacttgggcctgggcacggtgactcacacctgtaattccagctacttgggaggctgagggaggagaattgcttgaacttggaggttcaactccttgagccgagatcgcaccactgcactccagcctgggcggagacagagtgagactttgtctcaaaaagcaacaacaacaacaacaaaaacaaaaaaaaaactagcttgggagaaactgaggcagaaaatccaaagaggaagtgagacgataactataaaacagcgatccccttcaccacctccc

SEQ ID NO: 231882 - DNA, 495 bp, Homo sapiens
ttagctcggcagtatctaataagccatactactgccacctaaaatttccaaagagaaattaaaaatatgtcagtaacagtatataatcattgcatttgaagaatcttaatgatgccttcccataaatgctatctaaaacagaaatccatacattgttttcagaaatgtagttcttttccattctggatttaaaaaaaggccactgacctaggaatgctatattctaaaaataaataggaaaaatgttaccaataaatttcaagttattttcacacttcttaaatctttaatcattactgtattttttatgttactttactacaaagcagactttgacatattaagtaagccaagtcttaaatctaacctatataaagtgaattagatcctaatttctaaaagaggctttaataataaggtttcaccatattcacaacatggacctggaggataaaaatattaacaacaattaataccttgaccatatttctattg

SEQ ID NO: 231883 - DNA, 683 bp, Homo sapiens
cctgtactcagcctctctgtccccacacgtgactgtccttagaatagcaactgggtcctcggattccagtaccccaccatgactgccgccagccactcctatgtcagtcttggctgtctgccaggcactgctgatgattgcccccagaaccgtactattaatcccattacacagatgagcaaactgagacccacagaggctgagtaacctgctatagtagtaagggtcagagcaaggctttcaacctgggcaacttgcattccaggccttcctcatagacagagtctgtgtctattaggaaaggctacaaggagcaggtggcatgtgagccgccacggagcttggcttggggctttctaagtggctagggcagaggggtgcagtccaggcagatggagggttggggcagaagggacctgtgaagaagtcctcctgtactatgggatcctcccctccttatcagggctctggcctggagctcagttcaaaggcttatctatgcaggaatgaaggcaacattcttgatgtagagtctaagagtctgaaggtcagggaacctttcttggataccctcctttctgcctaccagaaccctgtgtttcctgcctgctgggaggcaagtggaacacagtagaaccagatcccaagaggaggagaggctggagggggacccacagttgcat

SEQ ID NO: 231884 - DNA, 406 bp, Homo sapiens
gcagaagcccagaaacagaaacagaaacagaaacttctggggagccagtaccagggtaggaaaacttaaagtgtaattgactcatagctggaggcttagggtggacaaatttgagagctaaaaaatctatagtggccaggcatggtggctcatgcctgtaatcccagcactttgtgaggctgaggcacgcagatcactgagctcaagggttcgagaccagcttgggcaccatggcaaaaccccatctctacaaaaaagacaaaaagtagccgggtgtggtggcacatgcctgtaatgccagctacttgggaggctgaggtggatcacctgagcctggggaggttgaggctgcagtaagccgagatcacgacactgcactgcagcctgggcgacagtgagactgtct

SEQ ID NO: 231885 - DNA, 352 bp, Homo sapiens
caaaaatgtgttgattgtaattgttcccattttgattaataaagatgtgtttcagtctagttacaatgacttaaaagtcaccgtccaaagctgcaattacgtttgcatcaacctagtagaataattataccatagacaagattacaaagcaaatgaattatttctctaactgaatgcaaatttattcatgaagagagtaaagtaacatttgcaccagaaaatcatagctgaagccagcaattttccagagggaaatttgttaatgaacctttagctattcagagaataatctttttcaaagcttgataacatctataaccctctccctaagacaaaatttactaaggttttt

SEQ ID NO: 231886 - DNA, 236 bp, Homo sapiens
tatgctgcacctccttgaggtccaccgttttttagctcccacataagagagaggacatgtgatatttgtctttctctgcctggtttatttcacttaacagaacgtcttccagttccatccatgttgctgtaaaagacaagatgtcatttttttatggtgtgttattttttaagaaacaaaagacagtaaacgcagtgctgtcttgagaaacacagtggcccctggggcctggattc

SEQ ID NO: 231887 - DNA, 482 bp, Homo sapiens
ggttttgataaacggggggcgtggggggaatgtgaaccttgaaagagccaatccctcggatgaatcctgagtggctaatagcctaatttcaaaagagccaagtggccatttgcttactagaggtcgcacacatacttggagttcctggaaaacctgcatgtctgcttaggggctttcatagctgcctgttcatgtttgtgctgcctgagccaaccaatagactgtgacctatgtcaaccaatcagaactcagcaagtgttgaccaatcagaactcaccaaacatcaaccggtcagaactaagcaagtttgaatcctttatttgactaagtggacctgagtggaacctggatgggatctttcactataaaagaaaaaccttccctttgctctctggaacgtaccttcattttacactgaaggctgtgtctcttcggtttgccaactgttactggaataaagtctctttcctctaaaaactctt

SEQ ID NO: 231888 - DNA, 413 bp, Homo sapiens
ccttgatctaaatatgaagtgtttttactctgtgagcagaaagtttttgaaactagttcatgaaggtgagtccagtggtatttttcttttttacttctcagccttctacgaaaggcaaatataagacagcaaaatccaaagaatggagttattaaggctgcaagtggagtccgaggccagttccatgccaggcatggtgcgtgcactgagagacagggatcctctgctccaggagccgaaggcacatgctgttttgcttactactgaactctactacacatttaaagaagaaccattaccaatcctactcaaactcttccaaaaaactaaagaggagggaacacttccaaactcactttacaaggccaccattaccctgatacccaaaccagacaagaacacaacaacaaaaa

SEQ ID NO: 231889 - DNA, 1014 bp, Homo sapiens
cttagtacagccctccaactctcagaaataatctgattggaagaggtgactggctttatccctacctgcattgatggtgtctctctcctccctcagggcaggcagcctagaattttaaaaaattactctcttctccttgggggaaggcctgaagacttgtatttgttgtgaagcctgaagaaaaaagcgccaccagttctcagggctcctctccactgtgactgggagctttgatgtgcccttttgatgttcctgccttgaggcagctggagaagattatcaaaagtagccttaacagttcagggtggagttgggggtgcagcaccataacacgtgggactgcacatccctcacagtaactcactgagatggggttgccgtagtgcaggtgggattgccaggtgccaggtgcccctactgcagcctgcacggaggggaccgtcattttcagactgtccttttagcaggacttcaatgtcaggcctccaaagaagtctacaaattccatcagtcagtaacggcttggagttccaaagcttatgactcaaaggtgatcagagcatggacctggggctagtctggattggtaactgctaaacttggatacatggcttctgatggccctgctggggagaccatgtggagagatggcatagagccagagattcacgttccaggagccctgactgtctcatctcagggaattgaatctccttgtgctccagaccctatgagaggatgccatcccctgctaccatctgactgcaacctcaggagacaccccaagccagaactgagcagccaagccactctcatattcttgacccatagacattgggagataaaaactgattgttgtcaattttagtcagtacattttagggcaatttgatgtcctagcaatagactagtatatttatccattgctgcatcttcttctgcttagattatgatgcatgttttttagctccaactagtatctaaacttgtcatggtctttgcttgaaagtttga

SEQ ID NO: 231890 - DNA, 706 bp, Homo sapiens
ggacagggcatgagtttttaatcctgggccacaagaggccctgacacttcctctgttgctctcttgaaaccttcacgaaaggaagccaacctaggcagcatccaacactgactgccagacatgtaagtgagaccatcttggatttccccgcccagacgaccatctggctgaataagtgaaatcaagtgaaggcagaagaggagctgcccagcaacccacagaatggcctccaaagaagtctacaaattccatcagtcagtaacggcttggagttccaaagcttatgactcaaaggatacatggcttctgatggccctgctggggagaccatgtggagagatggcatagagccagagattcacgttccaggagccctgactgtctcatctcagggaattgaatctccttgtgctccagaccctatgagaggatgccatcccctgctaccatctgactgcaacctcaggagacaccccaagccagaactgagcagccaagccactctcatattcttgacccatagacattgggagataaaaactgattgttgtcaattttagtcagtacattttagggcaatttgatgtcctagcaatagactagtatatttatccattgctgcatcttcttctgcttagattatgatgcatgttttttagctccaactagtatctaaacttgtcatggtctttgcttgaaagtttga

SEQ ID NO: 231891 - DNA, 537 bp, Homo sapiens
  misc_feature (36)..(36): n is a, c, g, or t
  misc_feature (49)..(49): n is a, c, g, or t
  misc_feature (58)..(58): n is a, c, g, or t
  misc_feature (73)..(73): n is a, c, g, or t
  misc_feature (99)..(99): n is a, c, g, or t
  misc_feature (102)..(102): n is a, c, g, or t
  misc_feature (140)..(140): n is a, c, g, or t
tgcaagatgcctttttcaatttggacttccagcctncaagaagtggaancaataaatntctgagggtctgttntagcatttcctttgaagcagtggaanttntgtgcaggcggcaacatgacaccggcctcttatacatnaaggtgaaatacttcctgcctcagtgaaatccggctcccagtgaatttctttggtttagagagcaacttgaggattttgcatttggcaccattcaatttccttggcatctctccatagtcaccatttagaaggctcctggtcagtaggatttctctccctcttacactctgtagagattaaaaaaggattgtattacaggggcttggaaatgtgatggaaaatgaaatttgctttagcaaaaatggaagcttttgaaactcaagttgttctaacaggacccttagacaagaatagtttttaggggagcaaaatggcagatacggtttaagttccttatttagattgccactaagaaatattatgatgtgtaaaatcactcactcaaataaagcggat

SEQ ID NO: 231892 - DNA, 357 bp, Homo sapiens
catttaggggatgagatgagacagagaggcatggcgggagaggggtgacagcttggatcccagctgaggaggtcaggccttaccctgcagccttttccaggtttcaaggccaaactctcagactgctgttaaagggaaatcattctgggggtgttatggacacagcagggtgaggtagcaggggtgggtgaggggccatagatggagctgctggggcctgcggtgggcagaggactccagagcagagatcagggactcctagggtgcttgggagcacagaggactgtgcctcggacctcttcctagggtaagcaaatgccaacaatacctggtgtcactgaaaaaataggacaatag

SEQ ID NO: 231893 - DNA, 410 bp, Homo sapiens
ccattaggtgcttttatattcatctcaaaaacaaaattctgaactcaggacttggcaaattcaatacagaggagctcctaggattccagttatcctgccaacttctccaggaagaaagaaacaacttgcatgggtcttctgctgttggcttaattataaagacatcattttgcaagctgaaggctgagtttcattttaaacaggtgcttaggtggtggtattcgtgaatacttttcattccaagcaagaagactaaataagtagcaagtatggatgacttcagggtttaaaaaaaaatgtcttccagtttcagccactaccatgataagcacagtagagactgcagcagtaaattccaaatatgtgtttctaatttgacgtgaaagatactaaaaaattatatatttaaa

SEQ ID NO: 231894 - DNA, 477 bp, Homo sapiens
atggtaagttagctgcttgagtccaaactgtggtttacttttttagtaacctgggacaagtgacttcgactctcattatctcaatcataattacctcacttataaaatggatagacaaatcctgtaacactgaaactcacctgtgcatgtgtggatgaaatatgattacgtgtgtgaaatttgtagcacaaagaaagcccttcctttgggattgccttttttaccttgccaaccaagggcatttgtctccattattttttagttttttctgcccctctgaagccgaatcatttccccccacatagacactctcgcctttgaagtatggattacatatgtctgtgggtctcacttgcatgcctgtctttccctctaaattgtgaactcctgtgtccttactgaatctgaatcctcacaccaggcacttaacacacattaggtgagttgtgttaagctgaatgatactttaaaaaaaaa

SEQ ID NO: 231895 - DNA, 611 bp, Homo sapiens
aagtgggaaagtgaagtggtaccactggcatctaatagggattagggatgtcactaaacatcctacaatgcacaggatggtctcctacgacaaagagttatctggcctaaagtgtcaatggtgtcaaggtcgagaagccttgtttcaaattattcatttactctgttttgcccaaatatttggtggcacttaggaattcaaaagaatgtagtttctgaattttctctggtaggctattccagttttttgttattgttgttgttattttagaggattaaaaaaataaaaagacaaaggtggttctttaaatatgggccatagatcattggtcattagtaagggttctctgtgtctaaaatgctgtttgcatgaaaagactgagctttataaatgcatcttaaataatatttaagtattgaccaaaagtataaaaaggaacatctggataaatgattctaaaaattatatctagaaaagagatgaataaatttcattttccactaacaagttgtcacaagataggatgtcattcatggggtgggtcttttgtttaaggatcacttttttttttttttgaagagcatgtgatgttcatatccatcaatcttacc

SEQ ID NO: 231896 - DNA, 819 bp, Homo sapiens
caggtagagtgcttctcaggaccaggatgaactcttggtgctggtgttttgggcagaaagagcccctgggtggaggttgaggccattcttgaagaaagacaaggataaagaaggattttggaggggaaggttcttctggaaggggagggtggaagctttattcagcttctacagagatgtcctgccagcagagccagcagcagtgccagcctcctcccaaatgtacccctaaatgccctcccaagtgtactcctaagtgtcctcccaagtgtcccccaaaatgccctccccagtgttcagccccatgcccacctccagtctcttcctgctgtggttccagctctgggggctgctgcagctctgagggtggtggctgctgcctgagccaccacaggccccgccagtccctccgacgccgacctcagagttccagctgctgtggcagtggcagtggccagcagtctgggggctccagctgctgccacagctctgggggctctggctgctgccacagctctggaggctgctgctgacctgggccatgaggagcacggaggagaaggactggcagatcccaggtgctgaagatgtgtgtcagcctgaggcttcttttctctcatttcccatggaaggacttcggaaatgccttaagttcccctctttatcctgcccatgttcactccattgtagggttgaagtctagcttgtgatattttctggcctggctttccctctcagacatagctctttggagaactaggtgttgtaattcagttatgaagctattttctctgtaacaataaagctttttattcctga

SEQ ID NO: 231897 - DNA, 5428 bp, Homo sapiens
  misc_feature (1086)..(1086): n is a, c, g, or t
  misc_feature (4623)..(4623): n is a, c, g, or t
ggcaaagggcctcagccccgccctactgactgtgaattctacaacatatggagcgcctaccttgtgcaaggcattgtggcccttcagagacttgaagacagtgtgtgactctcctgtgagttaagagcactggctgagtcagacagacccgagtgacaagcccagcttcgctccctctcagcggtgagagccaagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggnacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtanggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatgaaaaaagaaa

SEQ ID NO: 231898 - DNA, 317 bp, Homo sapiens
ctaaaacaattagatgaaaggttgatggggatggcttgtgctgatatgactgaacccagtgatcaatcttaatatcattcaaagtgggacaaccagatgttttgtctcataatacactataatactctgaggtattcgtggcaaaaaaatttttgaacttgaatctaataaatcctctgtatctaaactactagttacaggaaatacaatatataagagttaaaagacacaaaaaggataccatcagccaagtccaaaatgtaggaaattccatagaacaaatgacctggtttcttcaataaataaatgacattaaa

SEQ ID NO: 231899 - DNA, 467 bp, Homo sapiens
tatgttcaatatccattgacatttaccgtgttagaaagtaaaacagaaatttgtaaaaatatgcattatttcctttaaaatagcattaataaaccatatgctgtacatgttatcataaataacagttgaaaaataattgtattttccaaaacaaaagaattagtgagaagagtgacattgttttgcatttttgctgtcaaatgtctggctgagtagaagatagctgcattctcttacctgcttctacttacattcaatgtgttgagatatgttgttttggttcaaatatatgaaaaaagtctgtcttcacacagatacgtggttgaaaaaaggaagactatcttaatagccttttcaaataattgtggatatttttcttagattacataccaaaactggacaagtatagtttcttaaaggttaattgcaatgtggaacctgaaaccataaacttttcaattggtcta

SEQ ID NO: 231900 - DNA, 480 bp, Homo sapiens
aaaactatagtgctactatataaagttatataaaacacaccagaaatagaatttttaaaatatgaagtgggttctagtattttttccctacatcccgttgagtcattgtgatgtattcccaccacttggtatagttcaaatttctcccttccttgtttttactgcagaactctttactgtcccaagtagagtgagactgaaaccaaaatttgagcactgggtccattcattcaattgttcattcatttacacgttaagtatgaagcatctataatgtgaaatgcttgctgaattttcaggaggccataagaacggtatcaggcttggcctctcccctctcaaacataaaggctaattctagtgtttttcagttttatctggttggaaccctagaattcctgcatactgtaatgaagctaaactttacatctaaactggctatatgtattgcactacagtgcataagacaagaaaagttac

SEQ ID NO: 231901 - DNA, 404 bp, Homo sapiens
gggcagcagagtctatgacctggaaggcttttgccctttgggaggggaccctggcagcagcacatggtggagggtacagagggaaggggagcctccgaaggacctgccccagaccctcctctgcagatgggtggccttcaccaggttctggatattcccagcctgtgccttcctgtcttccagcaccagaaacctcctcccaggacagaagggagtacggggggtcattgctgtggaccccccatcttcctcatcccaaacacatctatgcttactgtgtatccatcagggccagttatgcctgcaggtttcactctcagccccagtgacaccaggtgggtgagcaggggctgtgggtcactaagatgagcttcctggcagctggactcagagcccctgaggta

SEQ ID NO: 231902 - DNA, 1053 bp, Homo sapiens
ctccacaccaaatggctaagcatttggttctgacattgttttgccggttagtgaaatcacatttgcgattcagaagcacattttaagaatacagaaaacagtgaaaagaggatgaagaatgttaacattttttcctaaatgccatgaatagagcacgcatcagtaaattaaatgtctttcccattcttttataaaacagtgattatttttctcttgtttcattttagcatttataagaattctatttttccatttttaataactgatggaaacaagcatcattgtctgataaatttattttcatgctgtacacgtaactaccactttcatcatccactgttccaaacagatactgaaagtctcttttgtaattttctccttcccagtaattttctccatctacttgcagtgtatttgggatcctgacacctttccattctaggaggatgaagtgctttgggcagctatattttcttgtctgcctacagagactattcaatcacagcaagtgaagggttttgcagtgctagtacaaacagacaaggaaaaaaacatataatttctagttatttatagcctgtgcagctatgtggtcttatttatagcaaactgcacatttgatttgaaaaagtcatggtcatctggaggtcaaattcagatggcagactcaattcagagaaaaggagctgaactagaaggtaagcaagcctgttagactgggcaacttggacttgactttgctccttcaacaatctagagccagttggatgatatttctgcacaaaggtggttggttttacaggttgctcagtctaagctgcttctagtcaaataacaaatgtgaaaggagatagaaaaagctcttcagttgaactgataaaagattacacttagggagaaaatgtatgatggtttgcattataaaaacaataatttgccataaatcaggcatttctaggtttcaaacttttgtcataaaaaccaattttgagcattgcaattttagggacatattttattgttgttattttaaataaaaatctaaaccacaaa

SEQ ID NO: 231903 - DNA, 303 bp, Homo sapiens
gagggagaagaacggggaatcaatcagtggttcattttgcagagaaccaattcatgatgtaaacatgggggaaagagcatcagtaaatttgtgtcacacagcattaatgagaatgtaatcctgccttcatggaattctgcctgggccacacctccgctcctcagaacaagtggagttgagagccttggttgacaggctcaacaggtggatgcttccctctgttaagatgatcagtcttgatctgggggtgtattagttcattcttgcatggctataaagaaatccctgaaactgggtaatttg

SEQ ID NO: 231904 - DNA, 379 bp, Homo sapiens
atgccccatggatggagttctggtgggaaagcccagagcactttgattccagcctcagtctttggcagccaagttcccttgacatccagggcactgaaaggaaaagtcagtacaagacaaatgggcagacgttgaatggtctaaggtaaagtttgagactaaagcctgcttcgctagtaatgaaaaagtatcttttaggtcatgcttttgcaccatatctgaaggttaaaagactaggttggttatttgttgttttaagctggctttatctttacatatgtccagaaaatgaatagcggtagtttccattagtaaatttaattttcttttgaattgattatcaaaatagcagtgcttctccatttccctaacatattca

SEQ ID NO: 231905 - DNA, 334 bp, Homo sapiens
aagagcgaaactccgtctcaaaaaaaaagaaagaaagaaattatgaatcttattgtttccctttttttacctcttccttttctccatgccctcttgacctggagccaggaaggggtcttccatgtccttggaacaaggttacaagctgtagggtcccatgatatcaaattctgtaaactcattcactagaatagtagcttcactgctctgcatcgcatctttcctctggctcagggattgtcaaactatggcccattgaccagatctagcctgctgcctgcttttgaactcccacgagcaaagaatgatttttccaatatttaaatggttgaaa

SEQ ID NO: 231906 - DNA, 813 bp, Homo sapiens
gtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaaggtaaaggcctaacttggtctagaatatgacacttattgtggtggatagccaagcacattgggatctccacatcaaatactgacatttcttctacaggtataataattcatcatgcattttcataattaataaacattggtaaaattaattttacaggttacatgaaacattgaaagacttgttacagagggccatgatatttttcaaagaaatgtgttatactagataatttttttaaaggtgatgtttatcattaatataaagaatccttttaaaagtaat

SEQ ID NO: 231907 - DNA, 467 bp, Homo sapiens
gtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggtatgtaattcatcactttggccttaatatttttcttgtgcattcacacacagcaatgttagatacatccacaccttttgcacaaaagggctagagaagtactgtgtatatgtataaataaaatgacatttgttattgaaaaaaaaaaa

SEQ ID NO: 231908 - DNA, 431 bp, Homo sapiens
agtattatattgagagatatattatggtatacacagagcctgttttttgacctttagcataagtaaatccattgaacagtgtagttactttatgaggtcttacattcattaatgatgtattgtggtacttactgattcacagttgcactttaaagtcacaattaaatactaaatggattgtcccatatatcattaaatattttttctttcttgaatttcttaggtacaatgttagctgttctaaaaaatttgcacttagtcgttggaatcgtaagcctgataatcaaagtcttgggcatcgtggccgtcgtccaagtggccctgatggggcagcgagagaacatatccttaggcaggtctgtataaaccttgcttcaatgtaaaatacccttttcagaaatgcaaggaaagtgcaatgctgtattttgctt

SEQ ID NO: 231909 - DNA, 516 bp, Homo sapiens
tgtgtgtgtgtacaagaggcctaaccctaactagtctgaaatctcagtttaataccaagaagatgatcgcctctgaaaaggggacatctgatctggtgaaccatttgttttcaaatacaatttaggtggccttgtatacctaacatagggtgaaggtagacagcgaccttggacaaaaaccaccgttttgtatacacacaaagaaaaactaagggggtggaaggtaggattggtgggagtgcctgatgaaggaggtgcaagagacggagtcagaatgaaatgaaggggggaggacgtgcagcagcagtcagtttcctacattcagagtgtagattaagctctcaggctagccgatgtgtacttttgcatttatggatttcttggggagtggggaggagaacagaactttttaaaagtggcacaagtatttcggttttcaggcagatcattgcactgtttagctaaaaattaagttttaaagctgaataagaaagcattgaaacataagcacaaaaa

SEQ ID NO: 231910 - DNA, 399 bp, Homo sapiens
gaagagatgtgatgcttcctttgtgattgtgttacataaggttgtaactttcatattgctgggtgcttctctccctcactggcactggagaaatcagctaccatatttcagaggcccacatggcaaggaagggaggccatctttgccaacagccagcaggaaactgaggccttcagtccttcacttcacaaggaattgaattctgccaaaaatgttgcaagcttggaagtggatccttctccggttgagccacagataagaccacagcactggctaacactttgattgctggtggcagtcttgtgagaccctgaagcagaaaatctacacaagccatacccagattcctgatccacagaaaccatgagataataaatgtgggctggtttaaaccactaa

SEQ ID NO: 231911 - DNA, 447 bp, Homo sapiens
gcaggtagaggtcaaagggttgggagatgggcacctgtcaaatttgccaccatgtacagcgtaaccagatgccgaaatgcaggctctggggacagcatctatgggattcagaaagagccagtgacaattccagcacccacttccaatgagcatgctaatgtcacaggcgtggtattcagcaggtgtgacgagaaagagctggaagcggggcaggcagaggctcacctgtctgggtctcctccggggtgccagtctcccttggtggtttctagatgctgtcttcaccgattcacacagactccccccgtggggtaaggataatttgctgatattacaaagcaggaagccaaagcccagagaggtttggtgattttcccgagggcacccagcttctaaccagcggagcaaagcgttgaagcctgggtgacagagcgagattccatgtca

SEQ ID NO: 231912 - DNA, 578 bp, Homo sapiens
ccagccccaattgaacagtgagtgaaccatgattggttcccactccttctgccaatgactgctttaaaaattggcatgtgacacaactctggccaatgaaatgtgaggggagatctgctggaggggcttctggaaaacttgagtttatctttaaaaatctgcagaagagacgttcccttcatcatgaggtttagatacctggaactactatggcctctgccagacccagtggagagctagtagaggacaactagaggacgctaagggtggaagtgcagtttctgcacttggaggaccaggtggaggacaagtagggcacactaagggtgtcagcagtaagatgacaagagccggaatcaaatgagtctccacgtgaactctggagccctcctaccttatgacttcttgttaatagaaaaggtccttatctcttaaggctattttagttgttctgtgttacttacagttgactaagtgatgtgttaagggctcaaaaaatggtgtctattatttattcccttgattctaagaccaatgtataatctttaacatttctgaagttaaaatgtgttttccta

SEQ ID NO: 231913 - DNA, 288 bp, Homo sapiens
tgggcacggtggcctgaggctgtagtctcatctgcttgtggggctgaggtgggaggatcatctgagcctaggaagtcaaggctggagtgagccataattgcaccactgcactccagcctggacaacaacaacaacaacaaaaaggaaaatttaggagaaaatttggatatagctacatgttagataatagtaatgaaccaatgttaagtattccaaatttatgtgaagatcttttcaaaatacttaattctgtagtggttctaaaattctattggcagtcagtaaaaa

SEQ ID NO: 231914 - DNA, 523 bp, Homo sapiens
aatgcacacaaatatatgacaagaggggaacaggcctgtgcctcagtttcccctcttctcccctgtcgctggtctttgcaccccaccactcaatgagcgcattttgttggaaaccacctaagatgctgctgttcttccactaagtttcagaatcactttggtttctgccactggctggccgcccactagcaggccgtgcgagagtccccaggtcgcctgtgcctgccaggccagcaacaacagtctcctctcactggggcttttactgcctcagcctgcaagtttcccttctagtgaaaaccttcgtctttctttccctacccaacctctctcaccacgataacaacaacgaataaaaaaggaatctcttggccagcctttgtaataaaagaatacgactgactgaaaacacttcataattttatcttttttttgtcattgttcgtggttcctcattaacacacttattcccatttttggtggatttttttacttctattatttgggtcacttgcatataaaa

SEQ ID NO: 231915 - DNA, 339 bp, Homo sapiens
caccctgacccctccagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcataatgccgggcatgat

SEQ ID NO: 231916 - DNA, 365 bp, Homo sapiens
acacacacactggggattgtgggcctttcatgtcttcatttccagtgggatacaggaataatgaagtttctaaggcagaataagggtcacagattttatttaggtcattttgctacaattctaatttgtctttctttttacatgtattatcatgccattaataacaaaactttttaaattgtatttttagaagttctcctgggttctagatagactgtgatagcagggtaacctttagcaggttacttacctttcctctttaggtcccgggttctttaccaataaaatgagaatgaaaactgtatctagtagtgtagtttgaggattgtgggtatttgtatttagcacagtgcctggaatacgtt

SEQ ID NO: 231917 - DNA, 574 bp, Homo sapiens
gtaatacagaaagccatgcgcggtagctcacgcctgtattcccaacactctgggaggcagaggttgcagtgagccaaaatgacgccactgcactccaacctgagtagcagagcaagactgtctcaaaaaaaagtaatatacataaataacaaaatattatatagatatagtaaggattttaaagtagcatatcagttcttaaaagggaaggtgaatatgtaagtatattaaatgctgataattattattgcttctggatacatttcaaagtttctttagcatccatttcaaaggtggctagctttgtcgcttttaaagagaattagaattgagattttgcaaaatcacatcccatttggttcttggtattagcttattttaaatgtattttaaacattaagaaaatactaaaattcctatgtgagatagttaagaaatattaacattgaacacaatggaaattaaggaagaactaattaagaaagaatagcttataaaatattagtactttgtaattctgtacattaaacattttccttgcccaagggaaaaggctcatgtattatccctagcc

SEQ ID NO: 231918 - DNA, 299 bp, Homo sapiens
gtagtgctagcggcttcgctgttcggtcctcggaccggcagccgccactggtgttgagctgctaggaagcccctatcggcgagctcgttggagctcgaacccattgtcacccctctgactcaccggcaaaaatggttgaagcagatcgcccaggaaacctcttcattggtgggcttaatacggaaacaaatgagaaagctcttgaagcagtatttggcaaatatggacgaatagtggaagtgctcttgatgaaagaccgtgaaaccaacaaatcaagaggatttgcttttgtcaccttt

SEQ ID NO: 231919 - DNA, 190 bp, Homo sapiens
taaaagggttgcaacttagccaccccaccctaaatgaaacctatcatgtataacatcacattacctggaacaggtttgacttgatttagtaaaaccgaatatacaaaaacgtgtactaaaaggtcaagagatagagaaataatgtttcagtttgagaaataaacatttttttaactttaaatattgactt

SEQ ID NO: 231920 - DNA, 412 bp, Homo sapiens
ggactgcctgaactcagggcttgggatttcagctatccttcagacaccatcaccaaccctgatgttgcaaaaacaatgagagctccccacaagagctgccatgtgagagaagcctctccaccctctctgtgtgtgacaagaggtcacaagcagatggaaacctgccttgcttggcccaggctgggggagtggaaggactgactgctcccatcctggtttgacaattactgccaaggagccaaggacattctggccacaagagtgtaattcagagtaaacagctgagaacgtcattcattgttaagccctttaccactgttcattttctcaaaagaaattattctgataatattaattactgccattcatgcagtgtttgttttatattagatgctgaattgagcacttgaca

SEQ ID NO: 231921 - DNA, 184 bp, Homo sapiens
caatgactacaggactggggacaaacatcaatttaatgattatctgagcaaaagtttctttattcacaactaacattctttattcatataaaatacgttaacagtctagccttctttaaccttagatacacaactgacccaaatattggtttttagaaatacattatgacaattaggtttaaga

SEQ ID NO: 231922 - DNA, 589 bp, Homo sapiens
caagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaagatggccatctgtaagccaagcagagaggcctag

SEQ ID NO: 231923 - DNA, 619 bp, Homo sapiens
aatcagagccatcacactggatagttgtttttttcttatttgactgtgctgggtagtatatccaacagttaatgcagatagtgggtatccttgtcttggttcctgacctaagtgagaattcctctagtgtttccccatatgcaagacgtgttagctatgctgatgttaggactgaaatcatcatgttaagaaatatacatcattcttattattttaaaaatcaggagcacatattgaattttgatgattatcaacatcaatgcaagaatcatccttgcattcttggaataaaatctatttggtcatgattttacatatatgtacatttgtgcttgtatatgtgcactcaaaacttaggcatcatccttgatttcatttctatatcatacgtcacactcaattcatcagaaaagcttgctggtgttgccttttgtgtacaaccctaatttgatcattttctacatttttcagctgcagcattctattgcaaatctgtattgtttttatctgaactaacacaagagtctcctaaatggttcctctatttcttgtcttctacccttacagtcttttttgcacaaaaatcccttcagtagtttcttatcctgcttaaaataaa

SEQ ID NO: 231924 - DNA, 265 bp, Homo sapiens
gtttgttccctgctcctttctgggagctcctcatgtgctggatggcatctggacactggtggataaatgagtggagctactttttgagaggcttttgctaatttaagcccataagtatgtattactggttaaggataaatgagcattatttactatgaaaacacacaaatggacaatagaaatgttgatttattgtcattattctgaaccctatgtaaacgctttttttaaaaaaagattaaatacatacttgtaaaatcctaat

SEQ ID NO: 231925 - DNA, 326 bp, Homo sapiens
accatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatccta

SEQ ID NO: 231926 - DNA, 424 bp, Homo sapiens
cctcccatccacctcgacctcccaaagtgctgggactacagacgtgaagcactgcgcctggccaccctcttttctgacttttatctcctttgtgtctatgctgcactaacttagtaatggtcatatattgttttgtgtgtgtgttttactggttggtatgaggcttcttttaccctcattttattaaatggcaccagcacctacataggtgttttaagccacatactgagcagttatcctcaattcttcgcttttctgctgggaacatgtgttctaagagtgaatcctatcttttcctcctccatacttatgttcttgttttttcacatttctccatctccattgtaattattcctgatcaagccatctgaattctgccataacctccagcatattcccttctataatttcatcttttcaattc

SEQ ID NO: 231927 - DNA, 398 bp, Homo sapiens
taatcccaaattcttcctcaaataaaatgaaaaactccattccagtaaatggtaaatacataaaagttacagtaagccagagacttaaaaggacagccaagaagtcttccaacagtttattagaaagaatgtagacatgaaaaaaaaaccccactgtcatgaacataaattgaggttacacacacatgtatgtttgtacatatctaaacgttattctcacaattctacaaagcagctagctccattttacagaggaatattttaataaacataccccaggccgggtgcagtggctcatgcctgtaatcccaacactttgggaggctgaggcgggcagatcacttgaagtcaggagtttgagagcagcctggccaacatggcgaaaccctgtctctact

SEQ ID NO: 231928 - DNA, 505 bp, Homo sapiens
ccctttgattttataaattggatgaaaatactgattatgggaattaacttgtccttttgaaggatctttcttcatatatatacatacataatattttcctactgtagtgcttgttgaatttattacccatgtactatatttaaggcattctaaaaatgcttgtcccaaaggcagtcaaagatggctttttagaggatgcaatgcctaagctaagtctttttttgtttctctgaaggatctaatcaaaagaatacaaaactaccatcatttcaccatttacaaagttcttctgttaatagagccaatacatcagcagatatcatttccacttttgtatgtacataagaaaatttggtctgaaacctgagcaaaattaatgaaaaatattaatttgaactaaatggaaatcattgcttttataatgatatgcaaacctgtcttctttagttatatttgttaaatttttgtctttggcacagtcatctatgaactgactctgtctcaa

SEQ ID NO: 231929 - DNA, 371 bp, Homo sapiens
tctgaaatagttgctctattgtgttatgtgctcaaagaaagcatgtgcttgtaaaggttaaaaaaaagctcaaagctgaatagaaataagtttgctgagactgtcacttaagctgattggacaggcccttaactggggagcatacaacatatacttctaatcaatgtgacttgctctgtgactctggaaaatctactaagcctctctgtgcctgcacttcttagttacacaatgaggaggatatgcagaaggcagtctgctgcagagatcagaagtgtgggttctagggtcagactgcctgggtcccaattccagtcatctcagctacttaccacagtgctaccatcattaaagctgctacaatcatgaaa

SEQ ID NO: 231930 - DNA, 684 bp, Homo sapiens
atggcggaggaactcataagagttcatcaaagacatccctgaaattaccgtccctgaattctgctcaaggagtgcagcaatacactcactctagggccaaaagtaaagacgtttcatgacctcaaagcagatgctgctttaggacagatatttccagaagttattctattttgctgagggtgttaggcttttctgccctctttttttacaagtaagaaaatgagtgaaattgtgtccctgtcactgaaggacttgatccctctgattctcagttcccatctgacttacatcttggtcctggagctctctgactggttccttcaaattcaatagaagaggttctcaaaacatagagcaaatatacacccttgagaagcgcacatactctgttgtatacaaatgctttaccaaacactaggaaaggaagaagtacatccagaaaaaggtgggcttccaggctgcaactgctctgaccaatctcgggtgactgtcatcccagccctggggctcctgtacacctgtgcaggtctcagggcagcaggagtcctggggcagacagatgactctggaaaccctcagccccatccctcagcaccgcctccatccacccctcctgtccctccgcttctccacggagtcccccggggtagtgagggacagggatgcaggggcctcccctcccag

SEQ ID NO: 231931 - DNA, 456 bp, Homo sapiens
aaatggagttgggtaaggactggctgtcaaggtaggaggaaaaccagtgaaaaaccagggcctgggaaggagtgctgactctgcagaatgatgctggggctggaaccagccctggtgatgtagatgtagttgatgtagagcctcgtgggaaagaggttgggatttagtagtattttcctgggaagccactgtaacattttaggggtgggagataaatctttagatagtttatgaaaatctttttttttttttgtctgctaaagagaatggactggtggcagagcaagaatagaagtagaaagctaatttggacacttgtagtaatctaggcaagagatgactgtggtcaggagaaaggtagcagcattaggtattaagagagagggtagatgtaagctttattttggatgcaggagttgctgatggattaggtaagtgtgggtaagggcagtgagg

SEQ ID NO: 231932 - DNA, 241 bp, Homo sapiens
gcttgtgacctcatggttgggaatggtggttttagtcaattaactgtgtcagccacaaattaatcaattttatttagcatgaataagatgaaatgtcactggtgaagactctactaatttttattcgattagttaaattttcactctaactcctctaatatttaacagaaagatttaaaacatgcatgaaagcttagaaactacaatctaatgacagattaaaagaagcttattaaagaaa

SEQ ID NO: 231933 - DNA, 453 bp, Homo sapiens
tatttgacatgcaaagggcttgggttttgccattaattccaccatttatattattaggcaactttgagaaaaacctatacaactctatagtttagtctcacagtgtataaaatgggattagtatctcactcaccagtaacggttataaaaatgtaagttacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgggaacccgggaggcggagcttgcagtgagccgagatcccgccactgcactccagcctgggcgacagagcgagactccgtctcaaaaaaaaaa

SEQ ID NO: 231934 - DNA, 440 bp, Homo sapiens
cgccccacaggcccgcgttgctgcttgagggactctcattgtcgtaggccgcctcggcatccactctgaatctaggctggactttctctgaccggaagcggggctgccacccgggacagtttccaattcacatcccccgtcctcgagctgatccacccagacgcccgccctacgcactgtcccctggtgaccaccccctgtgtccccacagaccccacgccccacatggactgtgcagctgcaccacggagtccccccacagtcagcgtggccccacggggctcgtgccgcttgccttaaacccaccagttaaaactcccccaccaggcatggtggctcacgcctgtaatcccagcactttgggaggccaaggcaggtggatcacctgaggtcaggaattcaagaccagcctggccaatatgaaaaaccccatctgtact

SEQ ID NO: 231935 - DNA, 307 bp, Homo sapiens
atttgcattgagctagccctgctaccttcagggatttcagaatttttttctcatgtaatggaaggaaaccagcaaaccaaatccagaaataaagcaaaaccctaactaggagagtgttttcaagggagagattgctatagcatcagcctcttgggtttggagaatgagcttaaccatgagatttaggtttgagcatgtttactataagtaaaaagcattttcctggagtctggcaaatattgtggaagatgtactgaaatgtaattgaaatgtagctgcctcttaattttatacttaacaaatgcca

SEQ ID NO: 231936 - DNA, 386 bp, Homo sapiens
ttctgctattcctgccgcataactctctcttccccaggcttttcccatctccatcctattctctcgcaggtgctgggggaaaagattacttcccagatgcagtatttacatctcctccgccctactcttccaaccctgcctgaaataagcgtggttctcctgtctgtcagactatgaagagttctcaaatatgtctttcccagcgagggagaggagaaaacttcagcctccacgatcgatgtttctcaagtgtcaaggaaaatggagcctaggagggcagccccacaagcagcgtgatgggcatttaagccgacgcatgtgccaggtcctagaacagagtaacttccccatctcaacacaataaaatggtgatatgagaatacctg

SEQ ID NO: 231937 - DNA, 472 bp, Homo sapiens
ttctgctattcctgccgcataactctctcttccccaggcttttcccatctccatcctattctctcgcaggcaggtttttcttccgcctctctggggattttcgcgttggttctccctgcccccaggagtgaggcgggtaacgcccacgcctacctccggtgctgggggaaaagattacttcccagatgcagtatttacatctcctccgccctactcttccaaccctgcctgaaataagcgtggttctcctgtctgtcagactatgaagagttctcaaatatgtctttcccagcgagggagaggagagtgagtatccaggaactttaatgcgataggacatcaatatgagtgtttatagggaaagccagtgatcctattgttagacgcgaaatcaagacatatgatctgattttttgttttactttttgtttttgaggtataacattcagtaaagcgcacaaatcaaaagtgt

SEQ ID NO: 231938 - DNA, 610 bp, Homo sapiens
aaaaaatggccagcgaaggagaacttgttcatattagcaggtgttctagaaagaccctctaatctccctacccagctgggattttgaagagatgttgtagtgaagttattattttcagagacatgggccaggttaagggaaccaagaggggaagttgaagcttgtgcaacagcaggactccattagcaccccagacagttcggagggtcggccacacccaagttacagccctagggctgcagtcactgccagaaccacagcaaagcagggagggagcaggacaaatacataccccctcccctcctgtcacctgtcccccttgctgttgcctcttgatggctgaaccttattcaaagtaccaggggaagttaagtgattcaatgcttagggctggctcagtctccgggggcacagagaaaggtaggggaggctgcaaagagtatctggggacacagagattaatcaggacatgcggtaagtccaccttgggacacttttctaagaaaatcatctgccatatgctgaaatactttttacaagtatatggactgcaatattacgttctgtttcaaacaagccaacttaaatgttcaacagcagaagattcatt

SEQ ID NO: 231939 - DNA, 279 bp, Homo sapiens
cttaatctatttttaacttctatttttgtacagaatgtgttactaaagtagtcctggaatatgtacgtttcaatacataactactgcatatattggcaatgcatactcaatttttactgacagcagtaacaactggagagggtgaagaccatttgtccctgtgacaatcgtccacatgaagaaactaaggtggctcttgggtcagaccaaactgatcggggaatctggaggcaggggatgaaccagataatttccagcccttcttggtagctcttcgta

SEQ ID NO: 231940 - DNA, 358 bp, Homo sapiens
gacattgtgttcatacctcttgagccgatccaaggactggagttgctgggtcctatggtaactctgtgttaatgtttttgcgaaactgccagagtgttttccaaaatgtccgcagcattttccattcccaccagcagtgtaggagggttccagtttcttcctatccttgtcagcacttgttattggctatttctttgactgcagccacccacaaaataactttaatagactgattttatttatcctcacattcacttcgtgagcctttgttttggttccaccactgagggaaactgaggctcagggtgatcgagtcagtggttgaagaccccatggagagatacctggatcagatacc

SEQ ID NO: 231941 - DNA, 484 bp, Homo sapiens
agcacttcacttccattatattttttctccaaaacccatagcatcagtctaatcatgagataaacatcagacaagcccaaactgaggggtgtgctacaaaatatctgaccagggtgtcccaaaactctcaaggacataaagagcaaggaaagtctgggaaactgttacagaccagaggaacttaagaagacacaaggcttttttgcaaggtgaaacctgaattggatcctggaacagaaaagggacgttggaaaaactggtgaaatctgaaggaaaaaaaagctaattgtagccaatcaatgctggtttcttagttttgatgaatatattgtggaaatgctggtttcttagttttgatgaatatattgtggaaatgtaagaatattaacaacagggaacattggcaaactccatgtactacctttgcgctttttctgtaagtttaaagttatctcaaaataaaaacatttattaaaaacacaaa

SEQ ID NO: 231942 - DNA, 429 bp, Homo sapiens
agagcgagactccatctcaaaaaataaataaataaataaacttaaggtccagttatgtctcaggtacaaaaaccacttttccagtccttgaccctgtagggcacagacttgaaccttggctatggtctgcacttgcagccctgactctttgatatgagaaagggagtgtatgggatgggaggagggaatgagggtcctagggtgagatgggtggcagacaaactttataatctatatcaggccctctcctttatatcatgacatacagaaaataatcatttttgtacagcatagtagggtaaactagaagatatttggaggcatctaagtggtggtaatgttttcttttaagcatctgattttgataaaatacaaagtattaggaatgatattaaatattgaatttgcataaaactttcaaattaaaat

SEQ ID NO: 231943 - DNA, 536 bp, Homo sapiens
catgaaatagttctcatgaatagttctcatggggctcagtggaaaagctttaataatggggactctgagaatgcaccccattgttctgggtagcagtgattcaaatgaaacaaagttttcagctatcgctaggaagccaggcctctcctgaaatgctcccttgggcagctacgcttctaacccaaccaggaaataaatgcatcaagaggctgtagtgtctccgcttcatcacagagtcattccctgctcctggctgtttgtagaataggctcctgctaaacatgacccttagaaatcctggcactgacccaagaaggaagcccttaccaggaagacgagggccctatgctgtcatgaatgaagaggactccctcgtgagaggcagtattgcagagcgggtgcagctcctcttaaaccctccctccccactgttcagctacagaaccttgaagaaataaacgcatctgtctgtgcctcagttgtgtcatctgtaaactgagaataactataagagtgccccccatccactgggtgtg

SEQ ID NO: 231944 - DNA, 758 bp, Homo sapiens
ataatttatccactcatgggcaatcatgtttcactgtgtccccactcactttctcctatccttgattattatgaaacaaattctagatatatcatttcattcggcaacctaagtaacgaacagagggaggctgtctaagagaaaaagatatttatgcgggaatagagcattgcaatgggaatatgtgtaccatagtaaactatgaggtattcagggaggtaaaggaagacacatgttttcaaaggaaaaaatgagaaggattacatgattctttgaaaataattatcattggctacaaagatcaataataagggtgacaccagtccaaggttgaacaggcagttgctgggcagaagtccttgcagaaatattttttgtataaggttgtgatggcctttgtgcaaggttgtggttttcataggatcttttgtgataattcttatcaggcaaataagcatgagaatgctcttttcatagccttccctggctctattatcagagatttttttttaacactagtgactccattttgattccaacaacattgacacatctataaaaatttcattatcaggccgggtgcagtggctcacgcctataatcccagcactttgggaggccgaggcgggcagatcacctgaggtcaggagttcgagaccagcctggccaacatggtaaaaccccatctctactaaaaatgaagcaggagaattgcttgaacctgggaggcggaagttgcagtgagccaagatcgcacc

SEQ ID NO: 231945 - DNA, 123 bp, Homo sapiens
tctgcttcgttagactgtattccctactttttatagtatttattagcaccagaactctgtgactgtttcccaaagaacaagagagaaagataaaggaaagtgagaagcaacaaaactagattt

SEQ ID NO: 231946 - DNA, 537 bp, Homo sapiens
ggttgcatatcaactgaatttcaccaccctcctcctactcagagttttacagaagccacagagtagtgacacggggagccgggcagtggagggagattcggtcatcagaaacctggcccaggttggcctctgatactgtgacatgtcaccattgccatcaagggcccgtgggtgctggggcgtgaccacttcccaccctccacaatggtgcccctccccataggccgcacagcgcatggagtccttgcttctgcctagataataattcacaaggaagaaaacaactctggctgctgcctcggggtggctgccagacaagggtgttttattaggacacatcttccgattttatctgcgggcccaggtaattgtcatagagcagtttgtctcccctttagaagctataaacgattgtatttgatgaaaatatgcctttcatttccttggatgagatattaaagtagtgtataaatcagggctaataggtgactagccactttggtgtatttttcttcttccatttggctcagaaaaaaa

SEQ ID NO: 231947 - DNA, 382 bp, Homo sapiens
tgccaacattttattgtgcatattttccaacatacagtaaagtcagagaaattttacagcaaacacttttatgcccagcacctagatcttaccaataatattttcttatattttatcacacagctttatcacgcagctatctatccaaccctctatccatctaccaatcttattttttgttttaaactttttactttacaaaagtgttagtaattctagcactttgggagccaccgcgccctacctgtcatggcttcttaaggctcctctgggctgagacaacttctcagactttccttcttcctagacattccttgatgaccttgacagtttttaggagggagtgttggtcaggtattctgtagaatgtcccttaatttgg

SEQ ID NO: 231948 - DNA, 500 bp, Homo sapiens
atgcacatggaaaacccacaaaaattgactgaatatatatataaaaaattagtagtttcccaagaatggaagcattgaaaataaacacctgaatattaaataaaatctttctattgggtgaatggggaaatacaaggaaaaattacagaatttctgaaaaatagtgacagtaaaagcaacacatataaagatttatgggatacatttagagcagttatcagaagtatatttataacattaaacaactctattaatatgaatgaaaataaatgcaccacattcccaattcaaaaagctagaaaaagaatagctaaaccaacaagtaaagatttttgcataactttttatataactaggaggagaataaaaataaaagctgaaattaatgatgtaagaacagaaaaacagattaatttttttgaaaaaaacagagaagccagcagctcatttaatcaagaaacaagagagcaagcacaaatacacaaaacaagaaatgacaa

SEQ ID NO: 231949 - DNA, 411 bp, Homo sapiens
aaactgggtaattgtacacagtgtccctgtccatggcccacatagcttttctacttttcctggatttagttgtgggttacttggcaaattgagtgatttttaagtggcatctagaactactcaggcctgttgtgctagctggaatacacagcaatgcgactcctactctgtctttcccaaggttgtataaacaaagttgtacttattgaaacatgtgaacatgaaactgaatgttgctttctttatctgaataactaaaacgtgtacttgatgatgataagtaatttctgtcataaaatctactaatcttgttgataaagtattgcttttccaaataggcatataaaaatgatacaattttgttttctttaacccgtgaaaataaagatgaagactcactaaatgtagcca

SEQ ID NO: 231950 - DNA, 372 bp, Homo sapiens
ataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttattttttttccagatttccttagtgataatatggaaattaatcaaggcactggaaaaagccatgg

SEQ ID NO: 231951 - DNA, 796 bp, Homo sapiens
cttggaacctagcagactgccttacacatagtagtgactgaaaggttgaatgatttaaggcgacacatgtacctagatccaggtaatcaattaggctctaatctatgcaagaacattcatgatttcattttagctaataagcagcgagcaatttgttaagttgcttttttttatttggaaagctttaaaagtagattttaagctctgaataacatacttacattttaaatgtatttgaaagtatgatagtgagacattttaaaaaatacatcaagataaaaaatgattgggttcactgtgaactagacagtgttggcagggtgaacacaaagtgggtgctaaagtctataaaatgttaacatgacaagaacaccacaaagtgagttaaaagtggccctacaattctcactggaaaagtattaacgggcaagcaggaaaaatgtagggtactgccatctccactaagggtctgtagggtggggagcctgttgtccactcctgaggaacaattatttccattcctcatggtgctgctgaaaagtgaagtacggaggagctggttcagtctgtgaactcatttcccatcacccaaagaaaatgacggaatcccaagctgactgggccccttctagactcttgatagttcaagctctatcaactctctaaagcgccagtctagggcagaggtaaagtaaggcaaactacagccctcaggccaaatccaaccaccacttttttttttggagatggattctcactctgtcgcccaggctggagtgcagtggcacgacctcag

SEQ ID NO: 231952 - DNA, 521 bp, Homo sapiens
  misc_feature (517)..(517): n is a, c, g, or t
gtggcagggggggagatttctacgcagacacacatgcctgctgccatgtggtctagagacacaagcttgtttgtgatcaaggcaggggatattgggactggactgaagggctgagaggtctcttggggtgaagtgacaccccaaatgcagtgactgaacagacatctcacttccccacccaactcctcctctcacctcctagagccaggacccttcaggtcagccacccacccctagtcagcctgggagtgctgctggtgggacttcaaccatgctgaactctgacctgagtcctaagcagtttggacccaagtagagaaaaattgagagggaacttgatgtaggcagagctttggaagtgctgaggaagcctgggcccacgtttggctccatcctttccacacagcctctcacaaacctgcccagtcactcagagcctgactgtcttccatccctggtgtcccttggccaccccctcccaggaaaagtgctgtaaaaagaaaaaaggagaatgttnggga

SEQ ID NO: 231953 - DNA, 382 bp, Homo sapiens
cgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaa

SEQ ID NO: 231954 - DNA, 475 bp, Homo sapiens
ctttccactccagcccttccaggaatgagccaggctcatccctcagggccttcactccagtcttctcatccttgggtcgggagcggtgagctcttccccagcccgcgtccccgaaagtctcccctggaatgacccttccttcctccgagaggctgcaggcctggcccccccatcctgtggcactgtcccttctagcactccatgagaatcacgtgctgtccaccctaatccagggggcaggcctgcagcacccaggatgtggctggcctgtggcaggctctgccactctgcgtgaaagatagcagctctcggctgggcgcagtgactcacgcctgtaatcccagcactttgggaagccgaggcaggtggatcatgaggtcaggagaccgagacctcagccgaggtggatcatctgaagtcacgagttaaagactagcctggccaacatggtgaaactccatctctactaaaaata

SEQ ID NO: 231955 - DNA, 395 bp, Homo sapiens
  misc_feature (324)..(324): n is a, c, g, or t
tggtctcaaggcaggcttggtaacgaccccatgtgaccttgggcagggcccgccatccaggccacccagaaagccatgtggcctgcacgatcaggcagaccccactgactggagcggggcactttactttggaggggcagctaccagagggctctatggatcccagcccagccgtcaggccggacgggtcccccctactggcctgcagtgacccttatgccaggctcggctggctcagcggtgggtcctggggtgacctggccacgtgggacagaagggcctgtgccgctccctccagtgaggtgccaaatgtgggccacactnacttggcccagcgggggccttccgggcagtggcgcagagccattggaggtgcccgggccctggggcagggg

SEQ ID NO: 231956 - DNA, 212 bp, Homo sapiens
aatgtgtttcttgattgccactgtgtgatgacgtcatcataagatgacgtgtgactatttgaaacaccctttggggtctcactggaagccagggtgcccccgtcccctacccatgttcctgttagcgtcagaacatatctgtacgggtctgcagcaacctcaatggttcttgccttctcagaacgaatttgactgtggggcagaaggcagga

SEQ ID NO: 231957 - DNA, 357 bp, Homo sapiens
cagaggccagctgacccacggactgacagatagctgtgcagatgttgaataattacttcctacgagccctggtcaggactcacacttgcacgatccaagcagcagaaccactggcattagagtgcctggaaacagacctgcaggcgcaccaggaggaatccccctgcccgccacagagggcacctttccaggtaagagtctgcagctctgatgaatagtacttgtcaattaacacaccagtcacccatcaccactataatgaccccagcctcagcctccgtgccagacggtgcagggattctttggacttatctaccgcaaaatcacactgtaatgtttgtccattgctttgaagat

SEQ ID NO: 231958 - DNA, 1318 bp, Homo sapiens
atgactctgggtgacaaagatgtagaaacgtagttcatcaattgtaacaaatgtaccgctatgctggaaaacgttactaatggtggaggctatgtatgtggcggtaagatgtgtttagaaaatctccgtatcttatgctcaaatttgctgtgaacctacaattgctctaaaaaaaaatcaagtctattaaaaaatttatcatgtagtagatcttgtataaagtctcaacaaatatcaaagaattaacatcatacaaactctctaagcacaagcaacttaagtaaaaaattaacagaaaaaaattttttgagtcaataggagttattttgggaacaaaacacaaagtaaagacttgaggggattgaaaccatcaggatgaatgtaagccagacgggggcaaattgcagaatgtcaattgccttaacctaggaaaggtaaatttctaaaaatgataccaaatggttaaaaatcactaaatgaggaattgaagagaatttcaggttagaaggttgtaaaaagtgaaataattgtccaaagtcaccaaactagttcacgagaaagctggaactagaaactcatgcctctcaatccagtgttctttccactgtaacagattggcaccatagaacatgtttgactcaaggcagtaaattaagtacactgaagaaaaagataagaaaaaagtgataaaatgtaaagtctttgattcagacccaagtattacagctgctatggcaaaaaatagccacaatttctaagtgactttaaccaggaaaaaaagaaagagatgagatttgaaaaggaattaaatttcaagaatcaacaggaagtgatgacagccttccctatttggtagtttcaggcctgaacttttgtcattaaggtaataattcaaagtgctttaatgcctggactgaccacactaaataacaaaattataacccgttgagctacggtcagttttataaactgtgcctaaaatttcctgagttcaaatctgattataaatgggcaataaattcatctgttcattgggctgatttactttattttctgggtgcatttaaaatcttttttattgtggaaactttcaaacatacaaaaagagtacataataaatgattcccttgtacccatcattcaatttcaataagtcacattttgcctttcaaattttacctattgccactaacatcctttttttttctggagtagctgaactgatttaagatgaaggaggaaaaataaaggatgaaaggaatattttcaatctgttattcattgatactctagccaaaaagattccagattatgaggc

SEQ ID NO: 231959 - DNA, 246 bp, Homo sapiens
ggtcaactgctaaatattagagtgcttcaggcctagacgattggcgtcttgtcttctgcatctctagtttctcaagcaaaacaagatactgtttaatattatctggattttatttccttatttattggtttatttttcatctcctcataccagtgtataaacttcatgagtcacaacagataggaagtgttttctaagtgtctgttggataaataaatggaaggaaggaaggtaggtaggtaggta

SEQ ID NO: 231960 - DNA, 396 bp, Homo sapiens
caagccaggtgtggagtgaccaggggtgcataagcgggcacctgcagggtctggccactgcacacagccaggcacgccagctgctgtgcagggcagggagctctaggcacagggacaggggccagctctgtgcaagcctgcagctggatcatatgcaccagcaggttccgctgcagggactcttgtctggacaaggggaatatggtggcacctggcagctcagagatgccagaaactgtgaagccccaaagagggtgtcacagccctggctcagggagcccctaggtgtgggctccccaaaggaccacagctcttctctccttcttgtcacctgcaacgtggcaagctttgggtgtgggcatttcagccctgtttatgttactagctctttcagtc

SEQ ID NO: 231961 - DNA, 279 bp, Homo sapiens
acggaatcccagaagggggcagtgacccaactaaggtcaaagggctgcccccgggaaaccagccgcttctcatccccaaggcagcctgcccgccctggagagcccgggatccccagatactgtcgacgaaaggggcagggcctgtgagcgacgctggccttaggcctggactgcaaggggtggccctggctagagatgggactgcacacccttccaggcaccatcctgggtaatggagacactctgggaacacgtatgtgcacatgcacatgcttacac

SEQ ID NO: 231962 - DNA, 606 bp, Homo sapiens
agcattttggtgcctagcatagggccaggcacttcctaggtgcttagccagtgcttataccagaagtctatgtttgggaattcatgttccctgatctcttaagatttccagatggaatcattcaaatagtgactgagccaaatttataataccaaggacacaggatgtgcaaactgacacaggcttttctaaatctgaagccttgtaagaccctacgtactggttacccatgtttcacattgaatttctatgcccagctcaaccctcgttatgtcccatgaccacagattccttctattccatattgcctgtttgcacagcatatgcatcctaactgcattcaaatatactcagtgttactaggaagggatgagggctgttacctaggagagcaagagtcacggcatctttgccagtgtaactgtggaagccttcatatgctatttggtggcccacttccctttctgagcctcgcagttagatgataaataacatatgccattttattttattcttctttaggcatttaaaaaatcaacaggccaggagttgaagaccggcttggccaatatggcaaaaccctgtctctactaaaaatacaaaaat

SEQ ID NO: 231963 - DNA, 436 bp, Homo sapiens
aactatgcaaaataaatgaaatataatgatctaagtgtttttccatatactgttgtgatttacatgtggttataaaatctaacatagaagtctctttttgagatatttttggttaaattgctcattcttttaataagtggctctttattgatgtgcactttgctggttattatttgtcaaataaagcatggaaattccccaagttaggagaaggagaagatgactttctgatagcttcaagctgggctgctactggctctattggaaaacagtcttccagagggcaggagcacataactaacatagcaaagtgacttctttgcacatagtatatgttgaatttgtggttgttcaagtaaattaagacagaagtcattcatggattcaacaaatatttattgacttcctgttatgtgcaaggcactacgcatgatgc

SEQ ID NO: 231964 - DNA, 155 bp, Homo sapiens
cacacaaccacaaaaaggaatgagagaaaactcttacattgaatttggtggcaacttttttaatgctgcaaaatgtaatttttgtgtagtaaatcagaataatggcaacactagtattacccatactgtttccattaattgcaaacagggaaaca

SEQ ID NO: 231965 - DNA, 941 bp, Homo sapiens
aatttagctcctaagatgatttagtaaatatttgcattatcttctcaaaggagcatcacagtgtactaaatagataagctgtgcaatatgtcataggtccttattactcccacttttaggtgagcaaactaaggtacagtttataattgcctgagctttcgtggctgatgtgtatgatttgagatttgaattccagacaggtatgcaaagctaagcctatgccagttgccaattaggtgaagaacgtgacagtcccctcctcacctcccctcacacgattgactctgtttcctcctttagaaagtaactgaactcgagatgaaggtcatctgagcagtggcatagcgaatccagcctgcttggagttgaacacacatgtctgccacttgtcccccttatgaccaggggcaaattaaccgtactatgcctcctctgtaaaatgaggatagtagcagcatccatctcacggagtggttagtgaggattaagtgagataatatatgtgaagtgtttatctacaataataagttgtctacatcatctagtttcttgccatttgtgtatctgctaaataaatatgtaatcctactgtcagagtctaccttcgagattaacatgggttgtatccacctattagtggtgctgttttgggcattttataactatgacatcatcaggctcttcctgggaaggactgagaatggaaaataggagactcctcaacagtctagtgctggtgttgcagcctctggccacgttctcttttgtgtggccagaggcactttacaccctggcagaggcatttgccacagtggactgggaaagtggtgtcaaagccagcggcttccaacatggcctttccttgtggcctgaatttatttgaaaaaatccaggactagaaagaggcactgtgccttgggcctgtgggtgcattccattga

SEQ ID NO: 231966 - DNA, 484 bp, Homo sapiens
caggctttcgatggattggacgaggcgcgtccaccctggggagggccatcattttattcagtctactgatgcaaatgcttatctcttctggaaacaccttcacagacagacccagaatatagttgaaccaaatactgggcacctcatggctccaacaggttgacacaaaaaatgaaccattgcagaaaacgaagaacagtcaccaactcccacccatgcagctggctcatttgctgggctgccctccccagcaggtggcacaggaatccctgccttggcagggaggaggcctggggtgtgtgcaggtacccatgggaagtttctttgccatggggaaagccagagtcaccccttgcttgaacacaagagttggaggtttcagtgagctgagattacgctattgcactccagcctgggcggcagagtgagactctgtctctagataaataaattaaataaataaataaatataatttaatataaa

SEQ ID NO: 231967 - DNA, 597 bp, Homo sapiens
aaaggagttatatgaatacacccacatagtcacccaactctacacagttttaggggtttgtaacataaaactccaatggaactgaaggagttctagaaagtatttaattttaccccctcccttttatagatgaaaaaacaaacctagtcccacagagccttgagtaatattgtggtaaaccgattaagactaattgcggtatgggagggggtttggcctaggacactgggtcgtttccatagggcagacccatgattggagaccatttgctttagagaacttgaaagtcctgtaggtctagctccttctcaaggctttgggctctttattttaaaaagtgataatgtaccaccttctcccattatgtatgcactttggaacttagtactaagtttcaccagtgggaaaatatctcaaatgggaagacctgaaggcaatgcccactgcgcaacagaggtgggattccgatgcagttttactctgctgtgcctgagtggtactagacctttccattagcaatgcacatggttgagaatacattcacgctctcaagcaacttcactccgaggagtgacgtgccctattcctcatataagc

SEQ ID NO: 231968 - DNA, 490 bp, Homo sapiens
aataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttat

SEQ ID NO: 231969 - DNA, 414 bp, Homo sapiens
ataaaccacagggcaaagggactcctttttcctcctgaagagagagtatcacctcatctgaatggcttcttgacccagaaaaatctaaagaacagcatgcctcctgttttacggcaggtcttgttcttggaattttggtctgcatttctgctcacccaatattgcatggctcccatgttaatgaccctttcctacatccatccacttaaagttgtaatgcagtcctgcatccagtgccctcagctgtgtccctgagctgttaagctgaatttctgtgccaactgacaaataccgagtgcctactctggggaagcctctgtggctgttccagacagaagatgacaaagttctaagtgcatagtgtacaaaaaaccactaacttcatgcccgctggcttgatctcaacagttaagc

SEQ ID NO: 231970 - DNA, 490 bp, Homo sapiens
ctgtcttttggtggaagtttaggttcaggtgggtcccctatcagatgagcagctgccgggcctctgggacaatctaatgttagtaagtcccaggcgactgtgcaccctcgatttggccttcagtgtttgtgggatgggggcaagattgaaaataagttaagccctagagcatgatagagaatttcaggagtttgttttttggactggaatttgaaaagtagttatttgaggacatttttctgtctttcagtgaaaccagttatctgagacctattagggaaatgaaagttctattgaatatatttttcgaggcgctagcattatgtattttaagaaatgaaacatgggttgggcacagtggctcgcccctgtaatcccaggagtttgggaggccgaagtgggaggattgcttgagcccaggagtttgagaccagcctgggcaacatagcgagaccctgcctcttaaaaaaaaaattaaattgacaaaaaa

SEQ ID NO: 231971 - DNA, 289 bp, Homo sapiens
gcttatttattcaaacatatattttatgactatacatgttatgaatgccattgtattaacagtacttctgtttaattgaccttaccaactaggtcggccagtaggccaaagtcttcaaagcctctagatcctaagaccgtgatttttagacttttggagggtcatagaaccctttgagaatctaatgaaacctataatcttgtacccaggaaaatccgcatacacccaaacaccgtgcccatagtttccaaaggctgatgaactttacggacccttctgtcaggaacgc

SEQ ID NO: 231972 - DNA, 461 bp, Homo sapiens
tttttttaagaagtagatatattttaccatggagctcactaagaaatccttaaatagacaactgagaatggtatacattgggttgtaagagacaattctacctcctgatcactcaggaagtaatgaaaaccagttcattatcagttagtttgagttctgatgtgttcaggtttctcttctagagttgctcaagattggcgacgccttccctgtgggtgggctgcctgcccttgcatcttgccagtctgagattctgcttcttgcctccaacacgccgcaccatgctagctgccagctgggtctccacctctcatttgaagattagcttctcgtacaccctctctttgccttgagagctggttgggcagtattttctggctcaataagcactttgttccatgcttcacactctaacttcatcttgtacaatgcaacataccagctccgcgagctcgcggccg

SEQ ID NO: 231973 - DNA, 802 bp, Homo sapiens
  misc_feature (105)..(105): n is a, c, g, or t
gttttagtgatggcttcaggaactgagatgatggtttgagctgggtctgggaaaataagggacccaggaataggaaagggggagaacatactagggtatgggagngctgattggaactacaaagtacaaggccagtgggtccattccaaggtatggaatggctcatctcatggctggcacctgggcttgaggtggctctaaggctgagttcagttgtgttaggttctctcatccaaagagccagggttccaacagtattaggcagaaacagcatggctttttctgacccagcctaggtcacatggtgtcaccccaggacagtctatcctttacaagccagtcactaaggccagccggattcagtgggaagggggttaaactccatctcttgaagggagagtaccaaggttaagaaaggcaggagagtgtggtggccaactctggttaaaaaggtctacaagtatgccagcatttacctttaaatactgtgtatccccacctgtgcttgcaagacaggaagaggaaggcagggagagaggctgcacatgtgggagctgacccactagacacaattattagatgtagtttaaatcctggctctgctcctcactgggtctgtgattgtcagaaagaagattaatgcctggagggtccacgttccatatatccagtacaccagtgaaaaggtacatgacgctgggcacagtggctcacgcctgtaatcccagaactctgggaggatcatctgaggccaggagttagagatcagcctggggaacatggcaagatcctgtctggaaaa

SEQ ID NO: 231974 - DNA, 287 bp, Homo sapiens
tgtgtattcataattttgtattcttcttaaggagttactcctccaattgtataagcttcaggtctcccaaaatctagatcttctggtgggacctggagttgggtaggaacagttcaggtaagagataatgaagacctaaactaaaacaagttcagtggggagggatgcgtttcttaatagaaaagtgctatcatttactggcctgtagctcttacagatgaagatgtttgattcttttcttcttttctgtatccatagtgctgtgaatagtccttgaaggataaata

SEQ ID NO: 231975 - DNA, 456 bp, Homo sapiens
aaattcagctagagttaggggctttccagctttataacagtcacccactttaagaaatatgttttacatcaaactccagaagctacacatgcattgggatgttgtgtatgtgcaaacaaagttgcatgaataaagacttcactgtatgtgatgcattctgatattttctgtcttttttaaaccctagtttagtctagtctagttgatttgactctgttccactctattccattgttgttctttaacattctgggcataacccctcaaattaactccaggacttatgaatgcttttccattagcaatttaaaaaatacaagctagagctacttcatcttcaagcccaacaacccccatgctatcgctcaatgcccattttgcccattttagacggctgaaatttaaagggtctctagccagaaatgtatgactgggcaactcaacacactagacctg

SEQ ID NO: 231976 - DNA, 253 bp, Homo sapiens
ctgggagcattccgcctccgactgcaccaggtccactttgtagtttgggaattcctgttccacgcccccagatgggaggcgggatccagccgcaaggaacagaaaggcctgggactctggtcctgtcaaaggtcaccaggtgctttattgggttctcctcagacccatgtgcagcagtgggaggtttctttttgtccattcttctgcctgcccttcccctgccaccttctccatcctcacaggtggaaaggcc

SEQ ID NO: 231977 - DNA, 474 bp, Homo sapiens
gcactcggctccagggacaatatttgctcggggaaagaatcaaacatttatcctcgcatttattcaggggagcagttgtcaaacacgcgtgtcctcactgcttggatgtttcccaggcctggcctcagcctgggcctttctcctgccaggatttgtgcccactcagccgctccctgtgccctccaggaggttgaggtcctgctctgggcagacggcgggagcacgggtcggggccagtgctgggcagggcagaggggtccctgaggccgagtgatgccgcaccctggtccttctccttccagcctcagagcaaggccaagttgccccagagaccccagcaaggctctctgggcccacgttctgggcctggggcgccaggaaaagctggtgtttggggtgggggaggtaggacaattctaggtgggaggcggcgggattcccagggcctgccatttgcgtcacccgcgcggccgc

SEQ ID NO: 231978 - DNA, 493 bp, Homo sapiens
aaattgaaatcactaaaaatgaagccatgctttcctgaaagccctatgaactgaagctagaccacttaatctttagaagaaagtaacagcaacctatttatatacataaatcatttttatagctgcctactcatgtatggacttcatttggggagctggggagactgagggaaagggtaaaaagtcaggaagtttacaggaaccagaacacacacatccagcttcctaagcacagaaaactggagaagaagcatgctgcttccattatgaaaccactctgttggtaatccgtactgttatttgatggtctattatttcgatgtctaaacttaaagcttaagaaacttagagaaatctttaaaaactactgaactaaattttttattactactttatttatttacttatttgtaagtttattattagtgatcacttccataatatctttatatcttatgtaacaataaatccagatgtaagaaatttaaataag

SEQ ID NO: 231979 - DNA, 228 bp, Homo sapiens
tcaggacggcacggccgacatgttcattcatctcgggacagcatggcccaggtgttcgttcatctcaggacagcatggcccgggtgttcgttcatctcaggacagcatggcccgggtgtttgttcatctcaggacagcatggccgatgtgttcattcatctcaggacggcatggccgacgtgttcattcatttcaggacggcatggcccaggtgttcattcatctcag

SEQ ID NO: 231980 - DNA, 329 bp, Homo sapiens
tcttcttgtccccacatgtgcctagcaacatggccatccccacatatccccacatgtgtagaacattgtggcaccctacattcgcatattaaaaggctagggtgggagggccactttttttgcaggctacgtgaatgacatacctggtcaaaccaattccctgggtcatatgcaaattagtcaccacctcctccagcctcataatataactggctcttgtctgctgcacccaaggttccctctttcatctgggagccctcttccctctggttctgtatgagggagcctcttctttcttgcctattaaattctccgctccttaaaacaat

SEQ ID NO: 231981 - DNA, 950 bp, Homo sapiens
gactcacccaaggcccaatggctgtgagcgggaagccaggactcctcacagcgccagcttcttccatgcatgccagcccatctgcagagcccggtcaagctcaggggaacgccaccactgaaccagagaggcagccaggaggagggggtctagatagagaaatgtggaaaaagcagctgattccagaaatttcctgcttggcctggattaggccatgctggggactggctgccccttgcccagtgggtgctggggcattcaggcttggggtcttttaggtcagccctaaaagttgatgatttgatgctgatcgctggtacttacttcagctttccttctggttggaagccttaattagtggaggttgctgacactgtttatgcgcatcggtatttttttagaatgtggagtggaagaggtgggctttgggggactggctaaaccccaagaatttaactggccgtgtattttggccactgttgcgcctgttaagatcttggagtgtgggtttgcacctgtatttagaggtgcacaaacccacacaaattcaaggataaataactgcaaggcccgaagagaacacgctctcccgctgcacgcaggctgctcaactgtgatgaatggagtaacaggtaccacagggcgagcaggacgccttcatcaatggtggtaatagccaccaatgcatcatctgtggaggcaacaggagggacggctggggcagaatcaacagaacgtgaaaatgaattgtttgtaaatacaatcaacagtgttatgttcgtgagaaagccattcatcattcagaaaccacctttagtaaaagatgcacctggcttcccggtgagacggggccatcaatccctccccagtcacagggtcagctcggggctgcctaaacccccagagaacagacacacatatttattcttatttgaaaataagagttgtta

SEQ ID NO: 231982 - DNA, 762 bp, Homo sapiens
aaaaagttggcaactagatctagttgcctgccaggatgaccagcgttatgctggtgtgtgcgtgtccatgcctccgggatttttccagggttatcaatgtcagtgtaagatctgatggaatttaccgttgactcaattttcttcaccaatcaaggctcattccttgaggcatgagttatgcgaaaagcttttctgcaccaagtactttcattctggtctttggaattgtcataattctgacagagaacacagaccattactgaatgctcttcaggttaccctatttgcctgtcacattgcttctaccggccacatcctgcatttcctgtgggacagcattttcaaacggattctagtgtttgagctggaaccaaaagaatgaaactgtttttacataagtgcatattgctgtctctgcaaataaagtacaacaatatgactgacttgtaaatatcttccaggacaatgctgtgattttccagttgattctgcaactttaaagatataaccaagtataattaggccgttcaaggatgaatgggtcccacagaagctagaaatagtttacttcctgcttccatttctagatgcagaagactaatattcacagaaaaattacgtagacaaattttgtttactagatctaaaacattcctgcttctcagaaaaacaaaaccaaaggagtatttaagataaagtaacagtgaacgtgttgagactaaaaagtttccatcaactagtcccatatgcaccctctaccct

SEQ ID NO: 231983 - DNA, 796 bp, Homo sapiens
taccacagagggagatcttctgtcccactaggaaactgcgaattgtaccacagagggagatcttctatgcaacatggagaccatgaatggtacacacagagagagatcttctatccacatggacaccatgaattgtaccacagaggcagatgttctatccaacatggaaaccatgaactgtacacacagagggggatattccatccaacataggaaccatgaactgtacacacagagggagatcttctatccaacatggagaccatgaattttaccacaaaggaagatgttctatccaaaatggaaaccatgagttgtatgcctagagggagatcttctatccaatatgtaagccacgagttggacacacagagagagatattttatccaacttggaaaccatgaattgtacacacagagagatcttctatccaacacggaaacaacgagttatacccacagggggagatcttctatccaattcaggtgttccttatgtgatagcatactctgcatctacaactagctaaagtttcgtgatgtcattattgttattgttgttgtagaggtgaggtcttgctatgttgcccaggctggtcttgaatccctggcctccagcaatcctcctgcctttgtttcccaatgtgttgggattacaggcaaaagctggtcttattctttctaaagctgaagtttgagaagtaaaaatcactttcaagggtagaatgcattttatattttctctgaaaaatgaattggcacaaatgtccagttaaatttgtgcaattttctttaa

SEQ ID NO: 231984 - DNA, 408 bp, Homo sapiens
gcccacccattccactgtcccgctgctctgttgctggggctgaaagctccatccctgtggaccaaggtcagctgtatttcttgggtttagtgacgggttaaaagaaaaacaggtctgggccaggtgtggtggcttacgcctgtaatcccagcactttggaaggctgaggcaagcagatcacctgaggtcaggagtttgagaccagcctggccaacatggtaaaactttgtctctgctaaaaacacacacacaaaaatagccaggcttggtggagcacacctgtagtcccagctactcaggcggctgaagcagatagaaatcacttgagcccaggagacggaggttgcagtgagccgagattgcaccattgcattccggcctgggccacagggcgagactccgtctcaa

SEQ ID NO: 231985 - DNA, 430 bp, Homo sapiens
gtggtggtctgcaccactatctgtgtctccaagccgcagcccactccatggggtcctgatggttcccttctgaatctagggaggacagcaggcagcagggaccctccatcgctgttgccacttaatccctttagcatcctcaagataagcccagtctgtacaaattcaggttcattttatttctaaagtcccaggaacaatgtcagaagggaattacagtgaagaaagaaagagttcaagttccagcttacctagacttcctgcagagcctcgaaagagaaggcagggttgcagacatctttgtttcatctgtccagcatcctctcccgtgccttggtactgggctttgaagccaggctgcctgggtttgcaacttgccacttattaacagtgtgaccttgggataaaggcccacctttcagagccacta

SEQ ID NO: 231986 - DNA, 373 bp, Homo sapiens
tgaattctgcattgtttactctcatacacagggattctaaacacaatttattattgttcagaccaatacccaggtaagagaactcctcgatgttcacaattcatgcatctttattcttcatttaaataagcacaatcaacaactcctctcatgaggaaatgccagggcagaagcatttcagtttcctaaaagaagtctctaaaatcctggacataccatattttagatgtcttacccaaaagtcccacagaaaaaagagttgtgtatgaaaataatattattggccgggcacagtagctcacatctataatcccagcactttgggaggccaaggtgggtggatcacctgaggtcaggagttcaagaccagcct

SEQ ID NO: 231987 - DNA, 736 bp, Homo sapiens
tgcatctgggaagagctacaaatgaatgttgggtttgggtttttgtaaaaatagtgactggtgcattcttttcattttatggctgtgggaaaatggtagagtcatgtgtgccctatatgaagatgatgccgctgaactgtcattggtcctcctgatggtcagtgccagggattggaatacagtcagtacttgcaggagccacgttctggctagttacctcgctgtccaaagacgatttttcctttttgtctatattttcatcatagggatgaacatattccatgttctgctagagcctttatgactcagtaggggagagatcaagaacttctgcaagtccctggatacagcatcagcgcttggcttagggaacaaagtaactgacaagtctgtattttacagtctgggtatttataggctatgttacgatgcctgcaaaaatgggagcaaacaagcaatcaagtaactccaataagcttcacttaatccatttcttcatgaacaagcttttagtcctaacagcatttgggagttctcatgaaagaaatacaggagaccaatgagccaggagatagatagagctcttcatcacagaagagacatgtttttaaaagggttacgtgatttttaaaataaaacaacccaagttccagtcactgtagaggctgaggcaggagaaccccttgagcctgggagtttgagtccagcctgggcaacatagcaagatctcatctct

SEQ ID NO: 231988 - DNA, 678 bp, Homo sapiens
tgcatctgggaagagctacaaatgaatgttgggtttgggtttttgtaaaaatagtgactggtgcattcttttcattttatggctgtgggaaaatggtagagtcatgtgtgccctatatgaagatgatgccgctgaactgtcattggtcctcctgatggtcagtgccagggattggaatacagtcattttgtctatattttcatcatagggatgaacatattccatgttctgctagagcctttatgactcagtaggggagagatcaagaacttctgcaagtccctggatacagcatcagcgcttggcttagggaacaaagtaactgacaagtctgtattttacagtctgggtatttataggctatgttacgatgcctgcaaaaatgggagcaaacaagcaatcaagtaactccaataagcttcacttaatccatttcttcatgaacaagcttttagtcctaacagcatttgggagttctcatgaaagaaatacaggagaccaatgagccaggagatagatagagctcttcatcacagaagagacatgtttttaaaagggttacgtgatttttaaaataaaacaacccaagttccagtcactgtagaggctgaggcaggagaaccccttgagcctgggagtttgagtccagcctgggcaacatagcaagatctcatctct

SEQ ID NO: 231989 - DNA, 534 bp, Homo sapiens
ctttgcgctctccgcacagctaccccagggcaaaagacaaatcccccttcactgacccctccagtaactgtccggacagttacaggatgcggtcaacatatctgttcacctcgcataacaaagctggcaaaaaaacatctccaggatgcggacaagtcacttgcacccctgactcactcagctccccgaccctgacccagttctcctgcacccccaactcagctccccaaccccgacctggttctggccctataaaagcctgctattttctgtaagcgggtctgcctccttcaactgtggtagagcagccaagcagctcagtaaagcttgcttgcctgactttgggtctcctcatcctttctctcggctgaccttacacctgcattataggaagagggaaacattttgaattttataaattaatagttttaccagtattttgttaaggtaatataccataaattttgaaatgctttttaagattctatgtgaacttcatttgtttttaattaaacacaactgtgttaaacgtga

SEQ ID NO: 231990 - DNA, 372 bp, Homo sapiens
catttgatagataaaagttaaaagaactgcttattgtgttttacaaaaaaggagaagctcttatatagttggaaattacttttgttactatttaatttagataatatattgtaggaaatggttattcgatgagaaagcagaaaatggaactcaacaattaaggcttcctggaaaaaaaagttctctattctttagcggagaatgaagatttaacattaagaatggcctgtcctcacaagtaaaattgaagttaaagtaacctcgaatttttttaaatttctatcaagtgatcttgttccaggaattaatattacacttagacttgatgattaccaggtaaagaacattcattagaactttaacaaaaaaaaa

SEQ ID NO: 231991 - DNA, 325 bp, Homo sapiens
acatacttgcaaccagagtcatcaattttgaagacagcaaccaagccaagcaatgtgaggttacagctatgaaatagaacagagatgtctagactatagacacagcctgccgttttgtgctgattggtaaagtgttccagccaactggaagcaaatatttctcagaagcagtttcctgctctcatcctctcctcgccatgcccactgtgcccaacatggctccagctgggtcacagaagactttgtcctggaatacagcatttccctatttaaatctctaactttgtatgtactcttttcaataaaagcatatttttcattacca

SEQ ID NO: 231992 - DNA, 323 bp, Homo sapiens
tgattagttgtgactttatctgcctaccagaaaataggactagccctctctggaagatgatagcattatccagaacctcatacacaaaatttacccaggacactcatgaagaggaggaagaaaagacaacataaacagacatacaggtcacctacttattggagttaacagatggatgttcaaatctgtattattcttatattcaagagaatgaatgacaaagagtagaattccactggagaactagttaaccaaggctagatggcttcattgaaagactttgtcaagcatgaataaagccactataaatattcttgcacaag

SEQ ID NO: 231993 - DNA, 328 bp, Homo sapiens
agagcctcttttgtgttcctaaactgaacattgcagtgaagtgaacgttcctcctcaggttaaatgtctacatagagactttagtctctgcgagcagataaatgtatattctttccaggacattatttaaagaagagtttgcaaactggtggcctgcaaatgtgttttgtttggctcatatgtgtattaaaattttttttgaggccaggcatggtggctcatgcctgtaatcctagcactttgggaggctgaggcgggagggtcacttgagcccaggagttcaagaccagcctgggtaatatagtgagaccttgtctcttaaaaaaaa

SEQ ID NO: 231994 - DNA, 138 bp, Homo sapiens
caacacctagacttcaaaaacagactctgcagttttctcacaatctgctgtaaattattgttccttttcattccctgtataaagcccacttcctgtcacttgttattgtttactgaaccaatgctgaaaacacattta

SEQ ID NO: 231995 - DNA, 440 bp, Homo sapiens
ctccccagcccagggcatgcagacggcccatgaacgctcatcttcctgaacctgcttccagcacactccctttctgctcttgggctgagctgagcttggagatgagcaggctgctgttggtgcaggggatgggttgaagcacagcctgcctggagggctcatggcctggcccacatagatgacaaccgggactgcaggaatggggaggccaggcagacggcactcctggggatacaagagcttccggagaccagcaacggcttcctcagtagcagcacctgacaggcacatcagcgcctctccgtgtgctggagttgcttctggagctctgggaagtcatcatcgactgcatatttattgtcagcgttgtttaaattctggtgcatttttctgtgataatgtaacaataacataaacatttgctgggtgctaaaaacgct

SEQ ID NO: 231996 - DNA, 561 bp, Homo sapiens
ccttggtatttgtaaatcattttccaaaatttttcacaatatctatataaataagatttttaaaattgtatgtataacactatagttggcaagtttcattcctggttccacaataacactgattagtggttggatggaaagccggcaggaatgtgttgtgtctgttcctgtttaacatttctgtaagtgatttggtgaggatacagaaggcatgttattgaatgtgtagatggacaaagtttagggtaaaagttaatgtgtttgaaaaaagaggttatattaaaaataccttcattgactggaacaattggaaaggacatacttgtctgcctacagggacagaaaactcattaccatggtggctttttcattgggtttgctagggccagaatccagaactcattgagtacttcttcttatagcatatatagcaattcattaacattggggaataataataatacaatagtcattgtccagaaaggactaactttaatggtaaaaggcttttttttgtcatcattttcttcaaaagaataaaaatataaaatattaaagtag

SEQ ID NO: 231997 - DNA, 511 bp, Homo sapiens
gccaattggaattagtttagcctgtgcagtctaaccctagtcagtaggggaagaacacagcagcagggaccacgtgtgtcagggataagaaccctttcccctcccttgtccaaatgtgcgcttgccattgttccatctgtaagggtgcacccttctatatagaagtaacttgccttgctgagaattaaaaggaaaattttatattcgagtgctacttcttttgcggcaccaaaactttatatataacaccaagaggagggggatgacaggaatttaatccaccaaagttagaaaaggaaagaatattctaggcagaagagcaatgggcgcccaatggccctgaggtggaaaagaatttatgtgttcaattcagcataacttcagccctatccagtaataccatacaggaaacatacttctgcagtgttccttttctccacttaaaacatgaagtaataacccctcgctctctcaactgctcctgaccatcacagaggatgggctctccagc

SEQ ID NO: 231998 - DNA, 446 bp, Homo sapiens
caaggggaccaggaccagcgcctcaaaaaggtaaagtgggaatgaagaaagccatgacatgggataaccaccgtcagtggcaggtctccggcctccctacgcagcatggtgacccccaggcttatcaagatataaaagtccatcctggagggcacattcggctccgcaggcttctcccagtctctctacagcttatgagtggttgaaccagattcagaactgctctccagaggacttttggaaatttggggatggagaaggaaatttgttgtcagaatgattaaggaatgtcgtcaatatttcacaactaggcccagaagttttaacaccttgcaacgtataggacatccctgcctaaagaaaaaatgcttttccccaaatgccagtagatacctgtattagtcagggttctccaaggaaacagaactaatgggaaattcatattc

SEQ ID NO: 231999 - DNA, 539 bp, Homo sapiens
attggttggacttcctctgtgttctcatagcatcagtctgtactgatactagttttcttaggcaaaaataatccagagatggttcttttggtaattgctgcattgtcacttctcaataataactgaaaatgggaactttcatgtcgcagagactttatttttaatgtattacatcctttttaaactacgtgacactggataagttatttattcagcttgagcttctcttcctttatgtacaaaatagagaggacagcacctagcttcagagttacaagggttaaagtacacagtgtacatgaagcccctgcctcagtgtctgcacgtggaaatcactctatgaatgagtgatcctactcattccagtaacagtagctgacactttcagaaaggagaatggccctctttggtgaatgttattaattctcttggtaaaaataaatgcctgacacatgctaggtactgagttatttaatatgaatccactaggaacatattgaatgcattatgaagcagaaaaacatagctatgaagatagg

SEQ ID NO: 232000 - DNA, 454 bp, Homo sapiens
caggcctaaagaaggaggtggaagatggtgggaggtggaagatggtgggagggggaagtctcactgtcaggcctctgagcccaagccaagccatcgcatctcctgtgacttgcacctatacgcccagatggcctgaagtaactgaagaatcacaaaagaagtgaaaaggccctgccccgccttaactgatgacattccaccattgtgatttgttcctgccccaacttaactgaatgattaaccctgggaatttccttctcctggctcagaagctcccccactgagcaccttgtgacccccgcccctgcccaccagagaacaaccccctttgactgtaattttccattaccttcccaaatcctataaaacggccccacccctatctccctttgctgactctcttttcggactcagcccacctgcacccaggtgaaataaacaaccatgttgctca

SEQ ID NO: 232001 - DNA, 288 bp, Homo sapiens
cctgaattacttcttttggatttagactgtaattgataagtgaggcatatagtatcttaattctagcaagggataaaattaaaaggggggaaacaggacacaagactttcctctaattacctgtactcaccaattcctacctctcccaactactgatcagtgaccacctacctgggtatcaagttcccccagggttgccactaaaatcagaactatataaccccagtccgggtgtgatggagatgaaagtgatgggccagaactagctctatcttctaaatccctgct

SEQ ID NO: 232002 - DNA, 459 bp, Homo sapiens
ccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaaga

SEQ ID NO: 232003 - DNA, 293 bp, Homo sapiens
gaacaactctgagcaggattccacatctaggaggcctcggaactgagcggtattttctgagacacactgaatggctgctccctttccgccgctgttgagggtcgttatcttgattatccagatcacctagaaagtatccgtatccagaatcaataagatctactctctgctcctctgacagcagaagcagcaggaccacaatgaaccaaagagcgtggaaggaaacgatgtgaccggaaagctcagagaacggccacagggagtcgtaagcaggccttccaaactgaatcatg

SEQ ID NO: 232004 - DNA, 226 bp, Homo sapiens
atctgtcatattagatctaaactctaaaagaaaaggactttgggccttatatctgccacccattctttcaatggaggtgacacccctcatttctatatttccagtcatctctcaatgaaaaggaacatgcaggctggctcgcctttggagagcaccccacacagttttgaggagctctgcagctctgcttgccctttctgcatcacagcagatccaaaaggtgaaa

SEQ ID NO: 232005 - DNA, 482 bp, Homo sapiens
tttcacagagccaggggctgtgtgtgtgccagacactgagccagattcccctcggcaaggtgggtgcaaagtcttattaagactcagagaggctctggtcacgtcactggtaagtggcggcgatgccatcagaacacaggtctgtctggtgcccaacaccatggttctgtctgcacccctctgttaaatactgcaataagtaaaggaccagttattttaaaacaaacagtttgaagttcaagctgtaagttaaagttaaaaggcaacatcttaacgttccctgaaattggctagaccctgctgtgtttcaaccccattttcattctaaacctgggttttgtagtcaaatggacctgagttcagagcctgcccctgctatacttattattaatagctgactttaagtaaactacttaaccttcatgagtttcagtttatatatctgcaaaatgggggcaaacctggcaggggagagagttgga

SEQ ID NO: 232006 - DNA, 475 bp, Homo sapiens
ccagaccaggaaaaagggaacagacatctattctgggccaggcactgccctcacaactcctgagaggcccatatgattatcctcctttgcagataaggacataacctgccaggggtaacatcccccaaggtcacccatctcatatggccaggcctgccaggcacacgagcctcagctcttcgctttcccacccctcaagtctactacacctgttcttgctggatgctaggctcccttgccaggagcaaggaaggcagagtgggttctctttctccccaccatgactcagttgagccaacctcaaagcaggtgagggaccagaggtcatgggattgctcacatagaagcagccagggggccggacgcggtggctcacacctgtaatcccagcactttgggaggccaaggtgggcagatcagttgaggtcaggaattcaagaccagcctggccaacatagcgaaaccccatctctac

SEQ ID NO: 232007 - DNA, 202 bp, Homo sapiens
atagacaacttaacaaaacaagaaaaataaaaattcacaaaattaaaatatcaacaaggagctaaaaattatgaagaaccaaacaaattttggaatacgataactgaaaaattcactagaggtcttcaacagcagacttggacaagtagatgaattggcaaacttgtagacggatcatttgaaattatctaatcagaggatt

SEQ ID NO: 232008 - DNA, 131 bp, Homo sapiens
acgcgctgctccgctaaaactggctcttcccactggacgggatcctccaacactccctcacccggggacaaaccacgctatttttcctccttactatggacagatgatcaaaagtatcggagtaactttct

SEQ ID NO: 232009 - DNA, 893 bp, Homo sapiens
gaagaactgtatctccacttcctcggttctctggaataaattacaaccttatgactcatgagtccaaacaggacagtctttacgtctacccatcttatgactgatgtggctctcaaggaacaataaaacctaagcaaattatgggaacaagcatttatcaaccacgcaaatgaagccattctttgtatgtattatgcatctcaatctccatatatggttatcaacgtaataattcaagtaaagagtttttctacacccaggagttccaaaatcaagctacattcaaagagagaaacaacacattggatactcaagttatgaaccgtgagaagagtcagaaattccttataggatagaacatgtgcaattgaaatctaatattaagttttctgtggaaaaacacatatatgtgtactatatggctatctgatcattttaaaaacatactcagaatactttaataaaacactgtgagtatgaattatctatgctttaaacactttacttctctttctgcatttatgccatcacttcttatctcttcataccttgaactttttcttttccccctctctcactctatgactcctgaacaaaactgtcatttccaatatctaacttcattaactaagtagggatggcagatgtttattatcaccaaaatgcagcataacatttgcaaactggtttatgacatgcatctttataaagtgctcagtgaaatgcataaacgattgattgaaaattggtcaaagagaatattgagtactttattagttactggctaaagctaaggagttacagaaaagcatcatatctaaataaggagttttatttgaaatatgtaatttcattatgaataaattccataaaataaactaagaattgctaaa

SEQ ID NO: 232010 - DNA, 245 bp, Homo sapiens
gaaaaacccctaacctaccagccttcaatgagattgatttgagtaataactccatctccagtgtggagtggccagcctcacatcaattaaactctttctttactgcaatgctatggtctttgtttgtgcagcaggcaggaagaactcctcaggcagttacacttcgagccttaagacaccttgatgtcagacttccagtgccctgaattgtgacagaataaatttctgttgttttaaaactccca

SEQ ID NO: 232011 - DNA, 968 bp, Homo sapiens
ctggagtgcagtggcgtgatcttggctcactgcaagctttgcctcctggattcacgccattctcctgcctcagcctcccgagtagctgggactacaggtgcccaccaccatgcacagctaatttttgaatttttagtagagatggggtttcaccgtgttagccaggatggtctcgatctggatccacacgcctcggcctcccaaagtgctgggattacaggtgtgagccactgtgcccggcccaggctcattttaataaaccaggttttcactcagctctagaactctctggaggtgtccttacacacacacacacacacacacacactttaggtttttagagattgatttgataagaaaaaaaatttttcctttacagccaatgacttctctctacatctttaataaggctgtgattgttgatgacgatgatgatagatgtggcatctgttgagtgtttactatgtgcccaagaactgtgcaaagtgcttcaaatacattatattacttaatcctaacagtacccaaacaaggttgctatttccattttatagtaaaggggccaagtcctaggatgactctgcaacttgcccaaggtgtcacacagcaaagaagcagtagagctataatttgaaaatagggggtcagactccagaacctattcggcaataaaaggtaaaagccctgtcccctctgcaaaaagccactgcttctagctactcgcaatgactttcacagaaataactttctgtatttgtctttcgtttgggggatatttaattaaatggtataattaaaacaacaagtccatctggcattcccaggtttggcaagaaacaagaatgactcttggaaagcccaggcctcagctggtgggagcagaagtgtgctggtgtcctaggaaccaggctgccagctaagaatgttcagcctccccccgtactttaccgagggggtgcggagttaac

SEQ ID NO: 232012 - DNA, 397 bp, Homo sapiens
ccccagcaattaggaattcatcaggcaacaggtgggaggggagcctcccccctcctccttcttaccaaacttgggaggctggggaggcagatgggtgagcctgtacgcagacagaagcagcaaggcctccaggaacagctatgtccggcattcccctgctgtagcctgcaaactagttagcgggcagcctgcaacttattaaggatttaaaaatagtatccatgtgtctccagtgggctcagaggggctgggtcttcattgtgggaatgtcagcaatgctggagcctcacttactgttgagtcgacagttgttatgggagggacattaccctcccctctgctccttaaccaatgtaattttagtagtttttagatctcacttgagctttaaagaaca

SEQ ID NO: 232013 - DNA, 394 bp, Homo sapiens
agaggatgcaagggcgccacgggattggtctcctcctttggcactcattagtcaccaggtgcactttgtcagcatcgcgataacccagaagagaacacgtgtagatggcctctatgaagctcttttgcttgttagcagctggtcaaagttagcagaaatggaaggaagtgaactcaaccaacaaaagagaactgagcaattcatcccgggactctgctctctctgtttttccccctgttgaactgaaagcaacgctagtcctgaacggatgaatgagcagaagtaaaaggaagagaaggaggaaaaccagaaggaggaaaagaaaaagaagaatgtgagaaaagtccagaatccatataaatcaagatatagaaaagagtttttctaaatctca

SEQ ID NO: 232014 - DNA, 299 bp, Homo sapiens
gccacacagcttaaaaagattaggaactgtttggttgggcatagtggctcatacctgtaatcctagcactttgggaggccaaggcaggaagattacttgagaccaggagttcaaaaccagtcttgccaacataacaagaatctgtctctatataagaagattaaaaattagctgggcatggtggcatgtgcttgtagccctagctacttgggaggttggggtggaaggatcacttgggcccaggcattccagcttatgatttcagtgagttatgatcacaacactgaattccaacctaa

SEQ ID NO: 232015 - DNA, 452 bp, Homo sapiens
tcttgatatcttactaattattaaataaggaggggaggaataaaacattttaacaaatttttaaaagtcaaatcaaattgattttctatttgcaaataaagcaaagatattatagatcagaaaacagaatgtatgaatgaaaaaaatgacattttacaaatatttattttggccaggaatgttggctcacacctgtaattccaacactttgggaggccttggccgggtagacggcttgaccccaggagttcaagaccagcttaggtaacacggcaaaactccatctctacaaaaaatacaaaaattagcgaggtatggtggcatgtgcctgtagttccagctacttgggaggctcagcggggaggattgcttgagcctgggaggtcggggctgcagtgagccatggctgcgccactgcaccccagcttaggcaacagagtgagaccctattt

SEQ ID NO: 232016 - DNA, 598 bp, Homo sapiens
actttataaatattatctcatggatatgtgtgcaggggtgggcagtagatctacaggaaattatctcatgccctttaaaattatgctgttattttatccattttaggtgaggaaactgaggctcagagaggttaagcaacttgccaagatcacagagctaaaaacaggcaaatgccagtatttgaaccaaagataatgctcttacctggtacaccatatttcagagttgggatctccaaagcagatctgaggatggcaccggggcagcctgagcccagcccttccacttccaccccaaccctgcagacgcctgatgtatttacaagcatctgccctgggcggcagccatggagtgagcctcttggagaatcccaaggctctacattgaggaaaggtcccatctggcttcccctccccagtctagctcagctggagagacaggaaggaggggtggcctccctcctggccaggcctcatgtatagacccttgtcatggctggcagacttgaatgactttctttatcctcccttctcttccctacttcccccactgccagctgtggccatttaataaaattagcttaatgcttgttccttc

SEQ ID NO: 232017 - DNA, 574 bp, Homo sapiens
acactaatcatgtgcttattgaaaaggacttccaaacatttcaatgctgtcttctttgttttctggttgaatttcgccttcatcctccttgtgttgagttggatctttttcagcaacctggtctttggtttggggttcatgtgtagaaacaggatctaaaactacaactggttcggcttgtttttcaccgtcaatgtattttttcctgcatccaatgctactgggaggcctatgagatgaagagttagacaaaaaaagtaaaaagcagagagagaaaatacttgtctctgatattctggattcagactaacataaaacccaaaatgttctaagtctaatcaacatgcatatagtagtctttgagatgccagccatttaaaagaaaaaatgaagctatcagattacacagctgatactaggagcacaaggccagaagaaagaaggcagagaaagagcgattaactacagaagtgttaaaaagccaaatgcacctacctgcttaattgcattctcttctcaggaagcgtaaagctcatggacaaactgtgaacttctcacagcctgctgcccagac

SEQ ID NO: 232018 - DNA, 346 bp, Homo sapiens
gatactcaacaagggaggaggccataaggcagaatcagaagggtttaaggaatacactgtgacttccagcataataaactccacagggttcatggatagtcagcagagaatactaaagatattagtggtaacatctatacatatagcaattatcattaatatttctaaggcaacttaagtcccagggttaataacaacagaaaatgcccatgtatgtagtagataaggtcacggctaagttcaacgtctaactaatgagtccagatagtgattcactacgtatatacaggataagatatatgaagttaaaaagtcactaggatatatacttcaaaataaaagctat

SEQ ID NO: 232019 - DNA, 337 bp, Homo sapiens
gagacaaggtcccgctctgtctcccaggctggactgcagtagcacaatcatggctcactgcagcctccacctcccaggctcaaatgatccttccacctcagcctcctgaatagccgtgacgacaggtaagcaccaccatacccagctaatttttgtaatttcttttactagaggtaaggttttgccatgttgcccagactggtctccaacccctgggctcaagggatccgcctacctcagcctcccaaagtgctgggataacaggaataagtaagccaccagatccagcctgaaacctatttttcaattttcaaacatatgctttccaaatacgtaa

SEQ ID NO: 232020 - DNA, 758 bp, Homo sapiens
ggaggcagaggttgtggtgagctgagatcgtggcactgcactccagcctgggagacagagtgagactccatctcaaaaaaacaggaaagaaagatagattgtaaaaccttcagtgagtacgttggatgttgtgaaatttgccaaagagaagaaagatgatttttaaaggatataaaatatggaaataaaaaccactgacaacactgccacccgggggcaatgattgttaaggctcgggtgtgtgtgtgtgtgtatgtgtgcgcgcgcgcgcacacgtgcacctgccgtgtttgaaaaaaatggactgtcatgcattgtgagactttatagcatactctttcacatacacgtggagcatccctaatctgaaaatccaaatcttaaactggaaatgctccaaaatccgaaatgttttgagtgcagacatggcacacaagtgctcacgcagaatttcggattccaggttttcagtttagggatgctcagcctgcaaatattccacaaaacacaccacaacaagcaaaaaaagaacaagaggtgtggcgcccacgagccccagagaaagctgagagaacaatgcgaggagcacggagccccagaggcaacgtgacacgggcgacaagaggagtaacacgagacgaaacggggcaaagaagcaaagggcgagactctcacagcaaaaaaaacacctcgggggaacacacaaggtgagaaaaagcctaagagggaaaagaggggacacgaggggcatacaaagg

SEQ ID NO: 232021 - DNA, 629 bp, Homo sapiens
ggtggaccctgccggatcttgcgaagttgccaaggggtcaatgcccaggcgcgagtaattactgcattaatcccagaccccatcccgattcttgtcggggactgaagggtctccgcctggggctccgaagtcgatcatttcacattcacgcttcccaaaacgagacacaataaattccgctctggcctggagccttgaattcccgttacggtcccgccccgccgaggcccgtcgccttgtttctctgagtcagtttccccaacggtgaaagggaggacgctgacacctgcctgcccctccctatctgccgaggccgtggagatcagcagcagcgaaagcgctctgggcttagaagaggaaaagggctgcgtgagcccaagagcttgcatcggaaggctccaggaagagcatctgcaaaaaagaggattccacgggatgacccccgacaactcttggaattctaaaatcctatacccttgcccgcacccattcgtgtagtgaaggggcgcgcgttaggcgcagaggccacacgctccgcaagtgaacccgggcacctctctgaacctattccgggctgagggcggggagcgggtggctgcccgatttaaaaacatgtatatgtatgtgta

SEQ ID NO: 232022 - DNA, 702 bp, Homo sapiens
tgcaaagcacttccacagaccaatatgatttccagtaagagctaaataaattttgttagttgttaaggcataaaacattaatataggatattacagtcctaggcttacattacttaatttggattttttgcaaaaattaactttaatgtgaaaaattaggagacaatatagagaaaattcaagagcctctccagataaattcttagaactaatgagaaagttcactaaagtttctggatataaaatgcccagggcaccggagggggaaatactttcttgtatattaatagcaaacaattagaataatttttaaaataccatttataatagtaccaaaatctatgaagtatctaagaataagtctattaaaatatggccaaaacattcatggagaaaacttatagcctttatttaaagacataaaataattcttaaacaaatggagacattattaaatatgtttatggataagagagactcaatgtagtaaagatgtaatcttctccatctttcacttcctttgcttcctaattaagacttatatcgctcttggctgcgcacagtggctcacacctgtaatctcagcactttgggagaccaaggctggcagatcatatgaggccaggagttcaagaccagcctggccaataaggcgaaaccttatctctactaaaaaataaaaaataataataaaaaaaaata

SEQ ID NO: 232023 - DNA, 496 bp, Homo sapiens
ctttctttaacaatatggagtacatagacatttatttactttgaatattttagcacttaacatgtgttgaatatattcccacatcaagcagatttagctctttcttattaaatgctgccccacacaccacagtcaagaggttgcacatgtgttcaaacactctcttcttggtagatagtcagactatttggtgttccttctgcgaaccgccctactgtcatttaagtaacaaactctgttgatacaggagtggcctctaactcatttagtctcctgtggatcaaaataaaatcctggtctcctaaatgggtgcggctgggagatcacttgcttttcagagagtagtttccatttcctgtacatcagatggtcagccctttaagcatgccaatctctgctggtgctggaatagctctgtctgcgcaccggggcaggcggctcgctcttgcgggcggattcctggttcagcggggtctccctggagccggcggccgca

SEQ ID NO: 232024 - DNA, 365 bp, Homo sapiens
gagagagagatacatagtagaaatataatacacataagaattataatcagaaagaaatgtgtatgccagaacagaagaaaacaattcaatttatgagtgaactaaaaacatcataaagaaaattaaaacccagaccttctttaaagacttgttgtagccaggaaataattaaggattgcaggaaaataacaaaaactcagaaacaatcatcagggctggaatctatcaataggtataaaatcgttttcttctgaaacataatttttctctctcagattccccatttctaccaaagataaatcttagtgggaccaagttacttgtaaaataagttttagcattatattcagcttcattatttgcat

SEQ ID NO: 232025 - DNA, 1622 bp, Homo sapiens
ttcccagcctcagaaaggcagaaaccaggaaagctaagacaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaaaaaaga

SEQ ID NO: 232026 - DNA, 1506 bp, Homo sapiens
ttcccagcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaaaaaaga

SEQ ID NO: 232027 - DNA, 245 bp, Homo sapiens
atagctgaccagtaaaagcagatatttggggccatttcgtaatgagatgctaattcattatttcatctggaaagttactctcctatacacgcaccctagtccactatagtatacacatcataaataccagtttgtaccatctctaaatgtatgtcttttcattgtaaaaatatagggtttcttgttggcttaggcaataggagagcaaacatccctctgatcccatcagctctttctacagaacc

SEQ ID NO: 232028 - DNA, 370 bp, Homo sapiens
atttttgaataaaatggtggcataactgaaaagtcatggggagagaaagaacttggctccttatttattttgcaactagtgtgtatgctatttgcacatgtaccctaaaacttaaagtataataataataaaattaaaataaataaataatggttaaaaaaagaaaataaattcatactgttttttttattctattgaaaaaaaagatgatgtttttagagctagtggttttgtggttttagcaaggtatcacatgaggaaacaaatactaaacaaagttatgttgaaaaaatctccatgttacctctttttagtagaatggtaaagttttgccctaaaataattcctttcactccaagcaactctttct

SEQ ID NO: 232029 - DNA, 359 bp, Homo sapiens
taactcatgcaaccatatgttgatgatctgggggaggaaagcttataagcattgcaaattgctaccaggctattgcagcttcaacggcaatgtggagacttattcttcccacatttttgttccctaaagcagagtatatttcaaacttttgaatctttcatttccatttctctaccacaagaagatataaagccgctcagacacttgccggttaaagtacttgagctccaggataaatacttaggaatagagccagtcagatttgtctcccagcttttgtcccttttctcttctagtgaggaaattgcacctcattagctttgtgactttagaaagccacttcacctttctaaatctca

SEQ ID NO: 232030 - DNA, 169 bp, Homo sapiens
gaattcacagataaaataattttagctttactttataggtactgctgaagttgtagcaggaactactagtccttcactgatgcatgtagctgccttgccgtacagtctgtggtaacttttaggcattccttcatcaatcacagcctccatcccaactgtttcagatctt

SEQ ID NO: 232031 - DNA, 424 bp, Homo sapiens
agtatttccataaatcctggtcttagaatcttaacttgcaattttgtcaatgattctgatgtatctgaaatctatttctaaaaatctttttctgatttcaaatatgatacatcttacaacaaattctaacataatagaattctataaaggaagtggtagccctctgtatattcatctctcacaaatcaccacttttaacagtttgatatatatactttgacttttcttctgcacatctgcctctgtgtgtatacacatttttttcctaaatgggattatttcacaactccttttccctacgtgtcaatacctatagatagatcttgttctttttaatggttgtgtagaatttctctgtggatacacaactccatatggattgtttataatttttagataaaataaataatgctgtgattcattc

SEQ ID NO: 232032 - DNA, 773 bp, Homo sapiens
tactgtttccacaggatcagaaaatcttttgactgagcttccggaggaaattcaaaaggaaccccatacatcaattcattctcaggaagatgaattatttgggatgaaggtagcacttcatgggagaaattattctttacagctttttatataggacccttggagctttgtgtataccaccctatcacagccttactgctgacattgctatagtgacttcttgctctctgtgcttgaccattaaagatgcaaaacatttaggaaaacaaaataatttccctatgaacaagatgcaggaagctgtgctcctgctgcattgataacccagtggatgtgcttacagagcaccagagaccacaggaaagcataaagcacatcagtgtatttattaggaattatactttcagttcatactctggacatttttaaatcttagcctgttcactcaatccattgctctttcactgccttatttggagtatgcgcaggtacttgcaaactaattttaaaactaacctacctcaaagtgagtatggggaacagatgtgtgaaggatattctaaagataagtgacttgtatgttacctgtttttatttttaactctatggcactgcttcttttcatttaaatctaaaaactagacggtgaacttttttgtagattgggcctgtgttcagatactacctggcacatagtaaacattcagtcattgtttgattaggcattgagcatttgccatatttggctttttatatcccatgaatccttatgc

SEQ ID NO: 232033 - DNA, 381 bp, Homo sapiens
ggaggttgcagtgagccgagatcaatgccactgcactctccagcctgggcaacaagaaggagactttgtctccaaaaaaaaaaaaaaaaaataggcaaaggatctgaatagacatttctccaaagaagatatacaaatggccaagaagcaccatgaaaagacagtcaaggtcaggcacggtggctctcgcctataatcccagcactttgggaagctgaggtgggaggaacacttgagcccatgagttcgagactagcctaggcaaccaggcaaaaccccatctctacaaaaattacaaagtattagccgggcataatggcgtatgcctgtggtcccagctacttgggaggctgaggtgagaagatcgtttaagcccaggag

SEQ ID NO: 232034 - DNA, 430 bp, Homo sapiens
tccttggggctcacacaaggctggaaaaatttgttcccaccagctggagtggaaaaatttcataatacatgagcatcaagcaaagtactcagaagaccattttctcattactaacaagcaaaatgagctctagattaattaagcttaaaagtaagcctcaaatggatcaaactgtatttaagttacttaagtctatcccaggattaaatttaagaatatttaaaggaatacagaaatatccagtacacagcaaggtcaaattcatgatatttgacatataattaaaaaattagcagcatgcaaagaagccaaaaaatgtgactcataatgaagataaaaataaattagtagaaacagatcccaaaataagttactgtaattattttctgtatgttcaagaaggtaaaggaaaggacagctatgggaaata

SEQ ID NO: 232035 - DNA, 488 bp, Homo sapiens
tccttggggctcacacaaggctggaaaaatttgttcccaccagctggagtggaaaaatttcataatacatgagcatcaagcaaagtactcagaagaccattttctcattactaacaagcaaaatgagctctagattaattaagcttaaaagtaagcctcaaatggatcaaactgtatttaagttacttaagtctatcccaggattaaatttaagaatatttaaaggaatacagaaatatccagtacacagcaaggtcaaattcatgatatttgacatataattaaaaaattagcagcatgcaaagaagccaaaaaatgtgactcataatgaagataaaaataaattagtagaaacagatcccaaaataagttactgtaattattttctgtatgtttacacaagcgtacagcgaacgcccgtctatacgaaactctggggtatgggcgtgggggttgggcagtcgcactggcagcccagccgggctcac

SEQ ID NO: 232036 - DNA, 655 bp, Homo sapiens
gaagggagacagggaagtgctgggaggagaagggtgggtccctggcgagggctccacccccgggcctgtgcccacagacctaggtgaagacaggcactccagccttcacgtccaaatgttgcatttcccaagaccactttgacccgccacgcccccattctgtgcctataaaaaccccaagaccctagcaggaagacacacaagctggatgccgagagaaacacattggcgaaggaatacacaggtggatggacgtcgagaggaatgcactggtgtaggagcacactgggatgccagcaggccatcgactggtggaatgacacaaagtttggctggggcagttggagaagagttgggccaccaagcggccagactccaggggaaaaccatttcccttctggctgccccatctgctgagagctgcttccactcaataaaacctcgcactcattctccaagcccacatgtgatcctattcttctggtatgccaaagccaggatacagaaagccctctgtccttgccataaggcaggggtctaattgagctggttaacagaagccgcctatggacggctaaactaaaagagcatcctgtaacatatgcccactggggcttcagctgtaaacatttacccctagacactgccgtggggt

SEQ ID NO: 232037 - DNA, 417 bp, Homo sapiens
ttactacgtctcaagtgttctgctagcacttcacgtgtactaattcattcaatcctcaccactaccccatgaggtaggcatttttaataatatgactcctatgttagaagtgagacccaggttaagccagctgtccaaaatcacgaagccagttattggcagagtgctggctagaacccagttctcctgatgcccactcctattctctttctgctgtatgtatatacattataacaacagatatcttatattgaaacaccttctgcattccactgcactaaaggctttgcctcggcggggcgcagtggctcatgcctataatcccagcacattgggaggccaaggcaggtggatcacctgaggtcaggagtttgagaccagcctgaccaaatggagaaaccctgtatctactaaaaa

SEQ ID NO: 232038 - DNA, 423 bp, Homo sapiens
actccagcctgggcaacagagtgagactccatctcaaaaaaaaaaaaaaaaaaaaaagaattctatgatttcttggctgggtgtgctcacacctgtgatcccaacactttgggaggccagggtgggggaatcccttgagcttgggagtttgagaccagcctggccaacatagtgaaaccctgtctcaaaaaaaaaagaaaaaaggtaaagggagagaaggggaggggatgggaaggggaagagacagaaagggaggggaagggaaatctaccaggcttggtggcatgtgcctgtagtcccagatactcaggaggctgaggcgggaggatcacctgagcctggggaggttgagtctgcagtaagccgtgatcatgccaccacactccagcctgggccacagagtgagagcttgtcgccaaaaaa

SEQ ID NO: 232039 - DNA, 134 bp, Homo sapiens
cccagcagttccccaccaggcatttcaccttggctcacattgtccgttcccctgctctctcacgctttcattccagagtgggagatagagagttctggaagccctggcttcctggtctgcttgcatcctctgtt

SEQ ID NO: 232040 - DNA, 325 bp, Homo sapiens
aggaagggcagatcgatggaaccattcgaatacacataggtatcaattaagctcattgtcttttggaccatggcttgtgatgccccaaaacaatgacaatagtaatatcaatgatcactgataacagatcaccataacagatataataataacaaaacatttgaaatactacaagaattacaaagatgtaacacagaggtgcaaaataagcacatgctaccagaaaagtggcactggtagacttgcttggtgcacggttgctacaaaccttcaacctgtaaaaactgcaatatctgagaagcataataaagtgaagtgcaataaa

SEQ ID NO: 232041 - DNA, 407 bp, Homo sapiens
cagtggattgtgttacaggaaagaacgctgagcttagatgatctaccacttctatagcaagtagtaagcaaatctgctaaacctgctcttggtcctgaagggaaacagtaactcattcttcaaggttgctcaccagaaccctgaaaaatggcccacataaagaatgatcagggccttacatgtatggctcatgtagcaagatgtctgggagcacaagaagcccaaggaggactgtctgtctctgtagcaatctattacattttccctctcttgtgagactactgtcttttgttcctaagccgcactaaggtctgattgtcattttccaaaaggatctcttttgcacattgcaagaacataatacgtaatgcttataaagtttctataaaaaatttttctttgaaaaa

SEQ ID NO: 232042 - DNA, 159 bp, Homo sapiens
tgacagtttatattttaatcactcaaacttctacatatatatttatgtaaagaacatagacaaaaaatgttccatttttatttcaattttaaaggaattatggaaaaagccttaataaaaaaagactgaacttttggttaactgaaaaaaaggtaggag

SEQ ID NO: 232043 - DNA, 405 bp, Homo sapiens
cctgctcgcagtcatctggaggactaaacccctccctgtggtgctgtgcttcagtggccacgctcctttccactttcatgttctgcctgtacacctggttcctcttttaagttcctagaagatagcagtagcagaattagtgaaagtattaaagtctttgatctctctgataagtgcatagaaaaaatgctgacatatgtggtcctctctctgcttctgctaccacaaagaagacccccatgtgatttgcttgaccttatcaatcacttgggatgactcactctccttaccctgcccccttgccttgtatacaataaatagcagcaccttcaggcattcggggccactactggactccgtgcattgatggtagtggccccctgggcccagctgtctttcctacta

SEQ ID NO: 232044 - DNA, 349 bp, Homo sapiens
agtcttgccagtgtaggagtaaatggggacccttccttgggtggcaacaggaagaattctccaggatgtccacactgatacctacttctgatgtcatgggtggggacatgcatctgtatatgtatatttatgtagctatgctgcatgaacatataatttcagtggaaaaatagcacttatgaaatttatttgtttctaacattctccacagttagatctcagacatcagcctctaaaaaatattgttgtggagctctcatgttacatttgacattttcgaaactgtgaggtggaaagatggtagtagaataacagaaagaacatttttagatataagatcataagctaa

SEQ ID NO: 232045 - DNA, 136 bp, Homo sapiens
catgcttgtgtgggttattttatctcatgtgagccatgttatgtggacagggaaaagaggaggatgatggaggaggaggaaagaatcgacttgttccaactgctctccataataaaacttcattcaagtgcatata

SEQ ID NO: 232046 - DNA, 216 bp, Homo sapiens
cttctcactaatgtttcttgcagctctttcaaataggatatttccatatatgagccctttttcttgtggctttctattctattctattgtcttaattactaaaagctttatatcagggtatccaatctcttggcttccctgggccacattgaaaaaagaagaagtgtcttgggccacacataaaatacactaacactaagaatagctgacgagcta

SEQ ID NO: 232047 - DNA, 500 bp, Homo sapiens
agtgtatttaaataaacagtagtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactttgagaggccaaggcaggcagattacttgaggtcaggagttcgagatcagcctgggcaatatggtgaagccccgtctctactaaaaatagagaagttagccaggtgtggtggtgggcgcctgtagtcccagctacatgggaggccgaggcaggagaattgcttgaacccaggagggagaggttgcagtgagacaagatgatgccattgcactccagcctgggtcacagagcaagacttcatctg

SEQ ID NO: 232048 - DNA, 423 bp, Homo sapiens
  misc_feature (6)..(6): n is a, c, g, or t
  misc_feature (30)..(30): n is a, c, g, or t
  misc_feature (48)..(48): n is a, c, g, or t
  misc_feature (69)..(69): n is a, c, g, or t
ctcctntatgccttcccctgaacgcagtgngccctcactaataaattntgagggctgacactgcctganccggctggtctttgccctcaatttcattgagatgggccgtgagtgactaaagtaatgcattaatggttgaatggctggccaccgtgcctcatgcctgtaatcccagcactttgagaggccaaggcaggcagattacttgaggtcaggagttcgagatcagcctgggcaatatggtgaagccccgtctctactaaaaatagagaagttagccaggtgtggtggtgggcgcctgtagtcccagctacatgggaggccgaggcaggagaattgcttgaacccaggagggagaggttgcagtgagacaagatgatgccattgcactccagcctgggtcacagagcaagacttcatctg

SEQ ID NO: 232049 - DNA, 473 bp, Homo sapiens
tggcttggctgccacacacagagctgtcatacacacagtggggtagagctcgcccactgcccggccacacacgggtgctcatcacgcttgcagtgttctcatgctgtttctactgtgtgcactcctgtttcactctgtaaagacgtgggtctcagcctacaggagcaatttagtgaccacagacagtctgaaaaccatggtctgcgtcaccacctgtggggctccagggaaggcccggacctcgctgaccgctgctgtgtgggacgcgcggggccctgctctttgggctctgtgacctttcactccgtctcctccccttccttagcagagacagacggagagagagatagagacggagagagagagatggagagagacagagacagacggagagagatggagagagagatcgagacggagagagagagagagagacagagagatagagacagggagagagagacggagagaga

SEQ ID NO: 232050 - DNA, 593 bp, Homo sapiens
ggcagtctcatccaatccctgggaaagacctttgcatccctctgagcaaagtcgtcctaattgccctttatcataccattatcaaaacttgaaattcatttttatgtattcaaagaggatgcaaacctgagggctccaatcaatttggttgctaagtctaaggttaaatttggatgtaatgttgtaaatgttaatgaacaacctttcctggacctacataaaagttcagctgtagagaaggtataagcacaaataattagaaaagctgaagacagaagggaggctcttaagaggcatctattctgaacctcagctctcgggcagaagtacactgcaaacatctgagaaagacccatttgtccacccttgcatgcttgccatttaattccctcactcgctgcaaaggcaaaggggtaaccaagagcactggcatggttcacagaaaggtacagcagctaaatatacatcagggtggatgtcaactttctgcaaatccccttaagtgaatctctttaacttggagctattcttgccttccattctctattggggtcctttgaaaagcacaacatagtcatactaaaacctcacat

SEQ ID NO: 232051 - DNA, 378 bp, Homo sapiens
gctacttgggaggccgaggtgggaagatcactttagcccaggagttcgaggctgcagtgagccaggatggtgccaccgcattctagtctgggcaacagagcaagaccctgttcaaaaaaaaaaaagaaaaaagaaaaaagaaagaaagggaaattattgatatagtgctaaatttcttatgttaatatcctagcccccatagtgatacttttacgacgtgggccttttgggaggtgattaggtcacaagggcagaatccttgtgaatgggattagtgcccttgtaaaagaggcctaaaggagctcatttttgccttccttaaaagcttgaaacagcgtatttcttaagcatcttatctaaattgttggacattttacc

SEQ ID NO: 232052 - DNA, 119 bp, Homo sapiens
ggtagcaggatgggatgggaggtacagcacgggaatcagctgctggtcccagagcagtggaggggccaaaactccgcttagggcacgagtaagaggagtgataggaagaggcagctttt

SEQ ID NO: 232053 - DNA, 441 bp, Homo sapiens
gtgcaagaatcattgctgttggaagcgaagttcctctttgttgaagttaataccttgaaaatgactatctcaagaacttagctggcatccctccagatgttctatcagatgtacctaaccatgctgctctcacaaaagtcatgatgtgacaaagtgatgaggcaacggtttactcagtttctctaaaaggaataacccttctccatccgtactgcatccaataattctataaacctgaattaattttctattggtcaatcaatctttccattgagatggataaatgtgtcagagtttactacaactacctgttttcatatccgaatttaccatgactataagctcctcaagtctaggagtcttttatttcctttaatttgcagtaccaagcaaacgttccacagaggtcatctgaaataaaggcttagtgcataattaatt

SEQ ID NO: 232054 - DNA, 365 bp, Homo sapiens
aatataaggcaggcacatttataagtattaaaagctgtaaggaagcattttactttcgtttaggtggcttgatgtccttcacattctcggcatcagcttgatatttcagtgtaacatacagtactgcaaacaacatatttggtgtactatatgcattcagttttcacttacacaaaacaccagttatggaacacttcctgaaacagaatggtggcttaaatcaaggcacagctgtatagctggtacttccctggaagaatctggctttgaactaagagaaaaccacaaccagaatggctcatgagaattataacaggtagggtagaccctatagtaatcaaaatcataataaagacactagagta

SEQ ID NO: 232055 - DNA, 595 bp, Homo sapiens
taagggtttaaggactggttttaaactattataacttaagctttatgtccacataattaacaaatttgtaccaacagtagttttctcataatacacaatctaatgtttgcaaaagcatcatgatcacacatgtataacacacttccacttctgtgtactggaacagcttttaaaggtatttctgtattacaacttaatctcaagctaattaattcaaaggtgagaccatcattacagtttgacttgttcctctatcttatcactctgataaaaatcatctggtatgatagagcattctataaaatttgagtattagatatattttatttgatatcattcacaaggtgtattgaaatgcccttcattaatgataaagcaccatgttaattatagataattagaatttgatttcttaatttcaggacccccgcttcggtcttcactttctgacaaagctgatgtactttggccaatgaacatgaattcaaatattggttagtcttgttctatcttgtgaaataacggagtagatgttccagtatttaaatatagtcccagtttataactagatacatgaacaaaacaaaaacaaaaa

SEQ ID NO: 232056 - DNA, 356 bp, Homo sapiens
aactgttaccaaggagatggattgccttccaaaggcaaatatgatgatgaagaattcccacccctcccccagcccccgcctttggctgctcttgtgttcaaagaatgtcactgtacccaactgttttccttgcaaggaatagggacgaaagtaccttgtcttaaacttttgtggttagagaagcccacagcccttagggaaacattgcatttttaaaaaatgactttaaatccgtgctgttgatacttatgtctaatgccagtcattggtctgggatctgtgtgcagagttgccttctgtctggtgagactggagtgggtgcgggtcagattccgtaacctcgtggagagaggata

SEQ ID NO: 232057 - DNA, 226 bp, Homo sapiens
cgtggtcagatgatgatgacaatgatgatgatgaaggcaatgtttaagtgtagtggttgttagagcgaagctagggagtagtagtggaaagaatactaacccaggtatcaaaacttgatgtctgcgcctgggttttgccctgctttatccagtacaagaccctaaattcacaattgatttagttctttatcactagaaagactacctgatcttgtttttccacctc

SEQ ID NO: 232058 - DNA, 432 bp, Homo sapiens
agcctgaaatgaatttaagtgtatcccactacaaagcctgacaatatttaaaggaatacaacaaaatccagatcccaacagtgtaacattaataatgttgaatattcattagagcatcatcacacatacaaaagctggaaaattcaacccagaaataggagaaaatgtaaccaatagaaaaggggttagaaatgaaagggatgatagaattggttaacaagttcattcaaacaactactattagtatacttcgtttgttcaaggaggtaaaaaaaacatgaacacaagaggattcataaaggactcagattcaacttctagtgatgaaaatgcaatatctgaaatgaaaatactctgaatgggattaacagatactacagaagtaaagaaaagtcaatttgaagacacagaatttaaaaatacacaatataa

SEQ ID NO: 232059 - DNA, 388 bp, Homo sapiens
gagagatttggtatatgattgagatgggggctagtttttgtcatgtgagtaagaagcaggccggatgtcagaggggtgccttgggttaacctctgggactcagaagtgaaagggccatttcaaagaactcaaatgagcgagtcttcacacaccctcctcaggggactgcggttcctgcttacaaagcagagcggtccttgtactttaaaaaaacaaaaacaaaaaaaaattctttcaccctttcctaatgagatccgcaaacatgatgcagacaagaaatgcaccggttcagaggagggaaggtcaggccgcctggggggagtccacgaaaaagatggacgtgccagatgctgtgcctggtgctgggaaagagtattaaagcgcggcc

SEQ ID NO: 232060 - DNA, 384 bp, Homo sapiens
caatgtgacagcaggaccaagggacccatttcaaagaactcaaatgagcgagtcttcacacaccctcctcaggggactgcggttcctgcttacaaagcagagcggtccttgtactttaaaaaaacaaaaacaaaaaaaaattctttcaccctttcctacctgaatgcagcaatgcagtcgcctggcatggagggttaactaccacgcggtaccaaacactccacaaacggaaaacccccatgaggggccggcggcgacgccaagtgccgctccagccaaccagtgaaggccggcgccgggcaagctggactccaacgactgtctggcttggaaggcgagacccacactgaggtcgcccagctcaggagctcgcgcagaacagtc

SEQ ID NO: 232061 - DNA, 1671 bp, Homo sapiens
  misc_feature (24)..(24): n is a, c, g, or t
  misc_feature (39)..(39): n is a, c, g, or t
  misc_feature (42)..(42): n is a, c, g, or t
  misc_feature (46)..(46): n is a, c, g, or t
  misc_feature (48)..(49): n is a, c, g, or t
  misc_feature (53)..(54): n is a, c, g, or t
  misc_feature (74)..(75): n is a, c, g, or t
  misc_feature (88)..(88): n is a, c, g, or t
  misc_feature (93)..(93): n is a, c, g, or t
  misc_feature (102)..(102): n is a, c, g, or t
  misc_feature (104)..(104): n is a, c, g, or t
  misc_feature (108)..(108): n is a, c, g, or t
  misc_feature (123)..(123): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (168)..(168): n is a, c, g, or t
  misc_feature (181)..(182): n is a, c, g, or t
  misc_feature (185)..(185): n is a, c, g, or t
  misc_feature (188)..(188): n is a, c, g, or t
  misc_feature (198)..(198): n is a, c, g, or t
  misc_feature (200)..(200): n is a, c, g, or t
  misc_feature (240)..(240): n is a, c, g, or t
  misc_feature (254)..(254): n is a, c, g, or t
  misc_feature (291)..(291): n is a, c, g, or t
  misc_feature (303)..(303): n is a, c, g, or t
  misc_feature (311)..(311): n is a, c, g, or t
  misc_feature (327)..(327): n is a, c, g, or t
  misc_feature (394)..(394): n is a, c, g, or t
  misc_feature (409)..(409): n is a, c, g, or t
  misc_feature (412)..(412): n is a, c, g, or t
gccaggcggagacccggaggaccnaagcttccggacgangangaancnnccannatggcctcggagagtgggannctttggggtggcnggttngtgggtgcngnggancccatcatgaaagtncaacgcgtccattgctacgancggcacctntgggangtggatgtnaaggcagtaaagnntanagnaggggcctgnanaaggcagggctcctaaccaaggccgagatggaccagatantccatggcctaganaaggtggctgaggagtgggcccagggcaccttcaaantgaactccaatnatgagganatccacacagccaatnagcgccgcctgaaggagctcattggtgcaaggcagggaagctgcacacgggacggagctggaatgancaggtggtcacaganctnaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagagtgtgccgggctcctgatgaccctcaagggacttcccagcacctacaacaaagacttacaggaagacaaggctgtgtttgagtgtcagacactatgagtgccgtgctccaggtggccactggcgtcatctctacgctgcagattcacaagagaacatgggacaggctctcagccccgacatgctggccactgaccttgcctattacctggtccgcaaagggcacccagatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggtgtcgtggcccatgca

SEQ ID NO: 232062 - DNA, 1421 bp, Homo sapiens
  misc_feature (24)..(24): n is a, c, g, or t
  misc_feature (39)..(39): n is a, c, g, or t
  misc_feature (42)..(42): n is a, c, g, or t
  misc_feature (46)..(46): n is a, c, g, or t
  misc_feature (48)..(49): n is a, c, g, or t
  misc_feature (53)..(54): n is a, c, g, or t
  misc_feature (74)..(75): n is a, c, g, or t
  misc_feature (88)..(88): n is a, c, g, or t
  misc_feature (93)..(93): n is a, c, g, or t
  misc_feature (102)..(102): n is a, c, g, or t
  misc_feature (104)..(104): n is a, c, g, or t
  misc_feature (108)..(108): n is a, c, g, or t
  misc_feature (123)..(123): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (168)..(168): n is a, c, g, or t
  misc_feature (181)..(182): n is a, c, g, or t
  misc_feature (185)..(185): n is a, c, g, or t
  misc_feature (188)..(188): n is a, c, g, or t
  misc_feature (198)..(198): n is a, c, g, or t
  misc_feature (200)..(200): n is a, c, g, or t
  misc_feature (240)..(240): n is a, c, g, or t
  misc_feature (254)..(254): n is a, c, g, or t
  misc_feature (291)..(291): n is a, c, g, or t
  misc_feature (303)..(303): n is a, c, g, or t
  misc_feature (311)..(311): n is a, c, g, or t
  misc_feature (327)..(327): n is a, c, g, or t
  misc_feature (394)..(394): n is a, c, g, or t
  misc_feature (409)..(409): n is a, c, g, or t
  misc_feature (412)..(412): n is a, c, g, or t
gccaggcggagacccggaggaccnaagcttccggacgangangaancnnccannatggcctcggagagtgggannctttggggtggcnggttngtgggtgcngnggancccatcatgaaagtncaacgcgtccattgctacgancggcacctntgggangtggatgtnaaggcagtaaagnntanagnaggggcctgnanaaggcagggctcctaaccaaggccgagatggaccagatantccatggcctaganaaggtggctgaggagtgggcccagggcaccttcaaantgaactccaatnatgagganatccacacagccaatnagcgccgcctgaaggagctcattggtgcaaggcagggaagctgcacacgggacggagctggaatgancaggtggtcacaganctnaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacccagatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggtgtcgtggcccatgca

SEQ ID NO: 232063 - DNA, 221 bp, Homo sapiens
ggctgatggtgggtggccaggggggcaggatcccgggtccagcccctgtgcctccctcttcccgcagtgtgccgggctcctgatgaccctcaagggacttcccagcacctacaacaaagacttacaggtgcgaggccgggggaggcctggctagtatgtgccagttctcagggctctggcacactcaggcagggccccaccccgggattgccatacatcct

SEQ ID NO: 232064 - DNA, 1536 bp, Homo sapiens
  misc_feature (24)..(24): n is a, c, g, or t
  misc_feature (39)..(39): n is a, c, g, or t
  misc_feature (42)..(42): n is a, c, g, or t
  misc_feature (46)..(46): n is a, c, g, or t
  misc_feature (48)..(49): n is a, c, g, or t
  misc_feature (53)..(54): n is a, c, g, or t
  misc_feature (74)..(75): n is a, c, g, or t
  misc_feature (88)..(88): n is a, c, g, or t
  misc_feature (93)..(93): n is a, c, g, or t
  misc_feature (102)..(102): n is a, c, g, or t
  misc_feature (104)..(104): n is a, c, g, or t
  misc_feature (108)..(108): n is a, c, g, or t
  misc_feature (123)..(123): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (168)..(168): n is a, c, g, or t
  misc_feature (181)..(182): n is a, c, g, or t
  misc_feature (185)..(185): n is a, c, g, or t
  misc_feature (188)..(188): n is a, c, g, or t
  misc_feature (198)..(198): n is a, c, g, or t
  misc_feature (200)..(200): n is a, c, g, or t
  misc_feature (240)..(240): n is a, c, g, or t
  misc_feature (254)..(254): n is a, c, g, or t
  misc_feature (291)..(291): n is a, c, g, or t
  misc_feature (303)..(303): n is a, c, g, or t
  misc_feature (311)..(311): n is a, c, g, or t
  misc_feature (327)..(327): n is a, c, g, or t
  misc_feature (394)..(394): n is a, c, g, or t
  misc_feature (409)..(409): n is a, c, g, or t
  misc_feature (412)..(412): n is a, c, g, or t
gccaggcggagacccggaggaccnaagcttccggacgangangaancnnccannatggcctcggagagtgggannctttggggtggcnggttngtgggtgcngnggancccatcatgaaagtncaacgcgtccattgctacgancggcacctntgggangtggatgtnaaggcagtaaagnntanagnaggggcctgnanaaggcagggctcctaaccaaggccgagatggaccagatantccatggcctaganaaggtggctgaggagtgggcccagggcaccttcaaantgaactccaatnatgagganatccacacagccaatnagcgccgcctgaaggagctcattggtgcaaggcagggaagctgcacacgggacggagctggaatgancaggtggtcacaganctnaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggtgtgccgggctcctgatgaccctcaagggacttcccagcacctacaacaaagacttacaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggtgtcgtggcccatgca

SEQ ID NO: 232065 - DNA, 529 bp, Homo sapiens
atctgctcagcgggggaccctgcatggagccccagctctcgctaaggtgacgaccaagccattgaatgtgtctgagcagggccagagccctccagcaaggctcctggcaagcccagcctgctgccctcagcctgacatgtgggaacatgtgtcaggagacaagtgtcctgcacccagggtgacttagtgcttggggacaagtgttttgtggacacttggggacaagtattctgtacccaaggagactgggccagggaagaggctaagcgccaggtggttgccctggcaaccaggacttggttctctgtgtgtgcgttcgtgtgtgtgtgtgtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacct

SEQ ID NO: 232066 - DNA, 296 bp, Homo sapiens
acactactgtggaaaactagaaatttaggatataattttagacaaagaatttctgcaaattctattttttattcatattgccaacttgctgttaagattctaccaatttcttcttcctaccacagtgtaacaaagggttattttttcactctttcactgcattttgtggcaaaagtatcttcaactaacaaccatggccacagcaatattaaaaaactaagagtaggttgggcacagtggctcacacctgtaatcccagcactttgggaggccaaggcaggcggatccacttgagt

SEQ ID NO: 232067 - DNA, 522 bp, Homo sapiens
ttttttcaaaatgtattaattagagtcttattttcagagtcttattatgggagccatttattgactcaggcccaaataattcaatatgatgcccctaaaacttctctgcaaattatggagaatgatagtgggttaaaggaataagagactttgtgctaaaggggtaacttagagccattttaaggaggaaagccatgaaacagtcataggaaaacagaagtctaagatcaagtccaaatgttgtgtggcaaagatgatgaaagtaaaggatgtatttttgtgaattctggtggttttaactttgtttttaattttctgagtaatccaagggtctgtattttatgaatctacaacagtataggtaacattttattgcaactgaatttatttcaaaaattattagttttggctgggcgcggtggctcacgtctgtaatctcagcactttgggaggccgaggcgagtggatcatgaggtcaggagatcgagagcatcctggctaacacggtgaaaccccatctac

SEQ ID NO: 232068 - DNA, 257 bp, Homo sapiens
tttggaagagacatggtcccattctgtcgcccagactggggagcagtggcatgataatagctcactgcagcctcaaatttctgggctcaaatgaccttcccacatcagctttctaagtagctaggtccacaggtgtgcaccaccatggctagctaagggggtttttttttttttttttttttttgagagatgcggggtcttgctatgttgctcaggctgttctcaaactcctgacctcaagcagtcctttccccttc

SEQ ID NO: 232069 - DNA, 235 bp, Homo sapiens
cattatggttttaatttgcctttccctgataattagtgattccaagcatcttttcatattcctgttggccatatgcatatcttcttttgagaaatgtccattcaggtcctttacccattttttaatcgagttatttttcttgctgtttagtttgagtttttgacatattttggatattaaccccaagagctactcttcaccctaacaatttcacaagataaagtgactctgccga

SEQ ID NO: 232070 - DNA, 347 bp, Homo sapiens
taatcgaataaccccgatcaacctcaccaccttttgctcagcctatataccgccatcttcagcaaaccctgatgttggctacaatgtctgcgacttgatatcaattcgctgactaagctatcagagtatctaaataatacgttatccacccattttttaatcgagttatttttcttgctgtttagtttgagtttttgacatattttggatattaaccccaagagctactcttcaccctaactatggcacactatcagcagtccagtctttcatcagttattctgcatttacctatttgaggaccatgcatggtatctggggatgacatagatgattctgtcctcaga

SEQ ID NO: 232071 - DNA, 230 bp, Homo sapiens
caaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctg

SEQ ID NO: 232072 - DNA, 776 bp, Homo sapiens
ggaggcggaggttgcagtgagccgagattacaccactgcactccagcctaggcaacaagagtgaaactccatctccaagaaaaaaaaaaaaagtacttggcatgatatttgaagctacctaaagtcatttgcctaagttcataattaatattcctaaaatttatatgttctcatctatacatgtccctaaaattactatataatagaaggaaaatgtacatttatgcttaaaatcactaggatcagcaacactgattaatggagagataagcatggaatgtatttgaacagcagcaaggcacagtgaaaggaacctttgtcccagccagacctaggtttgcatctttgctccaccatttactagctgtgtggctttggatggggtaggtcttagttttcctactatattaagtggagggtaataactaccttggatgattgttgtgaggaaatagacataaaatgtttagcacagcaccatgaacatgccagacattaattcaaatgatagctgccattatatttggtctttacttacaaatacagtagtacatggaccataattctaaaatgttttacctttattgaaggtatggaatttaaagtccttaggtgtggcaaaccaccatggcacacatttacctaggtaacaaacctgcatcctgcacctgtatcctagaacttaaaatagaataaaataggacaaaattaaatttaaaaaaattaaagtgtttgggtttttttttttttttttgagacggattcttgctctgtcg

SEQ ID NO: 232073 - DNA, 402 bp, Homo sapiens
ggctcttatttaaattttgtttttgttgtctttgaattgtttcctttgtacaagtcatttccctaaataatctccagatttcttcatgagtggaatagttaggtacttcctttgaatacctttgccaacagccttttttcctccttccccataattatcataactattacccacaaatggataaatttggttcctatctttcagtgcttttcatgaggttatcatctataattttctgccccaaagtctccttttaaaaaaagtattttttctatatagtcatgaaggctatcattcaaatcccagaagttgtagttttaccctttttgtttagtactgttaaaactcagctttggaatgatgagaattcagctcatttatcttacatcttttctttccaaa

SEQ ID NO: 232074 - DNA, 288 bp, Homo sapiens
gcgcacaaacctgaggacctaggcgggtgaggggtctgcaggtccagacgcctgaggggaagcatgccagggtgcccagtgccccccaaggtggtgggcgaggtttctggagaggtcccggaggagcgggcttgggcagcaggggtcaggttcaggaccctctgtgcatgagtccaggttgactctgcaggacggcatttcgagccacctggcatggcgttccaggcctgtgacggggcagtgcaggggtccgaactggcaggcacccaggtcctgaggacttcatgg

SEQ ID NO: 232075 - DNA, 494 bp, Homo sapiens
tgctcggtgccatcacagttttggctttctccaggatttatttgtaatcagcttgtcccgatttgggggtggggtgggtgagtagagaattagagacgacactggctagtgtgtgtgtgtgtgtgaagtagagggtagtaaatggagattggtcctggtgtcacaggcagctctgccccctccctccacttccagatgtcccactgctcctcatcaagcttcctggccagggcacacacatgtagacttgaaccccagctcctagttagtgctatgtccattaccacatagccaactaacaaaaggcacctcccacacctgcctgaccctccagggccccctctagaagctcacccgtctggctttattcaggctgggtgcggtggctcatgcctgtaatcccagcactttgggaggcccacgagggccaatcacttgatgtcaggagttcaagaccaggctggccaacatagtgaaaccccttctctactaaa

SEQ ID NO: 232076 - DNA, 907 bp, Homo sapiens
agagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaagcattgactcattcagaagtgggaggagaacgtcccgagaattcatgggaaagttttctggaaatgttggtcccggaaaggagcacttgaaacatattgctgaaagagggggaaggggccggattgcttgcaggccatcaggcgaagaagaagcccagaagaggcctaatcggaggggtccccttcccctcttttcggggggctctccgggaagaagtcccacacttggcccaggaaatttccgggcaaggggggcatattacggggggggaagaaatgttcccttcggccctttgccgacaagaacttgttcatgggcccaacaggg

SEQ ID NO: 232077 - DNA, 720 bp, Homo sapiens
agagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgtgagttccagccttaccccagagttccctgactctgtaggagacatatcacctcccactccatctcagctgaactggctttgcagttggctttgatgatcactcccaaaagttcagtgaatgaattaccactatgttaactgttcacaaaaagaatgaaacagacagtttctgccgttacggtctggtaccaacacattcgtataaagccatacagccaactaaataaatgagtaatttata

SEQ ID NO: 232078 - DNA, 606 bp, Homo sapiens
ccctcactctcatgtaaatgtaacttggggcgatgcaggatagtgtccagcattcaggaaacagggccttggtggaaagagcggccagccaggagaatcaagtctctaggccttttcagagccgaaatgcagccaagcaggaaggcggacaggcgcccagggctcctggggcaaggagctgccccttccctcctcctgcgaagagcggtcgccaaccgctcccgtgcctcctcttctagcccaaggagttcgcccgggccatccctaagcccaacagcagcccccagggctcttcacaggtcataagcccctctgagcggcgacagtcctcgcatccagcccgggtcagggagcgggggtgactgtccccagcacggcggccagaagaccccaaatgcggagcctgcccaagatggcggccacgactacgccgcgacaagacggccccgagctcggtgtgcccgagcttggagcccgccggaccgcaccaacacggggacctcccctctgccagtcccaagacggcgccaccgcctccaaaggccatgcccgccgtcgggatggcggccgcacgcccctcgataccgcccgcttccagatcactta

SEQ ID NO: 232079 - DNA, 483 bp, Homo sapiens
gcccatggaggggaaaaggacagaagggaacagtggtatccagtatcccaaacccttgcaggtgttcactctgtgtgtgcgtgtgtgtgtctgtgtctgtgttttagttatgctctaaattgtggtttctctgtctgaagttacaaatgaaaggtgaatacaatatattgtatttagtaacaatgatatggactggtacatccagacagataatgtgcagttgtaattagactcaatagacaggcagtcatttttaaattctttgacacatgcataaaatagtcatataataagataagatgacaattttatgttaggttgataaagtgtcccgatacatgcatttaaatgtctgtaagcctttttaaaaaaatccagacagattaattccagtttccagtatttgcaattagtcactaaatttttaaatcccactaaacaatggctatcaatatttttcccctgtttctggattttctttaa

SEQ ID NO: 232080 - DNA, 425 bp, Homo sapiens
gggtaaaagtatgtatatgtttgtcaggctcctacattttactttgaattggtaaaatagtaacttgaagtagactgtaaaacactaggaatgcatattgcaatatctagaacagtcactatacacacacacacacacacaaagagatattgccaaaaaaggcaacagatacattaaaatgaaatactaaaaactttaagtaattcaaaagaaggcaggaacaatggaacagaaccaaaacacacagaggacaaacagaaaccacataatacaataatagacataaattcaaccataccaataattacattaaatgtaaatgagctaaacataccactaaaaaaacagagattgtcagattggataaaaaagaagactcaaatataagctgtctacaaaaagctaatttaaatatgacataggtt

SEQ ID NO: 232081 - DNA, 246 bp, Homo sapiens
gaagacaagatctcactctgttgcctaggctagatggagcatagtggcgccatcccagctcactgcccccttgacttcctgggctccagtgatcctcccacctccttctggtactccaattacacatatattagtgtaacaatattggctaataggtcttttatatattcatttttttcagttttttctttatactgaaaaatttctattactatgtcttcaagttccttaatctgttaattccgc

SEQ ID NO: 232082 - DNA, 657 bp, Homo sapiens
ttaacttatttgatagacagataccagttaccaccttggatttatttcaagtagaaagaaaatttgtaagtgtgaatttttcacaaaaatgtgaaatagtaaaactattaaatcagttttactttggtttaaaaggatcctttgggaatctggaagtcccaacccctttagttatagtgattaaaaatcaaaccacctacttaaccaaatatttaacaaaaatattcttttcaccctttagcaaattcttccagaattactaaagatctgataatgtgagatctcaacaaacaaacaattcaagaagaggatttaaattttagaaatttaaattggggcattttagttaatcttacttttaaacaccaaacagtggcatcaatattttgtcaactttggtcaaataagatcagatgttcacatcaatcatctacttttcttggccttttctctatttggcctcttagtatgagcacactttgtaaaatgtaataaaaacatgtggtgtgcttcttgacatctaatccacttgcagtaatttctaggctttttgctcctgttaggtcctataaaataatgacattagtcattctcccaagaggctataaaaggaagcactgaattgcatcctgtttttcaaagataactcttcagatt

SEQ ID NO: 232083 - DNA, 806 bp, Homo sapiens
aagatctgtgtgtaggcacctactatatttgttctgtttctagtgctgtgtaggttttaagagttcaatgtgttccagtgttctgagtgtctacattttcactcctcatagctacttggaaagatttggcaagtaaacttgctaccatggttgggggaggataaatgcctttatcctttagtgctcccaacaacaggaccttttatggccaagcacacataaaagtccatgtgattacttaggctcatagagcctagtgccatggagaaaatgttggagaaatagatgttgtgtttgctatatgcacatgccaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccctgtaactctactttaaaatacgacccactaggattttttaaaaaagaagaaagaaagaaata

SEQ ID NO: 232084 - DNA, 166 bp, Homo sapiens
gctccagggacctacctgacttcctattcatgctgatcccactgagacccttatcaaccctgacctgttccccatgtgcctcttggatctgccttatgttccaggaactaacgttccctacagagaacttcaggttgcatcagggaacatatatacccaccagtca

SEQ ID NO: 232085 - DNA, 354 bp, Homo sapiens
ctcagtagccaggcacagctgttgctcagtgataatagttgaattaacaaatgaaagacttggctatcattaagatcccttccagatctcaaattctttggccagtttaacacataagagctctcaatctttcactcctctctcacttttattcctttcagcgactttttggtgatactgttcaatatggaaatggcacattgagtgcttaaactcagcttggattgaaattccatctccatcatttaataactgacctggagcaagatacttgacctctttatgcctcagtttctgtgcctgtaagatgaatatgatcatattaacaacctcatagagttgtcttgactttgt

SEQ ID NO: 232086 - DNA, 463 bp, Homo sapiens
aaaaacattcccgctaaaagagactaggacttctggaaacaaaatggctgaagccaggtctggacaggaaatgtacaagaggagtgtggaatatgttgaaagcaagggaactattgaaagactaccagtctttgatataacatgcaaacataaatgtacacatatccatacctatttctatatctgtgtgagtatgtgtatgtatatgtgtgtatatatacatatacacctaaccatgagttcatactgataccttcagtccattcaaatactgcagagttgattctcgtcttccttttttccacatttgactaggtcatgttgaaggaactcaggagccaacttagagaggctcccatgagccaaatgtgaacagcaataagaataataactgcagtgcagtaaaacatggcagatatatttaagtgcatgccttcattgtatcccataaagaagtaataaa

SEQ ID NO: 232087 - DNA, 501 bp, Homo sapiens
ccctgcacacttagggtgtctggggactgataatgctaactttagttctttgctcctgatttcacctatctgtgacattctttgtcttgatacaagtgtctgtagtactacattcacttgcttaatggtttaggggcagccacagccagtggaatgctttccagaggtagctgggcaacttgggagagagaaggaggaggatgaggccaggcatggtgactcatgcctgtaatcccagcactttgggatgctgaaatgggaggatcacttgaggctaggactttgagaccagcctgggcaacatagtgagaccttgtctctacaaaaataaaaataaatttaaaaattagccaggcatggtggtgtaggcctgtagtcccaactactcgggaggctgaggtaggaggattgtttgagcccaggaattcgaggctacagtgagctataattgtgccactgccctactactgcagcctgggtgacagagcaagaccctgtctc

SEQ ID NO: 232088 - DNA, 483 bp, Homo sapiens
gagtgtgtatagccaatgtgggggaggaaacacccatggcctaatgtcatatcatttcattaactcagtaagacttaccctagctgtatcccaaataaccaactctcataactgtattggacaattcatcaaatgcttatgggtgacattgaatggttgtgactgtgcactgtatataaaacccattactgatgaaggaagtgactattactaaagcaagtgggaatagcaatcagcaattggacaaattcaaccatgaatttcatagacaaagcaactgtgggttcaagcatgtcatgggaaacaattgcttggcttaacacaattcatgagcaaaatcaacttgctaaaatgcaggccatttggccctgagggctggagagaaccattatattgctgatgatatttgttgttgaacttggatctctttcacacggcatttgacaatgggctcagagtccatgggtccctagttgacttttc

SEQ ID NO: 232089 - DNA, 224 bp, Homo sapiens
cccagctaatttttgtatttttagtagagatggggtttcagcatgttggccaggctggtctcgaactcctggcctcaagtgatccaccctcctcagcctcccaaagtattgggattataggtgtgagccaccgcgcctgaccagtaatgttactttcttctcctgcctggtctctgctcacagagacctaacatcaaggtgatgtgactcttatttttcttagg

SEQ ID NO: 232090 - DNA, 448 bp, Homo sapiens
aatcatacagccctgtaatcatattctcttacttgattgtatgtcattaaatgctgatgtgtagtttctgaaatctgcatcctgaatgaacacacagcagtaagccttgtgctttgcttttcctgctgtttccagcctggcattatcatgaataaggctgaaattatctatttgtgcatctatggtcttttttttttcagtttttttcttacattaaatttccagaaattgagaaaatgaggaaaacaaattaagtatgaaaattattatgcagatgataaagcattggaaaaaaatttgaaaatgtatatgcagaaataagaaattgaaatgctctaaatttttccacctagtcataaattagaaaataaattaactagcaaataagtgaaataagtaatttcaaatccaaaattaaatttaagtagtaaaaattttggaaagtaca

SEQ ID NO: 232091 - DNA, 201 bp, Homo sapiens
attactcttagtctttgagttaattgagttaaggaaggtcagtcagaaataaagtacatataccattattataggaaattcttttcccttgataaagagtagtaatttgtaacaaagaaagcaggtatgcagcatcatctttgtagaatgaagcttaagaagtcatctgtatatgtacgtatttttttcctttttagcttg

SEQ ID NO: 232092 - DNA, 260 bp, Homo sapiens
cggggaaggaagcaccatggggcgggagggaaagggtctccgcttcaaaccgtgcataaaaccaacgttttaaaaaatacttgattgacttgcagatctccatcctggacatggagggcttctgggcccagctctttaatattcaaatgactttgaaaaatatttctcctcctggaaagcagagggaagaggaaatgctttgaagccttgctagttatttaattagttttttcaaaggtaaggcagtatatttttatcca

SEQ ID NO: 232093 - DNA, 720 bp, Homo sapiens
tgcttgctcccttagaatgggattcaccccttagcatgttttggtttcctccatcatcagattgctaactcccacccctaccgcttgcagagtgtctgagtccagtgtcatctctaggcttgttttacttgctgcacaaaacctctcctgagcagagaagctgggtaaccagtcttcctgacataaggagtgtgtacttgccagtcatcccatgggcagcctccctggtgacactgcccaagcagatgccatccctagccttggcccagaccactcaggagacatgctctgagtcacacactggagagctagaaagaacttaaaggtgcctggccactggggatttattttttaatctggggaacaagacacatacaaatgtatccacacaatgccataaatatcagatgatgctctccacagatccccaactcacgaggctctgagaggtaacttacaaatggacccaagtattcaggtggagaggaaaggtagggctcatggagttttcctgaaggttttattaggaaaggaaagtggacatctccagtgtatatatgtacatatacactgttgtttgacagcgcacaaattgctgggctttggtttcctggggataatcacggtctccatcccatagggttatggtcaggattaaatggaaaaaaatatagtgtctggcaagtagtcaataaatgttagctaatgctactattacta

SEQ ID NO: 232094 - DNA, 416 bp, Homo sapiens
caactggcctggtttcaaggaaaaaaatcatgtgaatttgattgaagtgctctctgtggggtgcaccacacagacggggacatatgtgcagcctggctgtgtgtttgctaataggaaagaggactgaggccaagaaagagaggctggaggtgagatgactcattctctcaaacagaagagggagcactgaatttgaacatgatgcagacaaaggaaggcaaaccagctgaagaaagaggtgccaggagacttgcaaggagacatgaatcctgggattatctgaataataaatgccatcacattctacttttaatacatacttcatctctttcacctagtgcactatgagttactacggggaagaatctgtgtgcctatctttctgttttcagtgatgatatactgaaagaatggtg

SEQ ID NO: 232095 - DNA, 554 bp, Homo sapiens
  misc_feature (7)..(7): n is a, c, g, or t
  misc_feature (32)..(32): n is a, c, g, or t
  misc_feature (36)..(36): n is a, c, g, or t
  misc_feature (59)..(59): n is a, c, g, or t
  misc_feature (71)..(71): n is a, c, g, or t
  misc_feature (135)..(135): n is a, c, g, or t
aaaaaanttgtcttttttgaaaaatatgtacngccnccttgaaatctgggcttttaaanatggctcctgcnttttcacatgggacccaatgaagtgtttagaaattgctgcaagccaagtaatactccagtgggncagtcagtaggagagcattttcagagggaagagctgtctcaacagaattacaccttactgtattttcaggatgaatttattatttctgccgtcttttggaataaattatttttctgctttctatgggggggaaaaaagaatttgggccaggaactgtggctcatgcctataatcccgacactttgggagactgaggtaggcagatcacctgaggccaggagttccagaccatcctgggcagcatggtgaaaccttgtctctacaaaaaaaaaaaaaaatcacacaaaaattagccaagcatggtggcacgtgcctgtagttcctgttacttgggaggctgaggtgggaggattgcttgagtccaggaagtggaggttgcagtgagctgagatcatgcccctgcactccagcctggtttt

SEQ ID NO: 232096 - DNA, 546 bp, Homo sapiens
aaaaacatagggtatggtactacctgtggtttcaggcatcctcctggagtcttggaatgtatcccccgtggaaaaggggggactatcgtaccatactgatgacttaatattcttaagagaattggtgactattgatagcacaaaagatcccttgtttttaattttttgagaatttgaaaatgtatttgaattaactgcctgtcgtagtgaataatggaaccatgaatgcatgcttcatgtgtatggaatagttgttgatagccagagctggaaatgccacccagtgtgaataacagtcacattcacacttccctgcccccttgtttaatgtttccctctttgtagttttcctggaattttttagtcaacctcatgaatgatgtataaagtgctgtgtgacctttcaagatattttaatattcatgtgaggtatgcaacctccatttgagtaaccagagagctatctctagtcatgtgatagaaacctgcccttgctgcttcctttccagactttgtcccactcctgctcctctcccacatcaccga

SEQ ID NO: 232097 - DNA, 318 bp, Homo sapiens
ttgggtcaaagaaaaaggtctcagtacattttaaaggataaagttatacaatggatgttccaagactgcaatagaattaaattagaaatgaataacagaaaaatccttagaaaatcccaaaatatttaggaactaaatatcgtacttctagataactcatggatcaaagaagatattagaaagtagtttgaggctggacatagtggctcatgcctgtcatcttagcactttgggagactgaggcaggcaaatcacttgagctcaggagttggagaccagcctggccaatgtggcaaaaccctgtctctactaaaaata

SEQ ID NO: 232098 - DNA, 807 bp, Homo sapiens
cagaagagtaggagaaaatctaagaaaatacagtattatgggagttaaaacaagtgtatcaagtagcgttttttttttttttttttttttgagacagggtcttgctctgttgcccaggctggaatgcagtggcacgatcacaactcactgcagcctcgaccttcctgggctcaggttattctccctcctcagcctcctgactagctgagactacaggtgtgggctacctcacctggctaatttttaaatttttttgtagagacatggtttcgccatgttgttcaggctggtcttcaacacctgggctcaagtgatccacttgccttggcctcccaaagtgctagagttttaggcatgagccaccacacctggccaagtggattttaaaggaaagaaatgagtggtcagagaagtaagggaaggcaaagacagaaatatccatttgagttagaaataagtgtgttgaggttgaccttgtagagagcagtttgagtagagcaatagggcagaagaagcaaagttgcagggcataggtggtgagtgaggagggtggaacaactctttcaagaagtttggtggtagaagaaagaagatatatatagcttaaggtaagtatagggtcaggttaagatgggagaggcttgctcacatttaaatgttggtgaactgaagccactacagagacagatgttgaaaatgtggtagagagataggataattgatagtagtggaaggatgtgagaagatttgtgttctacaacatgtggagggcttaggaggagggaactctcttctgttatgacagaa

SEQ ID NO: 232099 - DNA, 425 bp, Homo sapiens
ggattaatgtgtacttctttctaataggaattccaatgacagttgtcttgttggatttttttctacctacatgatcattttcctttttagagccaccatagttttatcctatttaaaatactttgtactttgaaccatggacacccacctcccaaaaattaaaccatttataacatgacccttgagcctgaagattgcatttcaaaatatagacaataaatagagtgatttttaaagcacctgtctaatcagcattaagcagtcaccagcacctccccataattgaaattccaaagagtgactctaaagcgtggacgtgttcagaatcaaagatggaacggtttttagggtaaatgttacatactgaaatcaagcaacatgtaaagtttttaatacatagatgatcgttatacagactaataatc

SEQ ID NO: 232100 - DNA, 207 bp, Homo sapiens
agaggcaaggtcttgctccgtcatgtaagctggagtgcagtggcacaatcatagcccactgaagccttgaactcccaagccatcctcctgcctcagcctcccgagtagatgggattacaggcatgagccaacatgaccagccctcattgctatacatttttgataattgtcctcttcctgacatatactttcctgtggcagaattta

SEQ ID NO: 232101 - DNA, 378 bp, Homo sapiens
cgatctcatgaccttatgatctgcccgccttggcctcccaaagtgctgggattacaagcgcctgggggcgatttctatgcctgcctcctgatgcagggcctgtgctctgagctgcgcctttcaggagagctctgcggggcttcatttcctttctaagctcatggcaagaaatgtagggtggaaaagacaggctctggaactccctggccacacaggagctctgccatttacacgctgtgcgacctcaattgagcaagtttcttaacctctctgggcttcaggaagggcttcatgtttgctttaaaggtagcccttcccaaggatcttttaaggggcacttgaattttcagtaaggagaaggaagcccaggactaagcc

SEQ ID NO: 232102 - DNA, 489 bp, Homo sapiens
tctccagcaagtgccactgacagaattcagacctactgcccatctctcttatttcagttttagaaatggctgtggctactcttcggcagtcagtggaggaagtgaaaaaaaacacggggtcacaggtacataatttttgtcccctggacctatttaaagagtagatgagaggctgggtgcagtggttcacacctataagtacgtgggaagatcgcttgagctgtagcttttagatgggcattcgaggctgcagtgagctgtgattgtgccactgcactccatcctgggtgacagactgagactctgtttcaaaacaaaagagtagattactgaatttggcctcccagagggcttagcagcactctctggaatccaagaggggccacaagagctaaattcagtacatttaaaggtgagaggatcatttgaggccaggagttcaagaccaggctggacaatatagtggaaccccatctctacaagaaattt

SEQ ID NO: 232103 - DNA, 375 bp, Homo sapiens
cttgaatttagttttaggaaaaaagttttttgcagatcaacttgtatttcctggaagaaaatttcctattttacctcagcttcctatttaatgtattatttatttatttacttaacatttatttgttttttatttcacctgaactgttagtaaacttagtaaaatttggtgcctacatgtggtaactgtcctgtcccttatactcagaaacgttttccacctttgtgtcctttaggtcattgttgtgttatattccatttattttattttgtccattgttctctcagaaattgagggtcatacattttaagaaaacaatgatatgctatttaagagaatgtatcataaattgatttgtaaggaaaagtatcccca

SEQ ID NO: 232104 - DNA, 296 bp, Homo sapiens
atgagcacacgctgggattcctcacagccttcatctcctccatggtgtggaggggacccaggatcctcatgtgttcccaaagcaggtatagagtggctgggcaccaagtcctggctgggagccagtggatgccaagagcccacttttgccaggatgggttgggaatcccactagatcttggggggatcaccatggtggacttgctcacacatgagagcccccaagagcaggacctcaggatcttctgcggggacatcaactggattcgcaaagagcccacccgtgctgggtggaca

SEQ ID NO: 232105 - DNA, 381 bp, Homo sapiens
gtgattgtttcctgccatgtggcgtctaacaggagtccacttgccaatctccgggaaatgtgagaagttgcaagcagacaggcatcatctcattccactggaagcctttttcaccaccagttggggagagcaccccgaggcctccatctgcgcagaacctctgataggtctgcaaatcaaaaacaatgggcagcatagcattgctgtgtaagatcacacaactcccggctttgctgtcataatttgctgggatgagcagaaacatgcaccttgaatttgagtagaatctggacccccaaacaatgccatttttgtccttaaaactttatctgtcatgaatacacgatttaatataagatcatagattggctcctgaaccag

SEQ ID NO: 232106 - DNA, 495 bp, Homo sapiens
accatctgtactagttgattctcacgctgctataaaggactacccgagactgggtaatgtataaaggaaagaggtttaattgactcagagttctgcatggctgggaggccccaggaaacttataatcatggcagaaggggaagcaaacacatccttcacatggtggcaggagagagaagtgcagagcgaagcggggaaaagccccttataaaaccatcagatctcgtgggaactcactcattatcaggagaacagcactgggggactgcccccgtgatctgatcacctcccacaaggttccaccccagcacctgggaatcacaacttggtttacaattcaagatgagattttgggtggggacacagccagaccatatcatcatttctaatttctgtgaaaatcgtaaaattaagagatatcctttagatttatttttactatctgaatttttacattcaaaaataaaggtcattggaaatcttatatgtgcctca

SEQ ID NO: 232107 - DNA, 505 bp, Homo sapiens
tctgattgagtctgtccctgtccctgggttgaggcattgggggtgacgactggatgatgtttctgtgatacgcgcggctctgagcgctcccacacgttgcagaggacacattgacgttcccggcttctccttcccgcgcctcgacacttcataattacctgacacaatgcgatatgggggtgtccattgttccactgcatgttactgtggagtgttcgttatgacagtggtggaacttaaaattacacaatttttttaagttcctaaaagaatgaattccgtgtggggatatgagtaagctttccattaaatctcagtttggcctgtcaaacgaggctcattctgggtattacatcgcctaatttgcattttagcattgttttgtttcttaaatgtcacattagagatacatgggcgtgtacgcaggagagctgagtacctccacgttgcctattttgcattttagcatcattttgtttttaataaacgccaacttaaaaacatc

SEQ ID NO: 232108 - DNA, 363 bp, Homo sapiens
gttttatggaccttgtagatcaggggtcagcaaactatatcttgcaggccagctgcctgtttttataaataaggatttattgcaacacagccatacccgttcatttacctttatctgtggtggttttcttgctagagtgacagagatgagtagttgagacagagattttaatggccttacaagccatgaaatcagtacttttctaggttttagtaaattcagagggctggagtgtttgaatgcctgctaggtggcaatatgtggttacacctccataaggggcagttgttagaacattgtacttaggtagactggctgtagctgttgtctttttgttttgttttaggttttcttagctgtggt

SEQ ID NO: 232109 - DNA, 626 bp, Homo sapiens
gttggccagggtggtcttgatctcttgaccttgtgatccacctgccttggcctcccaaagtgctgggattacaggcgtgagccaccacgcctggccaaaaacatgtatttttaagcccagtaaggataatgatcacattcttcaattgatatcttggttttaatttaatatgaaggatgtataagtaaactcttgttcctttatggtaaggcagtatatgaaagtattgatttgcatttttcactgccttacaaagtacaatttgtgccattaaaacattatctttcatcacaaaccctaggtgaagtatgctggggaagccttgctctgtgtttttgaaattgtaggtggcagcccattactgggtcatatggttcatggccagcatttgagaaacagaataaattaggaaatattatttagatgggaaacagaaacatggccagaagaatattaggaaatgagagtaaagtgatactgacagccttatggctctgaaactcaatatgaaatgagaagcaagtaggaacttttacattttgataggtgatgagcagaaagatatctcaagcaattaacacacatccaggtcaggttggctaacttttcccataaagggccagata

SEQ ID NO: 232110 - DNA, 587 bp, Homo sapiens
acattcaattaaaagagatactttataaattattcacggaaaaagataaacagaccacaagtaaacccaatctgcataaggggcccaatatctttgtttttactatacaacagtaaccacgacccaaatctagggtagaggagagctgctaatttctaccccaatgctcgaaatcttgtcaggttttgtgtcagggtagaacacatttatgctacaactaggttatcagagcaatacacacacaaaaaaacataatggtgggttgatttggactattttatttttgtccttccccaaaccatctggcgtgttagtgtaggggtattgatcagggatctgtgagctgcagaccccatgccaatccatagcgtttctggcaatcagcgtcgcccatgaattgcagctgtctgtgcagctcctcaacagaaatcttcaaaaaaaaaaaaaaatttccctcccttatcaaacacatcatccgttcgggggtaagtcaatatcatttctttgtcattctgagggcgaggattatgcggtagaaagtttttgttatctgttatagctgctgctgcgcctgccttttttttaaa

SEQ ID NO: 232111 - DNA, 436 bp, Homo sapiens
catggacccaacactcctttggccaagttgatgattctccaccatttatttgcctgcctcactatacacttctagcaagccactgcaaggctgcattgcagctaagaggaagccctccttgaaggctgcacagcaaggagtgttggcagagtagctgggtttccactgggagagcacgagtcagcatcatgctgggctcaagcatggatatgcactgctgctgccagagcatcataatttgcaagcatttatcgagtacccttcatctaattttcatcctgcggaaactagaaattgctacacttgcacacaataaacttctggcagttagccttctaaactgggacactaccatttgggagggaaaagacctttctggtggttaaagatggggcttccagttactgcatttgttttaatacagtctattccatag

SEQ ID NO: 232112 - DNA, 227 bp, Homo sapiens
ctattcttagcagaaaaaaaaaaatcccagacaatattgtctatatttctcaaaaaagcccttgcgttttgaatggatattattatgtcacaccttaaattaacagggaaccatttcaaatccccatttgaagttttactttacatcaaattctcactagactgaaagatccccgagagtggggagacattgtttgcttctgtttatagaggctcagtacagtccct

SEQ ID NO: 232113 - DNA, 439 bp, Homo sapiens
agccaaaatgctgaattcctcgttgttctttatttgagatatgtggccttgttctgagtattcagccaaaataaaacttacttaagcaagtgtcagtcagaagtttagttatgataagttgtatttatttttgtccaaacatttcagaaagtttcctctgaaaggtagttatggagaaatagtatttgggaaaaaaccttacaatctatgtgttctctattttgtctttaattttgaacaaaaaaggtatgtaaagcaggtgatgaaaagtttgagatcaagaccaaatatatgtgttccagaaaaatccagttaaagatgttgaaagacacatattggacattcgtagattccattcgcaagaaatgtattttcataatatacaacatttatggcgaggtgttattcagatactatagattatttttttaaattttcc

SEQ ID NO: 232114 - DNA, 431 bp, Homo sapiens
ggaattacctgaattatatgggatgaagttatgctgtgcctgaattttcagtcagttttcctaatgtttaaaataaactttacaatctgatttttaaactatgttctatgtataaatacattgaaaaatttgaggggggataagaagtaagttgtgtttttatgaacttgtgaaaatgcataaaaattgtctctcttttttttttcatctcttgaatgtgggtgaatgttcctgcaaacaaatcttgggtgaacatgtagattcctttggtatgctcatttcctttagaatgcaatgtgatagactatttaaatcatacaaacagaaaaaatatataattgaaaatgtatacttttgggaataaattaattttttgtgtgtcctcttttttgtagtatctactttgttcaattatttaccagtagagaata

SEQ ID NO: 232115 - DNA, 181 bp, Homo sapiens
gttcagaatacaaaatcattcaattatggaatatccaaagaggtatttttaatatgtaatctcccttcaaggccctgacacaaaatgaaagggagtttactaaaattctatttgagtccttttaagcaacaggggcaacataatgtcctctgtgttgcatcagttcactctgcatttctgg

SEQ ID NO: 232116 - DNA, 350 bp, Homo sapiens
ccatgtccctagtctctggcttgcggctgatttttaaattttttgtagaggccggatcttgctctgttgcccaggctggtctcgaacttgtggcctcaagcgatcctccctcctgggtctcccgaagtgcggggattacagacagagccactgcgcacggccgtggtcagctttgaaagctgggtagatccctttggcttatacgcctttctgctagcttaccctgattctgcttctggttcagatagtattttaatatttctagtgtgtctttttgtaagatacctgaaatctttttgtggaatgaagtggcatgaaaaataaaccaataatcattagtaagtatgttt

SEQ ID NO: 232117 - DNA, 348 bp, Homo sapiens
ctagttctagatcgcgagcggcgcccttttttttttttgggagtaaagatggggtttcaccgtgttagacaggctggtctcgaacttgtggcctcaagcgatcctccctcctgggtctcccgaagtgcggggattacagacagagccactgcgcacggccgtggtcagctttgaaagctgggtagatccctttggcttatacgcctttctgctagcttaccctgattctgcttctggttcagatagtattttaatatttctagtgtgtctttttgtaagatacctgaaatctttttgtggaatgaagtggcatgaaaaataaaccaataatcattagtaagtatgttt

SEQ ID NO: 232118 - DNA, 216 bp, Homo sapiens
gagattgacactggcaatgctttattcagcagaagtacccagtggggctcctctttgtttttgcagtcgatgagtgtcagagtttggatttaagtcatcctgattgcaaagcccatatggtttgcacagaatgatgctcctgctgggtttgcctctcacgtggagcctatgtggatttgtacatgaactccaatcttaagtataacataaggacat

SEQ ID NO: 232119 - DNA, 369 bp, Homo sapiens
ctgtgctaatgtttcatgattcttttttagttcagaaaatagagtcactgggattctcagaaatactacctaaatataaatccatagagacagaaagcagattggtggttgtcaggggttggggagggaggactggggagtagtagcttaatgggtttggggttttctttctgggtgatgaaaatattttgcaactagacagaggtggtagttgtattatacaacatcgtgaaggtaataaatgccactgaattgttcactctaaaatggttcattttcttctatatgaattccaccacaaaacaaagatatgtcacctatataatactgaatagtttccaaaggtcctgagggacaaggcagcgttat

SEQ ID NO: 232120 - DNA, 451 bp, Homo sapiens
ggctgaattgcccccaggacttgcacctgatttttgtataacctgggaatgggccaggtgctgtggctcacacctgtaatcccaacgctttgggaggacaaagtgggaggatcgctcgagcccaggagttcaagaccggcctgggcaacatagagaagacttgtctctaaaaataaaaacgtggggatgactgggacccatcctgattaactcctctgagtgagaccctgcaggtcagagtctccatgatagtgtgaggctcagagctcgcgagccctgcatgtctgtcctccactgtgggtcctattaagtatcagtaatagtaattataaggccaggcacagtagttcatgcctgtaaacccagcactttgggaggccaaagtgggaggattgcttgagctcaggagttcaagaccagcctgaggaacatagagagaccccatctctac

SEQ ID NO: 232121 - DNA, 374 bp, Homo sapiens
gcgcatgctcacttgaggcattcttcctttaccagtcaaatgctcccaggtcatatgccagttaaactccaccatgttgcctcttagtgcacatgcttgagcccactcgcccagctcctgagatcttatcgggaagctgctgatcaccagttccaggtgctttctatctattgggaaacggcctttccctggtgttggttgcaaccaattattattttaagtgagaccccatctctaaaaaaaaaaaaaaaaaaaaaaaaaattagctgggatcagaggtgtgcaccaccatgcctggcactgtggatatttctaagtgattattcttctcaaatgaactacataaaaaacaaaagattcatgaatttactaat

SEQ ID NO: 232122 - DNA, 449 bp, Homo sapiens
atttacatgtaattggagcaccagaagtagacaaagaatgcctaaagagataatggctaagaattctctaaaaactgattcatacccatagatgcatgaatctcagccaatcacaagcaatatgaacataagcaaactaaaataggcacattatagcagctaaaggaataaaagatatattacaaatagtggagaaatacaatgataagaacgatggctgacttctcatcagaaccctgggaggctggaagatgatggggtgacatctttaatgtgcatgaagaaaaaagctatcaaccccagaattttatattaagacaaaccagacatttttatggaaaaaagcaggcagaattaatctggagaattcactacaagaaatattaaaagttcttcagactgaaaatatatgattttagatggaagcacaccctgactacttgggtgtg

SEQ ID NO: 232123 - DNA, 505 bp, Homo sapiens
gtttattcagaatgtcacacagcattatttattaatatttgaaaggtctacccctgagtaaggagggtggatatatatttttttaagtggaagaaaccaaacttcaactcctatagctctctgtgcttgaatcttgtaacaggctgctcttataagcagtgccccagatccttctaatgggggaacctcacctgcccttgtcaggaaagaagggggaagggcccaggaaccttccagtctgagaggctggtattctggttctttcatcatgtgacttatactagtgatccctatcttcttgggggcaagtggggaagccattctcctcttgaagccggttatcagagaactatgaactcatagcgaggtgacaggattttaggatgtgcatttgtcaattccaagttattgtccaggcgtgtgtgtgtgtgtagtatgaataatatattgcatcttgtaatacagtattacattttatattaaattgcattttctaataaataaa

SEQ ID NO: 232124 - DNA, 938 bp, Homo sapiens
gtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggataccgaaaacatatggtgacacatcttccgaacaacttccatccaataccgtcgaagctcttcacaaatcgcttgcctcccagttccactgatacctgctgctccctgaactccgatgcgaaccatgctccctcactgacacgtcgaacccttcatgctacatctcgactgtccgacaccttgccaactcaaacatacgtaccacgaccacccccccccacccacacaccccacccaccgcccccccccacccaccacacagccaccaaaccccccgccgcccaccgcgccccaccgcccccaccaccggcacacaccccccccaacccaaccagcccccaccccccccccacccccccacccccaccgcccgcccccccacaccccccacaccacccccaccccaccaccacaccccggccacaccacccgccaaccacctccatctaataccaccaactctagacccccacacccaccacaccacccacccccaaccacacaccaaacccaccccacacaccccccacccccactccacccacaacacctacacccccacaccacaacccacacacacacacaccaccacaaccacccaaacccacaacccacacaacaccacccaccgcacacccactcacacaaccaccc

SEQ ID NO: 232125 - DNA, 476 bp, Homo sapiens
  misc_feature (311)..(311): n is a, c, g, or t
  misc_feature (424)..(424): n is a, c, g, or t
  misc_feature (451)..(451): n is a, c, g, or t
gtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggttgcatccccagcttctatatatttacnggcctttttttttggctgggaatattatccttgttaaaactttaaaaactaacctgttttgctttgaagggaaccgtgaaatttttgggaatattttgaaatttccttcccanaaggaatttccctgaaaaaaaaataanaaaaccttttgttgaaattttttaa

SEQ ID NO: 232126 - DNA, 581 bp, Homo sapiens
cgtctcccattccaggcttcctcttcaagactgtgtggtggtgtggcttcatttcgcagagaagggcgtgaaaggtaaaaccatcttcttggacgtgggtctgctcctctctgccggacaatgtgctaccgtggggcttttgtcctgggctgcagtgtggtcctctcgatcctagaaaagaggccgctcaggatggggatgagacttccattgctccgggcccgatgcatcccctcacgttatcgaggcctgcacagacccaaagtggaaccgccgcgaagacgatggacagctggccgcaggacccagggagagacgcagaaagaggctcaccaaagaccggtccacataaaagacatccctttttgacgcacagggcacattcgtccaaagacacacacacacacacacacacacacacagagggaaagaagcacacagagggtgagagacagagagagaagggagaatgggagacacagccccacacacagtcctaccgcggtggccgagaaatacacgcccccaggcaaccctgcggctgccgggttctgctctggaggggaacaaccctcggctga

SEQ ID NO: 232127 - DNA, 421 bp, Homo sapiens
attgttgttgttgtcaatatcaatccattaaccccactgcaaccaatatctgctatttctataagcatagtagaaaatcaattaaaatgtgttagataaatgaaaaaatgcatctctgagatctgtatagcttttctgcagaagcctgaagttataaagttatagaagatgaattcagaatcaatgaaaaatatggatctggatacttatcattctatttcaggatgtttctgtctgtagcatttgttaccactatcctaatgcaactgttatttttctattactgccaatgacattctgtttctataatcactaaaaccatcgtcctggtgctgcttctctactgatagtgggaacactttgctgagctgctgcggggatgtagattgagaaatggtccctctccttatcattcctaggg

SEQ ID NO: 232128 - DNA, 441 bp, Homo sapiens
gatatcagcagtatccccagatttcccattgtggcccctttcttttccctagcctgaaaagatcaaggtattatgataaataatagctgtgagaggcctcagggatgatggagacgtttatttacatttgagatctcagagatagacaaagatatatagaaaaatagaagtggagaaaggagccacagggagaaacagaaattcagatacacaaagacagagggacatggtggctcacgactagaagagagccacctagacacaaggacatgtgcagacacaagtcttccaatcctgtgtctcgatgtccctctggatctagagacagaaaagagaggaagacagaggaacccacatcgagatacccacattcatagggagacagagacagagagatgcacggagaggataagagatgcattgggagatcgagagaaatgc

SEQ ID NO: 232129 - DNA, 189 bp, Homo sapiens
tgaattgaaatctgagattgaacagtgcttggtgaggttctattgtaatgaaccttgaaattttttgatatttagacatttacacagagagagtgagttcctagttcctttctaccttggtttgatggtttttggctcaggtgggcagccaggggaggagataagaccctggggttcacatgagcaaat

SEQ ID NO: 232130 - DNA, 512 bp, Homo sapiens
ctctttacactgggtgtcgcgccgtctgagttcctgacttgtttacccatcccgttggggctccggccgctgcaggctacctgctgtgcccgggattggggacctgtgactcccgagtggaagagatggtggcccaggaggaggaccccgacctattcagactgggagctggggtcagagtgtctccgtctccggagggggaccttccagaccccgggcgggaggggcccacagcagggtgccccggcggccccaggagggggtccgggcctcgggcgaaggctgcggcgccccggaaggagccgcgcacgcccctgcacgcggtgcccgctgcggaggccacggatccggaggtgagagcgcccccgccccgctccctgcccagcccgcgcgcggcccggtccggggctgggggcgggcgccaagaggggcgccgggcgcagtggggcggccccctcccttttccgcagcgcgggccccgctcctcctcccgcgtccaggcccgcggccgc

SEQ ID NO: 232131 - DNA, 389 bp, Homo sapiens
ctatatcagaacactctggagctgaaccatacttcagattagactttatcttcattcagcatcaggatctgtagggggagatggctttcctagtggccaaaggggtctgctgccctgagatcagagaccctgtgccctgagtctcctgccaccttaatttccattcacagctgaaggccaggccagtaccacctttgctgaagctcaagacctatgtatgttctcttgattgtgtgttgtctctctgtaaaaagaagatatgactcatctctttgaaaaccaatttatgctttctctttggggagagggattgatattaaaagtgaaactaggattttcattggacaaataatttaataaagttatatttttaactttagttagattct

SEQ ID NO: 232132 - DNA, 268 bp, Homo sapiens
gatgcttcctttctctaggactcaattttcttatctgtaaagtaaagggttcatcaacattctttggttgaatcttacctgaaacattttgtgagccttcaccaatctcatctaagcctttgtttccatagaacaaagccctttaagaaaggaggggaaagtgtcatggagtcttactgtcctgagtgcaaatatggtctctgtattgtccttatctgttcattttctgcctctcagtactagaatgaaaactctggaagaagaagga

SEQ ID NO: 232133 - DNA, 385 bp, Homo sapiens
agagtcttactctgtcacccaggctggagtgcaatggtgcgatctcggctcactgcagcctccacctcctgggttcaagcaattctcctgcctcagcctcctgagtagctgggactacaggtgcctgccaccatgcctggttaattttttgtatttttggtagagacgggatttcaccatgctggccaggctggtcctgaactcctgacctcaggtgatctacccgccttggcctcccaaagtgctgggattacaggtgtaaaccacctcactaggccactaatttccattttaaaataaatagccttgagctgattctttttaaaatgtaaaatattgcctgtaacctttttgtttttgttttttgtgttttttttttgagacg

SEQ ID NO: 232134 - DNA, 555 bp, Homo sapiens
gctcccttagcactgtgcaggcttcccggatggcactttacattgtagttgactgctaacaagtcagttccctctctgctcgagggcaaatgtgtatctcttgtctcttggactcccagctcctgactggggcctggcacagtgtggggccagacttgggttagggagtgagtcagggaagattccctggaggaagtgagccccgagctgctgacttaaagaaaaagcaccctttccctcttcttacttccttcctggtcctcgtgctgaaggaaaacagtcaaaactttttttttccttttctgtttttcctttgagataggatcttgctgtgtcatccagactggagtgcagtggcacgatcatagctcactgcagcctcgaagattttttgtggagatggggtctcactgtgttgctcaggctggtctcaaactcctgggctcaagagatccttctgcctcagcactttgggaggccgaggcaggcggatcacttgagcaccattgcactccagcctgggcaacaggagtgaatctccgtctcaaaaaaaaa

SEQ ID NO: 232135 - DNA, 417 bp, Homo sapiens
gctcccttagcactgtgcaggcttcccggatggcactttacattgtagttgactgctaacaagtcagttccctctctgctcgagggcaaatgtgtatctcttgtctcttggactcccagctcctgactggggcctggcacagtgtggggccagacttgggttagggagtgagtcagggaagattccctggaggaagtgagccccgagctgctgacttaaagaaaaagcaccctttccctcttcttacttccttcctggtcctcgtgctgaaggaaaacagtcaaaactttttttttccttttctgtttttcctttgagataggatcttgctgtgtcatccagactggagtgcagtgagctatgattgcacactgtactctagcctgggagacagagtgagacactgtctctaaaaaa

SEQ ID NO: 232136 - DNA, 625 bp, Homo sapiens
tatatcactttttaaataaagtataagtatttcaatgatacattcaaaatttccaataccctatttttagtgatatttgtagttttcaggatagttattatgcatagaggctcctgttttgttaattttgttgtcatgttctcattttttatcaaaaaaatgtatagtaaatttatgtacctaccatacagtcctttgttacaaatcagttactgtgttttgtgtaacttatgtagtatttaaacatatgtcataaagggccaatgttcatttttaatgtacgagattttttgtaaaaaattttacttgggaaaaactgatgtgagtttttaagattgaataatgggtgacatgatgtagggggaaaatgacattatttcatgttaaataaggtggattcttccaccgtaaactcttttacgtctataaatttattatgttcataattattgtttctgcctttgcctttttataattagcgtcttaatttgtgacgtaattttactatcacagactatggcttcaaaagaaatgtattattcttcagtaattcacagaatatttaatttacagaatactcatgttcattgtaataaatttgaaatgtagctcaaagtcttattaa

SEQ ID NO: 232137 - DNA, 797 bp, Homo sapiens
ttaattgattctaaaatgtacattatttctcatttttaaaaaaaaatctctaaaatcagggtacatcttaaaagcaatataatgccatggtttaattggcacatgatttagtgatacataaaataaaggcacctcttgcagtggcatcttcgatttgaagaagtataatattctacgaatatacaaatttctgtgtttttttgtccccccaacccctgcccttttaaagacatatagtaatatagtggggttataggtttatatactgctacttagctgtgcagagaaattacagcatttaaaaaaatcaccaatctgtcttcctcataagtcatcatctagaaatggggagaagcaaagagtggtattttggccagttaataaggtcttatattcttttggcttaaacagtatcttttgggtaaattctggattttttcatatatcctgccatcccccattaaaaaccagcatctggtcttgggggattgtgagatttttgtggaggtgagggaggccctggcctatgcttgctgcctttgctcatctagtctggtctggtctggtccctgggcctttcgcaggtatcccctgaagtgtggttggtggtcttgaatttttttcttttgtctccatcagggccaggaactgtccttgctttcctttgggtacattcaccctgcagcagatgtcatggcttccaagtggaacttcactctctttctactagtgagctacaggaggcttagagtgctaaaaccgagatgcttcccctgcataaggccatgcaacacggc

SEQ ID NO: 232138 - DNA, 491 bp, Homo sapiens
tcattttaaaattcttagctgagaagattttctcaaactttatgttctgctgtgtgtgttgggggtggtggttagtagctatagtaaataggtttttccagtggcatcctcctacccccagttgctgatctagaacaagtgtttctgtaagcatatttgtagaacactaatcccgcaagattttacacaaaaaaatggtcctgccaccagtcctgtataccactggcttgtaaagcacatcagcaaactaaaggacccaggtcatttggaacctctgaagtgctagtgtgtgcagctcccagacttccttgaccgcggagccgtttaccttaatacctgttaaccatggaccacacttgggcaaacagtggcatagagtctggaattgcttccatgatgactttgctgtgctctgttcctacttgttttgtgcccttatttatatcatgtcactactagaagaaaaagttcagtaagaacaagtatttctc

SEQ ID NO: 232139 - DNA, 437 bp, Homo sapiens
aagggacttcagattggtgatgtcatccagaggagactagaaaccaacagaatcctccgaaaacgctgtgcccacaatctttgccctctttacaaagtaacacagatactccttgccacccagagccgggtggtgataaaatgaagctctctttgtaaagtgtcgagcccatagtgggtgctccataaatgttcatttcccctccctgaagcatggctctgcactccgagctggaaagaaagacaaacgcaccccaattcagtgcgaatccaggcatgcacgccccaagtgaggcagccctcgctcacatccatttgcatttccttctgcgagtgctccaattttaaaagcttaatatttatttagatatttattttcactgtaaatacaacacatgtttacagagatatttatttttctctataaacacagtaaat

SEQ ID NO: 232140 - DNA, 485 bp, Homo sapiens
tttttaaacttgagtaaattttctttttagaattcgtaacaaaaaaatgtgagaatatggttttgttatgtattttatgaaacttcattgaacccctttaccttatataactgttacgtcattctaacttccttttatctttatcggtttgaaagcaagattttacagttaaattagtatgtttatgttatagtgtattcttttggcatttggtgttatttcctatatatttcccaggttttgatgtattccatacgtttttatcactaatgaccacgtatcattgtttgcattactatagtgaagtttttcctcactgttaggtattaaattacttacaattttttgttactaccaatgatgcagttgtctttatgcaataacgtgtgtgtgtgtgtgtgtgtgtgcatgtgcctgcgcacttctttggttacaagggtatgatgaattatgacttttgtggtttgttgtcagattgatctcca

SEQ ID NO: 232141 - DNA, 243 bp, Homo sapiens
cccgcctctgcatcgccgccggccccttcacgcctctaccttgggcgggtttggggtaagggccgcgcagaccctaagggaaggcccgaggtcgccggagctcctcctctcgcggctgagtgagggtctgggaggccagatgaagggagctgctcggctgagctgcggaccagcgcgagagcagcgggcagtggcggaccagcgccagggcagggcaggggtggacagagggctctccccacc

SEQ ID NO: 232142 - DNA, 200 bp, Homo sapiens
cccatttccaaagccacttccacacttattgttatttttacagttggcatcccactctcagtatcaaaatctgtattagattgctaaggctatcataacaaaaaacaaaataccatttcctggggggtttgaataacagagatttattttctaagagttctggaggcaaggagtctgagatcacagtgttagcagagttt

SEQ ID NO: 232143 - DNA, 310 bp, Homo sapiens
ggtaggaatgattgatgagaggggattttgatttgttgagcacttaggtaagttttagtatacacatttggggacagaagccagggcagaaataaactgctcagcataaaatgggaaagaggtgacaaggaggctaattctgggaagagaggagccacctccttgctggtatggacaatttgtaggtattgggcgttgagcatcacacacaatcccctttctctggctttgtaattgcctgatgtgttcttcctgtctgctgcacaaacaaagaccacagcatagcaataaagaaagagtttaggctggg

SEQ ID NO: 232144 - DNA, 474 bp, Homo sapiens
acatgtttgctgagttggcctgaatttcttgccccatatctgggctgaagggatagcaagggcagtggggctggctccacgccctggagagatcctcccaccagcctcccccgtcctctctctctctgccagattctcggggatgctcagcctttgagggcttgagacaaatgcatctcctggaatgttcctgccctcccttatcagagcaagggctgggccattgacagttctgtggtccacaggccaaagtgtcctagaaggtcacaggctttatcttgtttatgtctgtgacttttcctgaggctcctctcttcttgacagtgtcacggagcaggactgctgcctgggacgtgtctggaaagtggcccactccttcagggccagggaagagaaccaagtcattgatgctggtggggcattccaggacaatctgtggaagaacatggtttcttctttaaccgcctgtgatga

SEQ ID NO: 232145 - DNA, 406 bp, Homo sapiens
ttctcatatttctgtaggttctgccacaggcacgatttcttccacagtgttattctctgattacatctcacgtccagaagaccacaccagcatcctccactttgacaagaatgagacacagaagacctgccaggtcctgatcattgatgactccctttatgaagaggaggaatccttcagcgtttcacttaggctgccagtgggaggacagctgggagccagattccccaccactaaggtgactattctggctgatcgttatgatgatggagctgaggaattttattctattttgctggactccaggaaatgtttgcttccttaagcagagattgaatatccccctgtcaaatggatcacctgaagaaatacttttataaggacaactatcatggagtaagacaaa

SEQ ID NO: 232146 - DNA, 382 bp, Homo sapiens
tttggccaggcccaagccgattaatttaggtcaccgcacaggtttttgctaatcccgcccatgttaagccgcattcagttcatggtaatccctctcgctataggtcgttttttggtttcttggtttttccttgagtttttttttttttttttttttttttttttttttttttttttcggggctaagggatgtgaggtttccatttggggtgatgaaacagttctggaactagattggggtgatggtcgcacaacactgtgactactgagttatatactttaacactgttaaggtggccaggcacagtggtatgttcctgtcgtcccagctactaaggaggctaaggtgggaggatcacttgggcccaggaggcagaggttgc

SEQ ID NO: 232147 - DNA, 476 bp, Homo sapiens
agtctctagtagctcagagttaaagggtattcccagcaagtttaagagatgaggaagggccctgaatgtgagccagagctactaaagtaggatgtgccacaggccacctctctttctgctctggttcctgtgaaacatagtgcttgttccagtaacgtcacctctaggaatgtatcctcaggaaataatcgttcacatgtgcaaacctgtatgtgaataaggatgcttttctcagtgggtttataacagtgaaacaaggaaacaaggtaatgaatggctctaaagaggctggtttaataaatcatggatacaagtaaataattggatttaatgcagttatgaaaaataatctaaacaccttggacctcagttgcctggtttttaaatgaagaaagccaaagaagaattgtattcctcaactagttttaggaggccagcaaacctttgataccaaaatctcacaaagacattataca

SEQ ID NO: 232148 - DNA, 874 bp, Homo sapiens
agagaaaaggcatttgtgcctggtcagtgagcatcatggaatccaatcaagtgccttctttcattaaaccaaaacagcaggtaggttgtgtgcatttttaagaccttttagaaagtatgcttttatagattaggaatttcagagagaaaagattggacagcttccctaaaaactttgagctatctcattgcaagatttgccctaccaatccgtgcacgaaccctggcccccttcctgatagcaggaggcccaccggtggaagcaagcagctttttaaacgccttcgctgcactcctgcaatgtgcagagacctctggaccaaagaccagagcctactcagcagactcttggttgatgtggacaagctgcctgtgtttcacacggtcgacggtggggaggccaccagggaaaatggaatgtgcagggcttttaaatgtcacgtctggactgtgttggcaggcccatgcagcgctccacaataaacctgtcacaaatgcattgagtcactgggtcctttatttctcatcacggcattctgtggccttgtgttctcttgccagcaaagaatggaacgttcagccccctagacatgccggctgctggattttttaagcaatcatccagcttagataaggggcgtgggctgctggggaatgctgccccaaagcgctgtctccagagcagctgccccaggcatgcttaattccctccctgcccactgtgtgcacccccaagatgcctctcaatatccagacctgcagttccactctgtttgttaggccccccaggagagcgagcctgcagtccgccccagcagaggggaccaggccagggatgcctctttcctctctggagtgttaccttggagtcctga

SEQ ID NO: 232149 - DNA, 342 bp, Homo sapiens
cagttttgcctaaagctctctctttaagagtcagtaaagcatagtggttaggagtgcagtctctggaagcagactgcctcggttcaaatcttggctctgctgctaggatttaacagggtaataaatgtcattcacttagaacacagtctggctaacaataggccctcaataaacattagccattatcatgctgaacatttttcaattacatccatcaataaatttttttggcttaagccatttcgactgatatagatatgtacttttcaactagacatacatcttttgaccaacttgaaaattttattaaaaacaaaataaaatcattttctgttctcagta

SEQ ID NO: 232150 - DNA, 365 bp, Homo sapiens
cggtgagacaattctcacgctaaaatacgtaatgtttcaaggcagaaatccttgttataattctaaactatgtgcaaccaacgaaattaccttcaagatgcctactggactcagcacactaagccaggccaccctgcttcaggctatttccctcatataagcagaatataacgagctacagttcattagctttaaacatttggcctaagggattcataggtgaagcctttaaaaacaagaaaatcatacactgttgaattaaactcccatttaaatgctgaaagttgggaagtaggtatttctagattgccggtgtgattatattatagcattgacatattaagaaacagtaccttctggatata

SEQ ID NO: 232151 - DNA, 453 bp, Homo sapiens
actaagcgccaaaaaaggaagcctctttgcttcagcaatatgcaaattaatttggagcatgcaaatagttgcagcatgcaagtagtttagaattagactttcattaaaactaagtgccacacagagaagaggtgtaaaacagagtagtaatctgttgcgtgcacttgaagggttcttgaaagacgtgcataaaccgttaccgttgtagcacaagttgagcagcaaaagccaaagtcgcacatctgtgtcttgtcgccacctctccacttatccactcatgctggcttttctcccagcagctctttgccctcctccttttaacactgtgggctgaggtgaggatgttctagtcaagagtctttacgagccttatatcgccaggctttcagaaaatgtgaagcatggtagtgtgaatttagaaaaaataaaagtgtgtataaaagctcatctgtt

SEQ ID NO: 232152 - DNA, 669 bp, Homo sapiens
cacagtttgatgtgaaagcttagatctaaacaatgagaaagaaaccacaacctggacagcaaggagcatagcattcctcacattggaacagcatgtgcaaaggctctcccagcaaagggggaagtggaaaggatagcagtttaaaacaacattcatttattttttatttttattttttttaaaagacaaggtctctgttgcccatgctggagttcagtggtgcagtcatagctcgctgcaacctcaaattcctagtcttaatcagtcgtcctacttcagccttcctaagtaccgggaatacaggcatgagccatcgcccctagtccatagcactcatttattatctctttaagttctgtagattagaggtccaagcaggctccgctgggtattctgctgaggacctcaggaggtcagaattaagcatcggccagcctgggtttttatttggaggtgatagggagagtctccttccagactcactcatgttggcagaattcattttcatgtggtgaaggtctgaggtcctcatttctttgctggctgtcagccagaagtcattctcagcttctagaagccactcaaatttcttggcttttagtctcctccagcttcaaaaccataaatagtgctttgactctaacttcacattgtgtctcttctgttttt

SEQ ID NO: 232153 - DNA, 354 bp, Homo sapiens
cgaaattagccacactttaaaagtaaaaagaaataggtgaaaataattttaatatgctttaacacaatatatctcaaatataatttcaacatgcaatcaatattttaaacatttagtgagatattttacattttttcacactaagccttggaatctagtgtgtattttgcacttacagcatttctcaattcagccactaaattttcatcaaaaatgctcaataagtatttagatttcaaaaagtttacagttgaaaaggtagagtcacatacccaagttgctccaattatacctacaaatttttaaataactaagttgagtatcaatttttaaatttacattaattaaatggca

SEQ ID NO: 232154 - DNA, 471 bp, Homo sapiens
caccctctctccccagttgcaggaggaagtcgctctgcttcctctgttctcaccgccagcccgagcttgggcgcccggggctttctgggtggggttcttttttgtgtacacagtgtgtgtatgtgtgcgcgcgagagtgtgtgtgccaaacgctcatcgcatccttccgcctaggcggcctcaggtgctcgcgggaggggatcaggatctcgtcgtgcccttgtccccggctctttgtgccgagtccagagcagcgcgaggtcagctctttagctcacacccccggccccgaccctgggtgggagcctccgcctccgcctcctccgcagccgtccgagcccggcttttgcccgtctgcttccatcccggcgcacgcctccgccgtgccgggcggccggagagctgtcagccggcgcctgggactcggaccccggccggcggctgccggtgcgaaaacttactggagcggag

SEQ ID NO: 232155 - DNA, 310 bp, Homo sapiens
agaagaaaagaacaaaaaatagataattttacaaagattaatacatttaaggtatggaagaactattaatcagagatagaaaggaactgttgattgttagttctgtttcactcctgtgttacgtgagccagattgtaaagtctttgacattagggaacatgtctgatacttggcatccactgtgatgctggcatataaacaaacacgtgtctactgatatgcaagcttgctacattaaaatgtgttctgtgcacatgtaccctagaacttaaagtataattaaaataaaataaaataaataatatgtgtt

SEQ ID NO: 232156 - DNA, 549 bp, Homo sapiens
acatcagaaatcaaatagaaactccctcattctaagattcatagccatcctccgagatatgacatagcgacctctcctccgtgaacagggaaacagactgagaggataacctaactctcccaaggccagagtatccactgggatatgcagccaagtcagccagcagttgaaacaagggctctctgtgctatctcacatctgaattgaattgtttcctacagacttctcatagctctctaggcaaggaatacatcttctcaccttcccacactaagaaaggcctctgtctgagcctgggtgccgggtggccaggattcctgctgaacgttcaggagctttccatctccagaggtgagctcctagttcctgcttaccttagaactgtagaacatataatgttaccactgaaaagaacctctcgtatagttggatcacaccctttacctatttatttaaatgtactgttttaattatgtaacatttgatatgtgcaggataatatgtatgcaaattataaagcataataataaaacctgtgaacccaccact

SEQ ID NO: 232157 - DNA, 474 bp, Homo sapiens
agcacgctgggcacagtcgcagccccgcctcttccttctccgtcttgttccctccttcggtcccaggagaaagacgctcatctccccacatgagaggctcagtgtaggcgtctggacaggggccagtcccacaaggctactgactccggaccacaaagaagctggaagcagcagctccgcctctgcagccaattgcagagcttttttctctgtgttctgcccccacttccaactcaggaccaaccagaggacgccaaacacgtcctatcaccaaccaccggacacctgactctccatcagccgcccctgccttccccacagcatccccaccaccctaagcggagggacctgtgccccgccccctgcctgctgatctcagggtggggcgctcccaagctccgaactcagagcctgggcttgctgtcgtctgggtggtctttctttatctccacatgcatctgcttatgcagtaca

SEQ ID NO: 232158 - DNA, 536 bp, Homo sapiens
gaagaatgaaaggcaagactgttaatggaaagggattccaatccagaccccaagagagggttcttggatctcgtgcaagaaagaattcaaggtgaatccataaaatgagggcaagtttattagcaaagtaaaagaataaaagaatggttactccataggcagagcagcgcttgggctgctggattaaggatacccgtatcttgagccgacctcttatctcatcctgtgacttagaatgcctagcttcccgggaatgcagcccagtaggtctcagccttattttacccagcccctattcaagatggagccactctggttcaaacatctctgatgagaccaaatctggtccatttgattcagagcatcaagtacaagattaaacataagaaagggcctctcctctcggaaagtcagcctgttggggaggctgccttaactaacaggtggaagggccctgaaggccggtcagggaccattccgggtgggctggaacatcagaatcctgagggtgtcatccagcaagtctagattcttgt

SEQ ID NO: 232159 - DNA, 139 bp, Homo sapiens
ccttctcccgctctggccgcgctcctccccggacctccggaggttctcctcggcccctccccgggctccccaagagttctcccgcctccccctgggaccccgcccctggcccgcttctcctcagccggccctgcggccg

SEQ ID NO: 232160 - DNA, 319 bp, Homo sapiens
ttccaggagccacaagagcccttcaatccacccagggacccccgatgtgggcccaccagccatccttagctttcctcctctccagaggcaacagggaataggaaaaagtccagagcaaggccacaccatgatcttaacgcaaatggaaatgtgaggaaaacgatcaatttgcttcctgaaaatgacattttttttttctggtttctatgagactcgaggtggccttgctgaaactgaaatcggtatgagctttccctggcagacaatggccattgtcacatattaaattctcatgaaagggataactttgtgggcaaga

SEQ ID NO: 232161 - DNA, 416 bp, Homo sapiens
catgtaccaccctgtgaacatggacaagttacataagctctcttcacttcagttttctcatctgtaaaatggggatcccagccctacctcatgtggttgttgtggagatgagataagaaaatgtatgtaaggccgggcgcagtggctcatgcctgtaatcccagcactttgggaggctgaggcgggcggatcacctgaggtcgggagtttgagaccagcctgaccaacatggagaaaccccatctctactaaaaatacaaaattagctgggcatggtggcacatgcctgtaatcccagcttctagggaggctgaggcaggagaatcgcttgaacctgggaggtggaggttgcggtgagccaagatggcgccattgcactccagcctgggcaacaagagtgaaactcctgtctcaaa

SEQ ID NO: 232162 - DNA, 646 bp, Homo sapiens
gtatactctgaacaaaatatgagtcattaatccctctaatggagggacctagaacagtgaaatagggaggacaggaaggagaatgatgctgaattgaactgggatcttcttgtctgtcaagcccttgaacagctttccctttaagcaacaaagatgacaagtttttgctattttggattagtgagagtgtacgaaatggtttccctttccttccaggcaaaaataccaacagaatctggcttcggaatgaaagtgctaatttcatttggtgactttcagatttgaaatacgggcttgaacaggcattgtgcattagtcagctgaggcagtggaggttatttttacgatgctaattattatttcctgacagtgatttactttatgttgtctactgtttacgcccccaaactagccattgttttaggaacagaattggttgggttgtcatgctcttttcaaagacaaatcttactattttatgcatagaaatactttcctgtaataaagaagaaagctttattgaagagaatcttgcatatgaaatgtaatctggataaatattcaaaactaatagggttatattttagtcttgattttaaagtatatttttctgacatcctaaccaccttgctttatgtgcattaaa

SEQ ID NO: 232163 - DNA, 592 bp, Homo sapiens
gtatactctgaacaaaatatgagtcattaatccctctaatggagggacctagaacagtgaaatagggaggacaggaaggagaatgatgctgaattgaactgggatcttcttgtctgtcaagcccttgaacagctttccctttaagcaacaaagatgacaagtttttgctattttggattagtgagagtgtacgaaatggtttccctttccttccaggcatttcagatttgaaatacgggcttgaacaggcattgtgcattagtcagctgaggcagtggaggttatttttacgatgctaattattatttcctgacagtgatttactttatgttgtctactgtttacgcccccaaactagccattgttttaggaacagaattggttgggttgtcatgctcttttcaaagacaaatcttactattttatgcatagaaatactttcctgtaataaagaagaaagctttattgaagagaatcttgcatatgaaatgtaatctggataaatattcaaaactaatagggttatattttagtcttgattttaaagtatatttttctgacatcctaaccaccttgctttatgtgcattaaa

SEQ ID NO: 232164 - DNA, 546 bp, Homo sapiens
ttattgcctacgatatgccaagcaccttgaggtgattcacacagacacttacatcgaatgactgccatctctctgtggattgtctctaggtctacctcgctcccatctcacataggaggaaactggcatcccccttcttcctttgaccccataaataaacaatgcacagtgcctggtataggacatgcttggtgtaacagggaaaatcattcacccaggcaagcattgatgttcagagcacttagtggtggaatacgttatcaccagctcaagcatgcgatgttcagccactccggcccacgaaatgtaagcacgggacgaacgggtggttttcccacgcctcccttgccagctccaagggctgaggctctccagagctgggctgtgagtgcctctccttctctctggggagagctcacagcatggctgtctctacagagcacgaggataatgggcagatgaaggtcaaagctacaggccctaaccaaccactattgagcacttgttgtgtgcccagacctataaagcgttttcatgagcaaaaaa

SEQ ID NO: 232165 - DNA, 691 bp, Homo sapiens
ctgtaaaaatatggtgaatactactactgacatcacagaattgttattttcagaattaaatgagatgacatatttaagttgcttggcacattgtttcagtaaatgctgaatacatggtgctattatattgtcattattgctcacatttggtttatgtaggatggtgtcattaactagatgtacatttctggagaataagcagtaggtctgtgactttttgatatgaaagaaaggcagaagaaaagagagggaaggagagaaaaccactcaaaaccctcccactaacgggatgattcctggaattctgcctatggagttttatttcttcatttcaggtttctgatctcatgagtccatctgattttgcaaatatttctcccttaggatgaatgtaaaatctgagagtcatttttattcaagtttggagaaagagaaatgtgtgagagtaccaggtatatgggagggggcaaaatgaaagacaagaagagaagagggtgtctgtgctgcaaagtcaagtctagcacactgccgaagttctctgaactctcaccactcacagcaaactggaaaccactataggaaccaactcgtctcttgatcctgatatgggagtcccagaaagaaagcccgatcattctacattcatgttgcactcaatttgttcctgacctgatggacgagatctgggtcc

SEQ ID NO: 232166 - DNA, 960 bp, Homo sapiens
ctgtaaaaatatggtgaatactactactgacatcacagaattgttattttcagaattaaatgagatgacatatttaagttgcttggcacattgtttcagtaaatgctgaatacatggtgctattatattgtcattattgctcacatttggtttatgtaggatggtgtcattaactagatgtacatttctggagaataagcagtaggtctgtgactttttgatatgaaagaaaggcagaagaaaagagagggaaggagagaaaaccactcaaaaccctcccactaacgggatgattcctggaattctgcctatggagttttatttcttcatttcaggtttctgatctcatgagtccatctgattttgcaaatatttctcccttaggatgaatgtaaaatctgagagtcatttttattcaagtttggagaaagagaaatgtgtgagagtaccaggtatatgggagggggcaaaatgaaagacaagaagagaagagggtgtctgtgctgcaaagtcaagtctagcacactgccgaagttctctgaactctcaccactcacagcaaactggaaaccactataggaaccaactcgtctcttgatcctgatatgggagtcccagaaagaaagccaaaaagtgaaaattccttggttctctgatgggaagcacacctcaagcactgtctccagatacttatctctttcctgcatttagtttctaaccagagaaatcagaaaaggaaaggtagcccatggctactatttaatgtgtcatttgtatgtttggttttattttgattcatgtcattctgctttcacaggaccctctaactgctccaaaccctccccgggagaccagttggaaagtagccatatcttaactcttctatgtgactcttcaaaagtaagggtgattttaaaggacatttctgctgacagattctcatttgtttcaataaaccta

SEQ ID NO: 232167 - DNA, 436 bp, Homo sapiens
gcattaggtattactaatccaactatatttcaacttgaagggacttttttgttttgtttcaaaataatgcattacttttttctctttgcttctgtatgaacctttatagagcaaatgaatatatgtatatggagttctgggttctagtgtcaattacataatcaaatttcataaaaggatgttagttactggctatgttgtcctaaaatttacacacactaaaaaatgtctgtcaagttgtacctttaacctgttcatagctttagggaattaagtttcttaaaccaaattatgaaaaaataacttaatggaatcttctaaaaggaaaaagtataaaaagctttctgaatgatattaccccttatacctaaaggctcaagatgcttgaatatggttcaacttttccaaagttaataaacaagggatgatgaaagca

SEQ ID NO: 232168 - DNA, 873 bp, Homo sapiens
aggccaaaacctcacgtcagcccagattcccataaggtgggtctgattccagtgagcaaacacaagagggatgacagaagcaggtgtcaccctctgacaaccagagggcagcaactgcttcagggtggggccgtccagggtctataggcccgcgggggaaggcagcgggggcgtgttcacaggtgcctccaggctcagaggagcctgccctcagacgctccttgagtacacagccccagagggagcttccaagtggacagacagcacagacacgtgttccgggccagcgtgaagacgtctgttggctagaggtctgattttctggttgtttttttttttttttttttcctgagacggagtgtcgctcgtttccccagttggagcgcaatggcgcaacctcagctcactgcaacctccacctcctgggttcaagcgattctcctgcctcagcctcccaagtagctgggattacaggcgtgcgccaccatgcctgggtaataattttgtgtttttagtagagacggagttttggccatggtggtcaggctggtcttgaactcccgacctcaggtgatccacccacctcgagcttccaaagtgctgggattacaggcgtgagccattgcgcctggcctgattttccttttaaatagatttaagaattctacctaatgttgaaaaaatgcacacatttgtatgggacaaaaaagggcctaaaagaaggaaaactgcatgctggaaggttgctctacgttaacctagataatgagaggagggaagcgtgggtgcagctcactccctgcaagctgccagcctttcatcagtggaaacaggtttctgtaccacaacctgctcttcactaacagctcactt

SEQ ID NO: 232169 - DNA, 775 bp, Homo sapiens
tagccctgccctggtggagctggagggccgcagggccgcccggtggggtcaggaggttgtgaagaggatcctgatacaggctgggcctccctgcaggcgtgagccccggagcacggggtgagcagctccacccagaggggcttgcaggaccaagctgggacagcaaccaccaggccctggggcagatcagtgagcgtccaggagatgcagatgcagaagacagccaaattcattcacctctgcgtgggcctgtgagggcccacagagatgcattttcattcacgaccaggatttcctcggccggagcagccgcttttcccagccgaagctcactgtgtttactacataggatgtgagtgtatagaaagactctctctaacgttagctacgcgtgcagaaatgtggggcgcttacaagtgtgggcagccgcagcctgttcctcacccctgtcctaacgggacatactccgcgcatgcacatttaggatcaccgtgtcttctcgttggactgatctgtcgttaggaccctggacccaagtaattgtctttgctctgaagttttgacagtaacaaaggcattccagctctttctttttcactcctgtcggtgtaacgtgccgtttttcatcctttgacttttagcccgcctgtgccctgtctgaagggagttgtctgtggacagcacggagtggtgggtgtttgtaatccactctgccagcctcagtcttctaactgttgcgtatggaccaattacatctgccctttctcttcaaaaa

SEQ ID NO: 232170 - DNA, 164 bp, Homo sapiens
ctatacgtgctttgccaatttcatccactctgaaatttcagccatctgcaatgtctatacccgcaacccagacctctggctaaactctagtcctatacatccaaatgactaccagacatcccttcagaatggaccataaatacacccattaaacgtcgcatgtc

SEQ ID NO: 232171 - DNA, 406 bp, Homo sapiens
cagaagggggctgctggcagccaggaggggtcaggcaccaagggaaggagcctggactggcgtgtgtggagggagaccacgggctaggaggacaggatggcagaggggctgggctgcattctggaacaggagggggagggccaggtgtggatctggggagaaacgggactgaggggcatctgggaagatgaccagggggtgggggagccctggctcgccgcaggaggggctgtcgggtgccatgaaccaaggccagccggaggcctgcagggtagaggccgccctctgagatgtacccaacatacaggggcagggacagaactgggggcttccatgccccacccccaaggcctccccacctccggggggactcaccccagaccgaccttacccagctgcttccttg

SEQ ID NO: 232172 - DNA, 431 bp, Homo sapiens
atccctcccacaactccggaattctaaaatggtttctcttgcgccagttctggttttctcctccccatgcctcatgcccagggccagggtgcacggtaaatctctgagatcctcctttcttttggcctttcttggccactgaccccatgcagcatagccatactcatggcttccccctgccttcctgacttgtcctgtctccttggacaatcgttcttccacctttttaggttggtgcttagccctgtgcgctgatgtattatagcaggcgagcgctggctttcagcctcaatcccctgacgttgaattccaactctaaatttactaactaggattttggataagggctctttgagtttcttatctttaaactgagactgttaatacccaccagtaagggtcatttttaaaattaaatgaaattctattaa

SEQ ID NO: 232173 - DNA, 391 bp, Homo sapiens
ccagccgctccaccagtccgaggtccagaggagcagacacacagacccgggccggaggcccctcttctagccctgcgggaaccggacagttccccaactgggactctggaaccacagctcctaaatcatcaaattctcaagctttttttttccctctcttcgtcccagccatcccagtcttcttcttcttttttttttttttaacttattgtttttttcgctcctgtcattatgaaagtggtcacgccattcaatattaagacttggagggaattggggaaagaaaagaaagaatctaaaagaagagaagcgaccggtgcttttaagggtgtctaattttcaaaagagacgtctgggagtattttgctctgggcgtttgggtgagcaggac

SEQ ID NO: 232174 - DNA, 494 bp, Homo sapiens
tctactttatagtagtatggggacattggttaagtgatctcttttattcacaatcgtctcatctgcttaatggtgataataataaatgtaggtttttctggaacaattaaatggctaatgcatttgagaaaaagcatgtatttcattgtttggcataaaataaacactatatatttttagtaactgttactatgctattattctaagctatactatcagcaagatgtaagtaatgctcctatttcatcataaatatataaatacttatgtttttatgtatagattgttatgcttacataggtttcagtgcactttgttagtaattattcttcatatctttcagaatgcaaacttcttaaggtcaaagacatgtgttttatctttgatatagaatattttcaatgacaagatatgttcatctttatatccccaaaacctatcatgtttttgaaagacagtaagtgttaataaacagttattagtgttgaaataga

SEQ ID NO: 232175 - DNA, 370 bp, Homo sapiens
gaaataaaaattcagtggaagggttagatagcttactggacacagcagaagaaaaacctgaaactgaaagagatatgcaaagaaattaccagaatgaaagcaacagtgtcttaaagaatatgccctatccaggatctgctggaatttgaaggcttttagttcttgaaggattcataggatctttgaatattaaagaggtatgtcttcttcactgatcaatggaagagtaaagtgcagaactgttctcactaatgaactttagtgagaaatgtttgtttttacttttgccagtgtaattatatattttcatgttattttgcttctgttctgatttttactttggcaatcaatattagtgagtaagtagtga

SEQ ID NO: 232176 - DNA, 449 bp, Homo sapiens
ggcatagcctcaaagctgccatgggggaagccaggcactctggaagggaaggtaggaaagagaagacactgaggagcatgactgggtgctgcgctcagccagcctctcacccccacccactccgtgaggaccacttggagcactggttgaaaccccggcagagcttggtgacggcatttctgccacatactgacaccataactaactaaagaatgtccttgggctagaattgagaaggccttagagatgcccggaaacagcctgctgcttggacaaatgagaaacctgatggtcaaaaccccaaatcacaatttatccctgggcacctggtggattcttccatttcctggagaccggtaaattgatttcaggggtataattcatgtgcacttgagtggtttcaactccttatctaatgattttaagtttttgtttaaatatttttttcc

SEQ ID NO: 232177 - DNA, 403 bp, Homo sapiens
tccctcagaaccaggagtccagacccccagcttcttcctcctggacccttcctcttaggcattttgaggtcctctactattccctctccctctcttttacacaaacccctctctccctccactccccattctaggattgagaccaagggtgagtcacaagaagccctgaggccctgagtcacctcgccctccccccttggcccctccctgggctggaggcagctggctgaggagtgaagcagtttcctaggactgacccctgcatcccaggactgcagtttgaaggcaggtgcccttcccactgtaaccccatcactgccacccaggcatgtccatgcccatcctttgctgtttttctctttcagtcatggcctatttggagacaaaatttctctgtgctcta

SEQ ID NO: 232178 - DNA, 808 bp, Homo sapiens
ctagggtgctcaggcaaactgcacgtgtcaccgctcctcagctgctgcagctggtggccacgtggcagtgccagggtcacactcacagagatgaggagaagctgggccccctttgatcttcacagtagcctatgagatggtccccagatcctccgatgcttcaagaggagctgggcaccacagttaagtgaagtttcctaaattttaagtgttggtcatttgtgtttaaaaatgtgaaaacaaaagaaataaaagtgcagccagacaaagcctctctgcctgcacatggctgctgaaaggctgaaatggatggaggtggtctcacccaggggatcccagggactgacgttcctatcgcagggaaggtgtcacacacggagctacggaacagcagggccggagcaaacaaagccagcccagctgcctcggctattccaacaggggctacactggagacattttaaaaataaagggggtgaggggaaagaattctccagaaactttggttcttctgtaatggcaagtataattgcaaaaaacatcttgtcagcctgtaaaatgacactttcacaggttttcttagcaagggagctagatgggcaagaaccaagcgttcaagttcggggaccgttcgagcccagtttgctttgctgtgtttcgtagccattaatgtccccccgccaattaccaccagtcattttgcaaagttatcattactactgtttaaaagaaaaaaaaacattgctcattttagaaagctgtctgtcaaaaatgcttaaaataaaagcagtcttggcattcgaaggaa

SEQ ID NO: 232179 - DNA, 418 bp, Homo sapiens
taaatattcttcttattgtccagaagaacaacaacaaagaaaacttttattagcagagagaaaataagacggataatccttgccttcctggaggttctgtaagtcagactggcctgccctgtgaggacagcattctttcctctttatcttctttaatgactgctctgctaatcacacctgactcctgttatcaatcctgtggttgtatcttttcagggtttttactgtggtcagaggtttccagatactctattattattatgaaaaagaagcattgtcattatcggacctaacttgggacacagaacaatgaacaatttttcaaaaggaaggaatctagcagatattcagctcttgtatctttttactttgcatcctgagaaaaggcatctacctcggtgacaggaattcaagggaa

SEQ ID NO: 232180 - DNA, 896 bp, Homo sapiens
ctccgacatcactaagcctcagtcttctaacctgcagagtgggaagatgaatgtcttcagtgctgacataatatttaaaaagctgtcaatcacctaaacgcccagctgtaggggactgcagaaatgcatcgtatgaaactcatccactgcatgaactactcttgccatcagcagcattcaaaatacattttcagagaaaaagtaggatatgaaatgaaatctgtgtctataaaagaaaatggataggccaggcgcagtggcccacgcctgtaatcccagcactttaggaggccaaggtgggtagatcacttgaggtcaggagttcgagaccagcctggccaaaatggtgaagccatgtctctattaaaaatacaaaaattagctaggtgtggtggcgcatgcctgtaatcccagctacttgggaggttgaggcataagaattgcttgaaccctggaggcgaaggttgcagtgagctgagatggtgccattgtactccagcctgggcgacagagtgagactccatctcaaaaaaaaaaaaaaaaagggataaaggatttcgaggaaatgaacctaagtgtcatgtgactggctgtgataggaatggggagaaacattttttcccctgccaatttttcaaattttctttcttccattctttgtacaatgggtaaatatacataatgttccacaatcacaaaaacaaggaaacacaccctgccctgcacccagggcagttctagggatccagtgaaattgtggctgcaaatagggccttgtgagctgcagaattctgagcacccaggaggagctgttgtccacagtactgggatgcatgcattcacactgctcacacactcaccaaggctcactcatggtcaactccaacacaccaagt

SEQ ID NO: 232181 - DNA, 337 bp, Homo sapiens
agtttgtgtccattcacagttagaactaggtaagggcataccaagaggcacccaagtggatcatctgagtttcacatgtgtatttctccctgtccccaaggtgtaaaggtggccccacctcctcatactaatcaattatccttgcttgctggcccctggctgcaaagagccaaaagtgtcgtgctatacatagcttatagttcaatggattcccgctctacccctttgcaagagagaaaacctgtaattctactcaacccagagttggggaaagtgaagcacagagttctccagtgggttattaggagtgattttaaataaagccatttgtgatttc

SEQ ID NO: 232182 - DNA, 177 bp, Homo sapiens
aatatgcatgtaagttttctttatgctttctcatgacttgttagcccagttactttttgaatgaataagattccatggtctagatgtgctacactttatttatccatccacctattgaaagatatcttggttgtttctaagttttgacaattatgaataaagctgctataaaccttt

SEQ ID NO: 232183 - DNA, 526 bp, Homo sapiens
gaatgtgagccatgtcgctgatttcgaacaaaccccagatgtgtggaaactgacttattttgattgcaagagggtccttgtcccttgcagatgggcagcttccggggaccggcttgcacgatgccgtggccaccccagtggagaccctctgcccggctttgtgtcctggcgtccccaccagggtgcccagctctcctgcgcagatgtcgggagtatctggatgccccatgggcacttcgagggcccaatccggagttttttgttttgttttgttttaagagattgagactgtgaacctgaactcccttgatctcctcccgttgggcccaggagggagccgaatccaggcccaaccgggctcactgagaaggtgcaggaagcccccaacgactcctactcgtgtgcggcccatactgggccaggacgctgcagtggccgagccgctgggtgtctgcaacggggagctcccccgccgctgggggcaataaacggaatcggtttcacacgctttccctcttgatctaag

SEQ ID NO: 232184 - DNA, 527 bp, Homo sapiens
  misc_feature (11)..(11): n is a, c, g, or t
  misc_feature (152)..(152): n is a, c, g, or t
  misc_feature (296)..(296): n is a, c, g, or t
  misc_feature (354)..(354): n is a, c, g, or t
  misc_feature (358)..(358): n is a, c, g, or t
  misc_feature (366)..(366): n is a, c, g, or t
  misc_feature (381)..(381): n is a, c, g, or t
  misc_feature (387)..(387): n is a, c, g, or t
  misc_feature (396)..(396): n is a, c, g, or t
  misc_feature (406)..(406): n is a, c, g, or t
ctttctagcantcttgacctaattcacaaatgcaagaaaataaaagaaaaatgagggaaatgatgaatgtaggtagtctggtgttaaaaactaatgcaggaatgatgcgcattgtcacagaaagaagaggggaaattccccatcctgttttncgtgctatgagggtcatttttaaaatttttattataaacactattaaattcagaccgcttttttggtttttttttctttatctgaatatacaagaacattcattatcaaatgttcatcatcaatactacaaagaacgagacacnagtcgcaagaaacaatggaaaatgttaataaagctgaaagaatcgttgagtatttttntgtntcttttanagttttttttaaatntgagtntctgtagtntcatcttttntggtatcgaagtcaggttttgctgcagtggccgagccgctgggtgtctgcaacggggagctcccccgccgctgggggcaataaacggaatcggtttcacacgctttccctcttgatctaag

SEQ ID NO: 232185 - DNA, 1501 bp, Homo sapiens
cggaggcgccgccagctccgcgctccgccactgcccaggccggcgggcggcactcggacccgccgccctcggtccctcgcgaggccacggaggccaacacgcctcgcacggggggacagcgcgggggcagccgtccaaacaccaggcgtcctcggctggtcgtcccagggcgcccgcacctctccgcccgcgctctcctgccgccgcgcccccaagcccccaaactccgaggcgctgcggcggaggggccgggctgagcgcaggcagggtggcccgggcccaggagcctgacggcctgagtgcggatttctcatctgagtatctgggaatcgagaatgaattggaaggaaaccgaggcgctgccctggccaggttgctgccccgcacccttccggagcaccgaagtcctgcccggcaacgggacttggagctgccgcagagtcagcctgagcccgaggcaggggtcgcgcccgcgatgcggggtctctgcgccgccccgcgaggctcctggccttgccctccctgccctttgttgtgtaataagacctgtggcggctccactgagacccacacgtgcaactccgcgcctccgcgttaaaggaggtgaaacgcagcagccctgagaaaccccgagaccccggtgtcctagcagaggcgccccggatggggaggggcgcggggccggcgccaccccagaggaaaagcccagcggagccgggttgggcaggagctggcggcggcggtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagagattgagactgtgaacctgaactcccttgatctcctcccgttgggcccaggagggagccgaatccaggcccaaccgggctcactgagaaggtgcaggaagcccccaacgactcctactcgtgtgcggcccatactgggccaggacgctgcagtggccgagccgctgggtgtctgcaacggggagctcccccgccgctgggggcaataaacggaatcggtttcacacgctttccctcttgatctaagaacctttaaaaatccgccaacgaatgctgttgcctggatgcactgcctatgaccttcagccgtgtgttcacgcgcgcccgcagccgtggagtggcggtccctcctgccgcccgcaaccccggggccgccggtctgcgcacaccgggagcaacttcgttacccacagcgcccgcgtcctgcggctcgcgcggaactgcgcgcgggaaggtggcagagcgacgctccagaacgctgcttgcgtagacgctgccgctgccttcagatcccaattcggccgcgcgcgggcggggccctggcagcaacgaaaatggcgagcctcgtagcct

SEQ ID NO: 232186 - DNA, 852 bp, Homo sapiens
gaatgtgagccatgtcgctgatttcgaacaaaccccagatgtgtggaaactgacttattttgattgcaagagggtccttgtcccttgcagatgggcagcttccggggaccggcttgcacgatgccgtggccaccccagtggagaccctctgcccggctttgtgtcctggcgtccccaccagggtgcccagctctcctgcgcagatgtcgggagtatctggatgccccatgggcacttcgagggcccaatccggagttttttgttttgttttgttttaagagattgagactgtgaacctgaactcccttgatctcctcccgttgggcccaggagggagccgaatccaggcccaaccgggctcactgagaaggtgcaggaagcccccaacgactcctactcgtgtgcggcccatactgggccaggacgctgcagtggccgagccgctgggtgtctgcaacggggagctcccccgccgctgggggcaataaacggaatcggtttcacacgctttccctcttgatctaagaacctttaaaaatccgccaacgaatgctgttgcctggatgcactgcctatgaccttcagccgtgtgttcacgcgcgcccgcagccgtggagtggcggtccctcctgccgcccgcaaccccggggccgccggtctgcgcacaccgggagcaacttcgttacccacagcgcccgcgtcctgcggctcgcgcggaactgcgcgcgggaaggtggcagagcgacgctccagaacgctgcttgcgtagacgctgccgctgccttcagatcccaattcggccgcgcgcgggcggggccctggcagcaacgaaaatggcgagcctcgtagcct

SEQ ID NO: 232187 - DNA, 1345 bp, Homo sapiens
cggaggcgccgccagctccgcgctccgccactgcccaggccggcgggcggcactcggacccgccgccctcggtccctcgcgaggccacggaggccaacacgcctcgcacggggggacagcgcgggggcagccgtccaaacaccaggcgtcctcggctggtcgtcccagggcgcccgcacctctccgcccgcgctctcctgccgccgcgcccccaagcccccaaactccgaggcgctgcggcggaggggccgggctgagcgcaggcagggtggcccgggcccaggagcctgacggcctgagtgcggatttctcatctgagtatctgggaatcgagaatgaattggaaggaaaccgaggcgctgccctggccaggttgctgccccgcacccttccggagcaccgaagtcctgcccggcaacgggacttggagctgccgcagagtcagcctgagcccgaggcaggggtcgcgcccgcgatgcggggtctctgcgccgccccgcgaggctcctggccttgccctccctgccctttgttgtgtaataagacctgtggcggctccactgagacccacacgtgcaactccgcgcctccgcgttaaaggaggtgaaacgcagcagccctgagaaaccccgagaccccggtgtcctagcagaggcgccccggatggggaggggcgcggggccggcgccaccccagaggaaaagcccagcggagccgggttgggcaggagctggcggcggcggtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagagattgagactgtgaacctgaactcccttgatctcctcccgttgggcccaggagggagccgaatccaggcccaaccgggctcactgagaagaacctttaaaaatccgccaacgaatgctgttgcctggatgcactgcctatgaccttcagccgtgtgttcacgcgcgcccgcagccgtggagtggcggtccctcctgccgcccgcaaccccggggccgccggtctgcgcacaccgggagcaacttcgttacccacagcgcccgcgtcctgcggctcgcgcggaactgcgcgcgggaaggtggcagagcgacgctccagaacgctgcttgcgtagacgctgccgctgccttcagatcccaattcggccgcgcgcgggcggggccctggcagcaacgaaaatggcgagcctcgtagcct

SEQ ID NO: 232188 - DNA, 1175 bp, Homo sapiens
cggaggcgccgccagctccgcgctccgccactgcccaggccggcgggcggcactcggacccgccgccctcggtccctcgcgaggccacggaggccaacacgcctcgcacggggggacagcgcgggggcagccgtccaaacaccaggcgtcctcggctggtcgtcccagggcgcccgcacctctccgcccgcgctctcctgccgccgcgcccccaagcccccaaactccgaggcgctgcggcggaggggccgggctgagcgcaggcagggtggcccgggcccaggagcctgacggcctgagtgcggatttctcatctgagtatctgggaatcgagaatgaattggaaggaaaccgaggcgctgccctggccaggttgctgccccgcacccttccggagcaccgaagtcctgcccggcaacgggacttggagctgccgcagagtcagcctgagcccgaggcaggggtcgcgcccgcgatgcggggtctctgcgccgccccgcgaggctcctggccttgccctccctgccctttgttgtgtaataagacctgtggcggctccactgagacccacacgtgcaactccgcgcctccgcgttaaaggaggtgaaacgcagcagccctgagaaaccccgagaccccggtgtcctagcagaggcgccccggatggggaggggcgcggggccggcgccaccccagaggaaaagcccagcggagccgggttgggcaggagctggcggcggcggtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagagattgagactgtgaacctgaactcccttgatctcctcccgttgggcccaggagggagccgaatccaggcccaaccgggctcactgagaaggtgcaggaagcccccaacgactcctactcgtgtgcggcccatactgggccaggacgctgcagtggccgagccgctgggtgtctgcaacggggagctcccccgccgctgggggcaataaacggaatcggtttcacacgctttccctcttgatctaag

SEQ ID NO: 232189 - DNA, 372 bp, Homo sapiens
tagtggaaaactgaaaataaacttcgcacatatgtaacatgtagctttcaaaaatgtacaacattctgaaccttcccaaataaattaaactctataccatattggagataagatcatttaaggggaaattttattcagaatttaaatctgagaaaccgcatgcctcaccctcacactagggtgaaaagtgaaaatggcctaaaactgcctggattttccagtgcaatagaacccaactgttactctcctgctaggatgtcacattttacaatatgctacaacagactggcttggaagaggaacaggcagaaacgcagccaagtatatacaacctcaggagtggaaactatgtacatcagcagggccacctta

SEQ ID NO: 232190 - DNA, 159 bp, Homo sapiens
cctccatgtaatatacccatgtaacaaaactgcatttgtaccctctaaatctataaaaaatttaaactaaaaaagaatgtttaatagtaatcccaggagtcctggcatcaaggttattcatttatgaatagggcccaggccctcttgcctggctgtcaa

SEQ ID NO: 232191 - DNA, 476 bp, Homo sapiens
acaccatcccccacccgcctcctgtggcgagtcatgggttaatactattggtcttactcattccgataaagctttctctcctattcctcctgacaagtgctcagaaagctttaggagtagcttgtttccaccagagacttccttccagtgagggtgaagtggaggcttctggagtatcctcacctgagggcctaaggacctgcagctcagaaatagcccaggctggtcagcagccagacggcagtggtgtcgccagaagcgtatgcagaccctggcctggagacagcacagaaccagtctccaaaattggcaatggccactgaggtcctgagggctcacactattcacaaatacacttctgaataggttggttataatcaatgtagtaaatggaatcattgcttaaatgtatccaaagagcccactatgcaaagagagatattcattcaataaacacttattgtactgaaaaaaac

SEQ ID NO: 232192 - DNA, 438 bp, Homo sapiens
ggctcactttcaggaagtggtgcctgggctgtgcccctcagatgtggtcgcttctgtatatgtgatgaattttgagactctcagtggcccaggaccatcactacgtattaaatccataagatgtgagaagggtaattaacacttcctgttgttatttccccttctttgcatccagggaaaggggtacaatagggaagagcaggaggagggggagggaagatccacacgccagaaactgaagtggtctggaatgggaagagtgctgggcacacaggagctttctggagctgtgtctagagggaaaatgaaggttccctcctgtttaaaccagactcccagtctgtggctttcacactacatgcagagtgtggaacacgtcatctactgatgagccctattcacccaacacactcagaacttgggggtttagcctttcct

SEQ ID NO: 232193 - DNA, 220 bp, Homo sapiens
gagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctg

SEQ ID NO: 232194 - DNA, 331 bp, Homo sapiens
accccgtttcttcagtaaatcacgaggggaatctataaacgaaaagagacctaagagacatagtaaccaaactacatacagaccttgattaaatccttacaaacaggagaaaaaaaaaaaaagaatggaacaacaacaacaaaaaaattaggtggggcaacacagggagacctcatctctagaaaaattcaaaaaattggatgtggtgatgcacccctgtggtcccagctatatgggaggatcccttgagcctgggaagatgaggctgccatgagccactatcatgccgctgcactccagcctgggcaacagagaaagaccctatctcaaa

SEQ ID NO: 232195 - DNA, 392 bp, Homo sapiens
tccagggagaaggcaagggaggcatcatcatcatctgcattttatggtcaaagacgtccaggcaatgactgctcaaggtctcctaggcagggaggcaggtctttgacccagacacagcatcatctccactgcaccacaccctcttgacattggaggtgtacttccaggaaaagggactctggcgccaaggtataattggaagagagatgctgcattcctaagcacaagcgcatatttcaaggggaaaataggagcttcagcttgataattcatgccacagctttcatgagactgactctgtaaacaaagtgtattgagaacgggaaaccaggcgtggaatttgtggtggagaatactcccccttataaaaatatgtgaagcttaaaaaaaaa

SEQ ID NO: 232196 - DNA, 490 bp, Homo sapiens
actatttttatagaacagtaaaatcagctgggaaaagagaggctttgttttaagaacactagtattccttttgcatttccacatagctatagagtgagaagataaggggataatggcgttttgaaggaaggaggggagtaaatataactttaaagattttaattggatgggtgaaattgtttatatgttttaagtatagtcagtaattggccaggcacagtggttcatacctgtaatcccagcactttgggaggccgaggcgggtggatcacctgaggtcaggagtttgagaccagcctgaccaacatggagaaaccccatgtctactaaaaatacaaaattagctgggcgtggtggcacatgcctgtaatcgcagctactagggaggctgaggcaggagaatcgcttgtacccaggaggcagaggttgcagtgagccgagattgcgccattgcactccagtctgggcaacaaaagtgaaactctgtctc

SEQ ID NO: 232197 - DNA, 378 bp, Homo sapiens
tgcctccatcaagaacttcactttcctgctgcctgtggcaataaaagaacccgttttgttttaacattaataaggtgagagaatagagaatttccaaaagaaattaagaaaggcaagagggtaggtgttggcccatggaagtttccctaaagcaggtctgatggcggagttcagtgagaggcctttgatgcggcaacatctggaccacatgaaaaaaagcctagcaggcaaatgagagactggccaagcagagaggctggggtgggaagcggggggtatgggttctaatcctaggtcctaagtccctgagtgaccttgggcgagtctttgatttttctctggtcctcaattttactatcagtaaaataaaggaatgga

SEQ ID NO: 232198 - DNA, 480 bp, Homo sapiens
tgaaaattcagaagtgctggaaaccctgggcccggatttctatgtgacagcaattttggggctgagtggcttcatttagatggggcatgtgctccccatattctgctctccccttaacactgaggttgatgatagtgacctcaacatcaatgaggtagtgctgtttccatgtcatagaattaagaggaggttgaagtatttcccattctcacttcaagcaaaactggaacaatggaagatacacttagggcaccatatttcaagcaagaaaggaagagggcaaatttccttgtacatataaaacatactcctaggtgtttaatgtacaaaccaattgtgtctgtgcaaagtgacataatttaaaacatccttcagaaataaacacatcaagaaccatgggctactcaagtgaaaataaaattactaaaatttcaacagggtttacatttgaatgaaaataaattacaatgctgttaaatt

SEQ ID NO: 232199 - DNA, 416 bp, Homo sapiens
aggcatcagatttcagtcttctctttccaagcacatagtacaagcaggctctttcatcccacactctttttttttttccgagacggagtctcactttgttgcccaggctggctcgatctcagctcactgcaacctctacctcctgggttcaagcaattctcctgcctctgcctcccgagtactacaggcatgctgagaatacaggcatgtgacactgtgcccggctaatttttgtgttttcggtagagatggggtttcaccatgttggccaggctggtttcaaactcctgacctcaggtgacctgcccacctcagcctcccgaagtgctgggattataggcataagccactgcgcccagcccaaattcgtatgttatacagaattttctgatttataaatgtgggcaactgatcgt

SEQ ID NO: 232200 - DNA, 496 bp, Homo sapiens
taaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatc

SEQ ID NO: 232201 - DNA, 285 bp, Homo sapiens
cagtgataaactggatgactctaatgaagaagtaacattattttaccaaataaagtggcataggcatttttctagatcaagagagtatttcagttgactttctcatgttttttttttaagagcatctagcagtttatttaattattttattctattttttatctttaaaatttatcctagctttattgtcattaacaaatgaaaattgtatatctttacagtgtatgatgtgacgttttgatatgtgtacacaccgtgaaatgattaaatcaagcaaattcacat

SEQ ID NO: 232202 - DNA, 652 bp, Homo sapiens
caccgcaacccctgagaggctgtcctgcgctggacaaagaaaggcccatttcactgtgtagctgaatgatgggcatgaatttggatgcagactgcccgagctccaaccctagctccaccctcagatagtgctcatgggaacaaaaattgatacaacccttagggagggaaatttgtatctgccaaatttacaaaatatccaataattccattgctggaacttcatcctccagatatgcctgtgcccacaaaaactgtgatatgtatgagcttattcattgcagcgtggtttgtgataacaaaaatattgtaatatccatcaatataataccggttaagtcagtatattggttaagtcagtgtaatatactggttaagtcagtgcatccaaagaataaaatgtagtggagctatgaaaagaacaagaaagctctttgtgtaatgatagggacacaccccaagatatggagttaatggaagaaagtaaggggcagacactgtgtataatttgcttacatttatgtgaatttaaggaagtaatatatttgtatttgctaccacgtgtgtaatatacaaacatacacagatgttctttcatttacaatgggattatgtcccagtgtacccatcgtaaattaaaaatatcataagta

SEQ ID NO: 232203 - DNA, 637 bp, Homo sapiens
tttttttttaaatagagaaggagtctagctatgtcgcccatgctggtctcgaactcctgacctcaagcaatcctcccgcctctgcctctcaaagtactgagattacaggaataagccaccatgcccagcctgattttaacagttttaattgaacttaagctgaaagtattatcactaaaaatcatcttgattcctttcactaaacctgtggtatgaatccagcttgtattacattctgtatctaaatacaatgaaagcagttcattcgcagaattaataaattccttctggcttttaaaagctttagagcagaaaatgacaagagagccaagaaaaactgtggatcagtgtgctaaatctatgccaaggaagcaccacatacctgcctcatgaaaaagttacagaaaactttaatagctaaagccctctggatggaatccaagagacaccttactctgtattactatttaaatttttagaatccagtatatttctcttctaatagcaagttgataatggtgctgcttctctggaatgcagtacaattggatcttttctacattgaaatatttcatagtaaattatcagcatctttaaaatatgctctcagctaataactgctaccacttaaaaaagg

SEQ ID NO: 232204 - DNA, 427 bp, Homo sapiens
caggaacagaaaacatattagtgttgccaggagcaaaaggtgggggaggtgttgactttcaaagcacaggaggaaattttttgttgttgttctttatcttgattgtgttagtgcccacatgactgtatgcatttctcataattcacagaactgtatactaataagggtgcacttcactgcacataaatgaatctcaacagacaaaaggttaaaaaagaaagaaatctcgggacaggaatcatggatttttgtattatccttgtatttgatggttgtttccagtttggtcactcatctgttcattcctttaacaagtatgtgtcgagtgcctactatgtgctgggcactgtaggttcaatggtaagaaaagcagatacaggactgctcttgtgaagttccttgaaagaaataaaacaaagtgcaaaat

SEQ ID NO: 232205 - DNA, 474 bp, Homo sapiens
ctcaccacattggccaggctggtctcgaactcctgacctcaggtgatctccccaccttgacctcccaaagtgctgggattacaggtgtgagccaccatgccccgccatcatttgtgtttatctctccaatacctagttgactgccacgcagtcagagatatttaaaagatgtttgaatcagttggtggatatgacgtggaaaaaaaatttgatgatcattctttcacatcattttataggcaagtaagtgaagtccagaaaggtaacattttgctttactttttccaagttatcagactgtattacttcaggcattttatcactacagtgctctagattcaggaaaaatattcccttccagtatgttccagaaataatgtgcggaaaccttagagacaggttatttcattaagaccagggttattctagcagaaaatgcctctctggtgtgtagaaagtgaactaagaatagtt

SEQ ID NO: 232206 - DNA, 334 bp, Homo sapiens
attaattttaaattgaactattttttaaaaacctctttggtaaatgaatctcattcctaaaagatttattcatcaaagctccattgtatttccagtgttcttggagctgtgggaaatattacaagagcaatcagaaattaaattcaattgtttcttctgcttagtggggagaatttaactactgtgtctacataatttcttattttctcatgtaggagacccaggcttgataatattctgattaatggttcagtatatttgagaatccaaagacaaaatactaaaacgaagtcaatcaaaaccccctttccctgaatttttgcaggaacaatta

SEQ ID NO: 232207 - DNA, 509 bp, Homo sapiens
aaacatgagccgggtgtggtggtgggagcctgtaatcccagctactcgggagtctgagacaagagaatcacttcaacccgggaggcggaggttgcagtgagccaagatcgcgccattgcactccagcctgggcaacgagagcgaaactccgtctcaaaaaaaaaaaaaaaaaaagattactttctttttatcattcctttatcttttaaagctttcttgcagtcaggtgcagtgtctcatgcctgtaatcccaacactttgggaagctgaggtgggaggatcactcaaggctacaagttcaagaccaacctgggcaatgtagggagacctctgtctctacaaaaaaaattaaaaaatagctggatgtggtagcacacacctgtagccccagctactcaggaggctgaggtgaaaggatcacttgaccccaggagttggaggcagcagtgagctatgactgcaccactgcaccccagcctgggtgatggagcaagaccctgtctcaaaaa

SEQ ID NO: 232208 - DNA, 538 bp, Homo sapiens
aaagagcaccacttgtgtatggccgtgagatagactctacacagtcccatcatttcttcaaaactctttctgcaagaccaggacatccacaactttaatcactttgtatgaaatgctattttaatgaattttatttttgctcagattgtgacataagtgttccaggtttgtgactcagagttaccagtagcctgagtcttttcctcttcttgaagctattggtatcatctatcaaaataaagataagtatagaacaaatacataaaaatataaattagatgaaggtggaaatattttttaatattgattttgagtttctgctgtatgttgtaaccattgaaaaatcaacacattttgttatttaataattgtttatcaatatttcttactccattaagctctgcccaagggtataagcttatatattacacattctcttgtactttgcaaaattggtttaatttcacaacacatcagagatttatctcaagttaaacagaagaaacaaaaatgcacaaagaaaagacatttctgcaat

SEQ ID NO: 232209 - DNA, 135 bp, Homo sapiens
tccggggcctcgctgaggtctcttcgctgctacttctgggacaaagaccactgctcacttggagcctggatctgaggaacgcaaaggcattaagttgctaatacatttttggaatggggtcaaggtagaagagtg

SEQ ID NO: 232210 - DNA, 214 bp, Homo sapiens
caattcaaagttggagacaaaaaagtgagctgttagctgtgtctgactttattccattcaagctcttctcagcctggtgcagctgtgtggggccaaggaagggccgagtgacatgagcaccacctgccatgcagtcggtggcgaggaagcttccagggatctgacagatgtgtcatacagaatgtaacttctagacaatgatgggcaaataata

SEQ ID NO: 232211 - DNA, 484 bp, Homo sapiens
tttgttattcagaatattttattttaaactacaaattagcacagctaatttgaatatttaaatttccgtaagcactgtaaattgaatacattttttcttaatgatatagtttttttcctaaaaatcctaggcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtc

SEQ ID NO: 232212 - DNA, 2765 bp, Homo sapiens
  misc_feature (2756)..(2756): n is a, c, g, or t
  misc_feature (2758)..(2761): n is a, c, g, or t
  misc_feature (2764)..(2765): n is a, c, g, or t
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagtatttttaccactacattacaacatactgaagaataatgctaagactacacaagaaagtgtttgtaataaatgttgctaatttttgtattctttccttgtggaattattggtttcaggttgtcagtagtcagcaacaacatagagggagaaggacttgttgcactttcacaatcaatgaaaacaaatctcactttctctcatatctacatttggggaaacaaatttgatgaggctacgtgtatagtaagttttaagttttttccttcactgaaggctttttctgggatcatctctgtaacatcagatattatttacaggtgcctcagaaatggttacacagtgagacactgcagttttgataattaacataagtcttaaaattaactactagagagtttggtggttcaaataaccaaagatattaaaactatgtattagtattacacatcactgaatgacacagttctaattcctctaaggttaagaaaaatcataattattgatcagatgtagcaaaatttctgatctgctccctaataattataccaaaatatggaatgggagagatagagtacaagctatcaaaatatttggcatgttgctcacataaatacagacagcctttgatactactttcaaaacagaaataatggtaacagttttcatttggaaagaacgagggggaaaaagtagatgttaaaattctcaaaatttgcaaaaggactaacaaaaattccaccactaaaaagagtaataaaacatagagngnnnnctnn

SEQ ID NO: 232213 - DNA, 2605 bp, Homo sapiens
  misc_feature (2596)..(2596): n is a, c, g, or t
  misc_feature (2598)..(2601): n is a, c, g, or t
  misc_feature (2604)..(2605): n is a, c, g, or t
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagtatttttaccactacattacaacatactgaagaataatgctaagactacacaagaaagtgtttgtaataaatgttgctaatttttgtattctttccttgtggaattattggtttcaggttgtcagtagtcagcaacaacatagagggagaaggacttgttgcactttcacaatcaatgaaaacaaatctcactttctctcatatctacatttggggaaacaaatttgatgaggctacgtgtatagtaagttttaagttttttccttcactgaaggctttttctgggatcatctctgtaacatcagatattatttacaggtgcctcagaaatggttacacagtgagacactgcagttttgataattaacataagtcttaaaattaactactagagagtttggtggttcaaataaccaaagatattaaaactatgtattagtattacacatcactgaatgacacagttctaattcctctaaggttaagaaaaatcataattattgatcagatgtagcaaaatttctgatctgctccctaataattataccaaaatatggaatgggagagatagagtacaagctatcaaaatatttggcatgttgctcacataaatacagacagcctttgatactactttcaaaacagaaataatggtaacagttttcatttggaaagaacgagggggaaaaagtagatgttaaaattctcaaaatttgcaaaaggactaacaaaaattccaccactaaaaagagtaataaaacatagagngnnnnctnn

SEQ ID NO: 232214 - DNA, 2647 bp, Homo sapiens
  misc_feature (2638)..(2638): n is a, c, g, or t
  misc_feature (2640)..(2643): n is a, c, g, or t
  misc_feature (2646)..(2647): n is a, c, g, or t
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagtatttttaccactacattacaacatactgaagaataatgctaagactacacaagaaagtgtttgtaataaatgttgctaatttttgtattctttccttgtggaattattggtttcaggttgtcagtagtcagcaacaacatagagggagaaggacttgttgcactttcacaatcaatgaaaacaaatctcactttctctcatatctacatttggggaaacaaatttgatgaggctacgtgtatagtaagttttaagttttttccttcactgaaggctttttctgggatcatctctgtaacatcagatattatttacaggtgcctcagaaatggttacacagtgagacactgcagttttgataattaacataagtcttaaaattaactactagagagtttggtggttcaaataaccaaagatattaaaactatgtattagtattacacatcactgaatgacacagttctaattcctctaaggttaagaaaaatcataattattgatcagatgtagcaaaatttctgatctgctccctaataattataccaaaatatggaatgggagagatagagtacaagctatcaaaatatttggcatgttgctcacataaatacagacagcctttgatactactttcaaaacagaaataatggtaacagttttcatttggaaagaacgagggggaaaaagtagatgttaaaattctcaaaatttgcaaaaggactaacaaaaattccaccactaaaaagagtaataaaacatagagngnnnnctnn

SEQ ID NO: 232215 - DNA, 2319 bp, Homo sapiens
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagactaaaattctaaccctggagaaagagaccaaggaactagactaaatttctttttataatgaaaatataaccaagtagtgaaatagcgtacaagtaaaggtcattgtaggtatctaactgaaagttattaagtagtattaataaaaaggtttgtggtagaaaattaccagtgactttcaaagggtttcaaagttcagaagttgaaaaagtattctacctatcctatttacgtgttacagacaggtgttactaacaatttcataaatacaggcaaatata

SEQ ID NO: 232216 - DNA, 1641 bp, Homo sapiens
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctggtaagtgataatttacacattaataattcaaagttaaataatgggaataatctatataaatattcatggtacttgggatacgttgttagacattatttccaatgattagaaactgcaaccaattgtcaatcctttgtcctaagctttaatatttaatactgctatcttttagtaacataaatgagcaatttagttgtgtaaacaagaatgaaagcaatattttatggtgaattttcattaactttcttggaaatcaagtggttaaaataaacctttactaaaacagaaagta

SEQ ID NO: 232217 - DNA, 473 bp, Homo sapiens
atattttagaaataagattttatccacttttaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctggtaagtgataatttacacattaataattcaaagttaaataatgggaataatctatataaatattcatggtacttgggatacgttgttagacattatttccaatgattagaaactgcaaccaattgtcaatcctttgtcctaagctttaatatttaatactgctatcttttagtaacataaatgagcaatttagttgtgtaaacaagaatgaaagcaatattttatggtgaattttcattaactttcttggaaatcaagtggttaaaataaacctttactaaaaca

SEQ ID NO: 232218 - DNA, 2670 bp, Homo sapiens
  misc_feature (2661)..(2661): n is a, c, g, or t
  misc_feature (2663)..(2666): n is a, c, g, or t
  misc_feature (2669)..(2670): n is a, c, g, or t
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagtatttttaccactacattacaacatactgaagaataatgctaagactacacaagaaagtgtttgtaataaatgttgctaatttttgtattctttccttgtggaattattggtttcaggttgtcagtagtcagcaacaacatagagggagaaggacttgttgcactttcacaatcaatgaaaacaaatctcactttctctcatatctacatttggggaaacaaatttgatgaggctacgtgtatagtaagttttaagttttttccttcactgaaggctttttctgggatcatctctgtaacatcagatattatttacaggtgcctcagaaatggttacacagtgagacactgcagttttgataattaacataagtcttaaaattaactactagagagtttggtggttcaaataaccaaagatattaaaactatgtattagtattacacatcactgaatgacacagttctaattcctctaaggttaagaaaaatcataattattgatcagatgtagcaaaatttctgatctgctccctaataattataccaaaatatggaatgggagagatagagtacaagctatcaaaatatttggcatgttgctcacataaatacagacagcctttgatactactttcaaaacagaaataatggtaacagttttcatttggaaagaacgagggggaaaaagtagatgttaaaattctcaaaatttgcaaaaggactaacaaaaattccaccactaaaaagagtaataaaacatagagngnnnnctnn

SEQ ID NO: 232219 - DNA, 2919 bp, Homo sapiens
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagtatttttaccactacattacaacatactgaagaataatgctaagactacacaagaaagtgtttgtaataaatgttgctaatttttgtattctttccttgtggaattattggtttcaggttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagactaaaattctaaccctggagaaagagaccaaggaactagactaaatttctttttataatgaaaatataaccaagtagtgaaatagcgtacaagtaaaggtcattgtaggtatctaactgaaagttattaagtagtattaataaaaaggtttgtggtagaaaattaccagtgactttcaaagggtttcaaagttcagaagttgaaaaagtattctacctatcctatttacgtgttacagacaggtgttactaacaatttcataaatacaggcaaatata

SEQ ID NO: 232220 - DNA, 2586 bp, Homo sapiens
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagtatttttaccactacattacaacatactgaagaataatgctaagactacacaagaaagtgtttgtaataaatgttgctaatttttgtattctttccttgtggaattattggtttcaggttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtc

SEQ ID NO: 232221 - DNA, 1941 bp, Homo sapiens
atccagatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccaggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctggcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagactaaaattctaaccctggagaaagagaccaaggaactagactaaatttctttttataatgaaaatataaccaagtagtgaaatagcgtacaagtaaaggtcattgtaggtatctaactgaaagttattaagtagtattaataaaaaggtttgtggtagaaaattaccagtgactttcaaagggtttcaaagttcagaagttgaaaaagtattctacctatcctatttacgtgttacagacaggtgttactaacaatttcataaatacaggcaaatata

SEQ ID NO: 232222 - DNA, 379 bp, Homo sapiens
agaaggaaccaactctgctaactccttgatttccaacttctagccttcagaaccgtgacagtgtaaatttctgctgttttaagcctcctagtttgtagtattaggtcggtgcaaaagcagctctggtttttgccattaaaaccacagttgcttttgtgccaacctaatactttgctatggtggccctaggaaacgaatgctgtgacctcagccaacttggttagacttttcaacctccctttcttcgtctataaagtgggcatcttgtagactttattcttgagaggcattgaaaaattaagaaaaatccagcctgcagactattggggatattgcctggcacatagttggtgctcaataaattgtagttattattaaa

SEQ ID NO: 232223 - DNA, 566 bp, Homo sapiens
ctaaggtgtctttcagtaggagaatggataaactggtacgtccagacaatggattatattcagcactgaaaaaaaagagctatccactcatgaaaagactacatactgtgtgattccaactctatgacattcaggaaagggaaaaaccatggagacagtaaaagataagtggttgccagggattgagaggaaggagggatgaataggtggggcccagaggatttttacggtaaactcctctgcatgataatgcaatggtggatccatgtcattatacacttgtccaagcccatagaatgtgcaacaccaaaagtgaaccctaaactatggacttgggaggatgatgtaccaatgtagtcaattgattgaaacaaatgtaccagtctggtggggggaagtcaatagtggaggaggctgtgcacgtgttggggtagggaggatatggaaactctactttttgggcaattttgccgtgaacataaaacagctctgaaaatataattaattaaaaaaatagttcaaaattcctttttgagacggagtctccaaaaaaaaacaaaaacaaa

SEQ ID NO: 232224 - DNA, 445 bp, Homo sapiens
cctgtaccatgcacccaaactggcaggtaaactgcaaaccaagggaacaagaagggcctaccactcctttaagacatttcatggcagctgcacgtacagctcccatttatatgccattggccacaatttggtcatacagccaacctagccataacagagggtggaaatgcattctttatacaatgcacccatgtactttgctgaaacttggggactctattactatagatttaaaaacagattgtgacccaaaaaaagtttttttaaaaaaatagaagagagtatcaaatagtgggggataaatagcagccccatcctaaagtttctctttccctttttcgtaacgaccaatgttatagtacttactaaggactgagtactctcctaaatattgttggttttgttttggttgattgattcattaaatcatttaatccttacaata

SEQ ID NO: 232225 - DNA, 497 bp, Homo sapiens
ccagctaaaatttgaagtttgaagtaaaagtctgaatactaagggaaaagataataatacatattgggagattacatatctgccaaaagacttctcctgatgttccaaacaccaccaagggagttttggatatatcagaataatctcagatgacactcatagcacacacctcttgaccagcagaaagccacagaacaaaacaggattagctccaaggcatagaagaaaggcatctgtgttgtgattttgggagttgataacattattaatagtctcttatttttttaactcttttccaagtttccattttgtagttcagaaattgtatatccattcttcatattaagacatgtatgtttatgtaacatatgcaagaaatttgaagactattagcaaagataatgaaagtgaaacccaaacgctatatagctcttaactcctcccatatttaatctttccactcttaaataaaggctagcataatggtgctgatttct

SEQ ID NO: 232226 - DNA, 129 bp, Homo sapiens
gggtccaggagctgccaaggaaaaccacagatctgcttgtttccatcgggagtcctgggaaccacgtgagtggtcactttaatcacctccgttaaagacatcttccataatcccctcctggcacttctc

SEQ ID NO: 232227 - DNA, 706 bp, Homo sapiens
aagcccttccatttgaatcctgagaaagacgcgctcaaagaacccagcgaacaaaggagagggttggagcccacgcaaaacatgggtgtgataaagccacacgcgacctgagcccccaccctcagtaactactctccagcgcccaccgggaggaggggtccggggaaaggattggcatcctctgcttctgcagaaaacatggctaccaacagcttctgtatccacctgcggaggagactgactgctctgttattcccccagcatctgtgaagaggctctgactggctaaagtgttggtatagtgatcaccccagggttaggcaaccatggctggtgaaaaggaaaaacgttatgaacctggctgtgcggagctacctgaggaagcttgtaggagaagggaaggagtctgtagctttaggggaagacagagccacaagatggaaggagcttggatgtctgaactattccatggagaaaagctgcaatgctgcatcttagtccagggatttttaaagtgtggttcctggaagagctggatcagagtcatctgtgttgatggtttaacataaagatttttgagccccaagactcaagtaggacaaggaatttgaatttttaagcagctcacctgacttgtctgtcctctaatgtctgaagacatctgacctctgctctttcagtaaaagcaacaatggttttaaaagca

SEQ ID NO: 232228 - DNA, 659 bp, Homo sapiens
aagcccttccatttgaatcctgagaaagacgcgctcaaagaacccagcgaacaaaggagagggttggagcccacgcaaaacatgggtgtgataaagccacacgcgacctgagcccccaccctcagtaactactctccagcgcccaccgggaggaggggtccggggaaaggattggcatcctctgcttctgcagaaaacatggctaccaacagcttctgtatccacctgcggaggagactgactgctctgttattcccccagcatctgtgaagaggctctgactggctaaagtgaaggagtctgtagctttaggggaagacagagccacaagatggaaggagcttggatgtctgaactattccatggagaaaagctgcagccaacgaagaacacctgcaatggactcttaacctgggggtgacgacaaccactgaaatatgctgcatcttagtccagggatttttaaagtgtggttcctggaagagctggatcagagtcatctgtgttgatggtttaacataaagatttttgagccccaagactcaagtaggacaaggaatttgaatttttaagcagctcacctgacttgtctgtcctctaatgtctgaagacatctgacctctgctctttcagtaaaagcaacaatggttttaaaagca

SEQ ID NO: 232229 - DNA, 459 bp, Homo sapiens
ctcacaaatgcaaatacaggaaagctttttgtaattgtaatacattcagcaaaaacaaaagcaagcaaagaataatttttccaaatcaagttgatagactgatatgcaagttgggaaataggatctttatatagagtttgatagacctcgattgagagacttttgtaagagtggctttatttttccccaggaaaagacattctggaacaagtttttatgtgaaaacaatctgtggttaagtgacttggagtgaaagctcaaactctagtgtaatctctgacttttgaatactttcttgaacctaaaaaatatgatcaaagctgtagtcatacaccagcagagacaaacagaagttgattcaccatggatgcaccaaaatctcagaaatcaccactaaagaacttattcatgtaaccaaataccacctcttcccccaaaacttattgaaataaaaaataa

SEQ ID NO: 232230 - DNA, 186 bp, Homo sapiens
tcccccgccctgtttttcttcttccccctctctgtctctgtctcttcctctctgttattctccttctcttttcctctctctggctttctttcttttctttctcttatttctttttttctctttcttctttctttttcctttctctctctctcacctccctccctctctccttccttccttcttctc

SEQ ID NO: 232231 - DNA, 366 bp, Homo sapiens
agacctagtaggaaaccttaacttccatccttatctcacaataaccaaggcagtgtccttgtttcctcactagctgggggtcaaaggaggcctgctaaacatgtttaaattagatataacgtttaaatgagatccagaatctcataataaaatacccaaaatgttcaggaatcaattgaaaatctctcattatactaagaatcgagaatatctcaactttaatgagaaaagaatcaataggcactaacactgagataacacacatattagaattacctgtcaataatttttaagcagccatcatgaaatgcatcataagtacttgcaaacacacttgaaacaaatggaaaaatagaaagtcttaga

SEQ ID NO: 232232 - DNA, 139 bp, Homo sapiens
caggggcctccaagggtgttctcagaagaaagggaggcatggaatccagattattcagcggaggctaatggtgtatctggcggggctcagcctgtgccgggcgccacgcgcgaattgaggtgtgaccgtgtgtcaggcc

SEQ ID NO: 232233 - DNA, 759 bp, Homo sapiens
atttgaaacaagatggagcaggaagggaggaaagaagggaaacagagaaagatgagagaaaatatccaacccctttcaagagagaaaaaatcatgatatgatttgcttgcctggtggcagagactgatccataatgaatcattcagacctttacttctgaccctcttgtgatgaagaatttagatttgtgagatggctggggtcaggtgggccaggagtggacagaggaagtaaataactaagttcagagtcattctgtagcacagattacagttcaggttttgctggaccaatcaggaaggttagaaaaatataacatcaataaccttgaccccgttgacactatctaaatccatcacaaaagaacagtatgttgtaagattcctgtaagtcgtaactaaagtcctgaccaggaccagcctactgattatgaatcagtgtcttggccaccaaccagtcctatctccctgggaattctgaatgagccaatgaacttggattcctagtaacattgatcaagccaagagatccctttccgcatgcaagtccacataatttctcacttagaaaggagccaatacagcaggagggagatttcaaaatagcagccatgacgaaacaagtgaaaattgtgtccatttttctttatctgttctgatgtaacttccagaatcattctttctgcatcttgacaccatttttaaagaaatttgttatccaagactgttaaatcataaataaaactcatcttattcagat

SEQ ID NO: 232234 - DNA, 611 bp, Homo sapiens
ggccaataatttttggattgtcatatttttcagttaggatattatcttcttgagagtttgcaacatgttttctagatttttggtagctctcttcataatttttaagaattatttattggttgattgattaataaagatattagtatatgtgttgatttaaagtgttaaatttaaaatggaattagatgagactaatggaacaggagaacttaggaaaggggacattataatactaaacaattagagatttgtgatgttcccctgggacaggctttgaaaaatcaccatggctgtgggtccttattaaccagccactcctcaaagagctgtctgcagcttcagaaagatacacagtgattgaaagcataatcattctgaatgaatattcagaaaacataaatatatatgctgatgtatatgtatgtgtctaacattcgcttatttgaggaacaaataaatgcttatttgaatttgttggtataaaatacctttttgtctatggtaatacagtgtgcccagaaggatgaaaaattcaagaataaagtaaagtactattcatccatatataatacagtattatatcgtatagtatagatctgaagcattcttgg

SEQ ID NO: 232235 - DNA, 133 bp, Homo sapiens
caagcaaagagggatttaatgcagacaattggttacagtgctcttagaaacacagaaagaacacaaaaaagaagagtgttataaagacactggaagctgcgattgaacctggactgaagcctagctgcccttg

SEQ ID NO: 232236 - DNA, 1023 bp, Homo sapiens
  misc_feature (11)..(11): n is a, c, g, or t
  misc_feature (19)..(20): n is a, c, g, or t
  misc_feature (24)..(24): n is a, c, g, or t
  misc_feature (38)..(38): n is a, c, g, or t
tggctaggtangaggcggnngttntagatatgcacggnttcgggggcacagctgccaccagcccgctcacggcagtcttcagcctctcccgcagcctgctggctgctgccctgctctacggtttctgccttggggccatcaagactccgtggccagagcagcacgtccctgtcctcttctcagtcttctgtggcctcctggtggcactgtcctaccacctgagccggcagagcagcgaccccaccgtgctctggtctctgatccggagcaagctgttccctgagctggaggagcgcagcttggagacagcccgggccgagcccccggaccccttgccggacaagatgcgccagtcggtgcgtgaggtcttgcactccgacctggtgatgtgtgtggtgatcgccgtgctcaccttcgccatcagcgccagcaccgtctttattgccctgaagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctactgccgggcgctgctgatgaccgtggctgggctgaagctgctgcgctcagccttctgctgccccccacagcagtacctgacgttggccttcaccgtctgtctcattttgataccgggctttccagggttcggtgaatatctctggcctgtttggcagtgggatgtggcagacgggtcggcggcaatggccgggaacggggcgttcccttgcacgtgggactgggtggtcagcggcgggttcacccacaagaggggtttcagcctgggaactgtgc

SEQ ID NO: 232237 - DNA, 476 bp, Homo sapiens
ccgatgcctgccccttgcccacagctgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaaggtgagttggtggctgtggcccagaccccaggctgtccaatgggagcagagccaacttctgcctgggtgggaagagaatttcctgacggtgtggccaccgctctgtagtcagccccgtgggcctttgcagcagcctctcaaggaaggggttacttccaccctctacagagaggaagcaggctgaaggaggttgagggacttgcctcaggcttccagagaattggtggtcagccaggatttgaacccaggcctgtctgaccccacgaccacctcct

SEQ ID NO: 232238 - DNA, 1222 bp, Homo sapiens
  misc_feature (11)..(11): n is a, c, g, or t
  misc_feature (19)..(20): n is a, c, g, or t
  misc_feature (24)..(24): n is a, c, g, or t
  misc_feature (38)..(38): n is a, c, g, or t
tggctaggtangaggcggnngttntagatatgcacggnttcgggggcacagctgccaccagcccgctcacggcagtcttcagcctctcccgcagcctgctggctgctgccctgctctacggtttctgccttggggccatcaagactccgtggccagagcagcacgtccctgtcctcttctcagtcttctgtggcctcctggtggcactgtcctaccacctgagccggcagagcagcgaccccaccgtgctctggtctctgatccggagcaagctgttccctgagctggaggagcgcagcttggagacagcccgggccgagcccccggaccccttgccggacaagatgcgccagtcggtgcgtgaggtcttgcactccgacctggtgatgtgtgtggtgatcgccgtgctcaccttcgccatcagcgccagcaccgtctttattgccctgaagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctactgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaagctgtgggacttgctgtacaagctgcgtttcgtgctgacctacatcgcgccctggcagatcacctggggctcggctttccacgcttttgcccagccgtttgccgtgccacactcggccatgctgttcgtccaggccctgctctcggggctcttctccacgcctctcaacccactgctaggcagtgccgtcttcatcatgtcctacgctcggcccctcaagttctgggagcgcgactacaacactaaacgtgtggatcattccaacacccgcctggtcacacagctggacaggaaccc

SEQ ID NO: 232239 - DNA, 575 bp, Homo sapiens
agatccatgtttcttgagtttttcttaaacgacagaagattttgcttcccagactagcatccctctgtggctacaaccagcctgaaccgaggggtctgccctttagaagggcccagctcacgggctcactgtgcactcaggccctagccagcctgctgtacgtaggtgtttgcgatttcatcattggccttgttttaacagacagcagagcagagcacctgccataaagcaagcctcgatgtgctaagtgccatgtggagcccttgccctgctggggctcgctgctcccatttgagctgccacagatcagcccctccccccagggtctccgaggagtcaggaccgcacagcctgccctcctagggaaggacttcctcagggaaggcaggcatgtggaagccaggtgcagagtcctggcctctccacacaggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttcta

SEQ ID NO: 232240 - DNA, 901 bp, Homo sapiens
agagtttggaaacttcgtaggaagttgtgggagacaccttggtttgtttgcttttgttttggggttcttaaatttagggattccacccttatcttgtgcagacacaaatcagatttttgtaattgcagatagatggaagtgtttgggcatcagaggaaggttccactggcccttcatccagtgggaccttctacacacagctattacgttctgctcgcaatggagacacccaagtaggttccactagccctgtcccacaagagcccagctattgcctggcagtatttctttaccaagaactgggctgccttggggaccaggtgggtgagcacaagggatgcctggcctctctgtcctgagaccccccttaattatgacccttacagccatgtccaccagcaacctggcaggcaagacaatggcacaacctcctttcactgcatttagggagaaaagggctggcctctctctgaaggagtgcagaaaatacacattattcaagcaagttagcatgaggcaagcctagagcttttacacagggctggatgttgagcagagagctgaggatgaggttggcattcttctcaggaaaatagcccaaagcccccaggatctaaaccttgcaggaaggaggccagacttggctgggctagaaggagcttttcttatgtcttcttaccccagcacccctaatttaaaatacagatccctgaggtgcgtctcaggtgttcaggaggccactcctgaacttttcctcttctgtgagggggtgggggacactgcagagggcatattgggtcccatggccccctacagctcactgcacaaaactctgctgggatcttgctacatatcccaagtaccaggccccccaggtctgaagtgggaccatgactccctg

SEQ ID NO: 232241 - DNA, 765 bp, Homo sapiens
aaaagatgtctataataaaatttatttataccagtggttctcaaaactgactgataatcagaaaaccctggggctctttcaaaaacaattaacaaaacaattctatttttagacccatgaatacatattttgggggaggaaggaggagggtatagatctgtattttgaaaagttccccaggtctccttgggaaattatatgaacaatcatgtttgggaacaaatgaatcatgttaccactgggaagaagtttgttatacatcctaaccaagaaacctaaatggttcttaagcatctgctagcagaaacagttataattatgaatacctaatgtctgttagattttgctgatccctcacctacctcaggaagaaacaaatccaaaaaagtaagatacggtcttttttatttgtgttaattaaaaaatgctactcctaaaaatatactaactttccacacttataaaggtgtttcttattttaaattcctcaatgagtgcggagaagacaacatagaagcttcttctctttctttctgtcttccttcaactctgtttctcttcttccttttatctttcctttcttttcttctttcctctgactggattgtttataacactttagaaaatttccctgactggaagagggccaatctgaatgagcttttgtctgtcttgggagtagaatgaaagcagattctgagcatggaccctgacttccagaaagactcccatctcctcctcagtgcctcactcttccctcagtat

SEQ ID NO: 232242 - DNA, 352 bp, Homo sapiens
ccaaatgtggcaaaaggagaaatctgtggggaagcaacagagacacttttcttaatatttaaatatttcattttcttcaggtagactttgaactctccagtctcatcttctttagagttaagacagacgtgtcagtcatcctagattttgttatgcctaaagtgtgaattaattttgagtggactacagtaattgtgctaaccatttgtttgaagagaagacataagagttcctttgtgacctgtggaaatacagaaacagccaacattacgaagttgccgccaggcatggacttgagggatcccatcccccatgtccctgaaccagaatgccagggattcccttccatggc

SEQ ID NO: 232243 - DNA, 2019 bp, Homo sapiens
  misc_feature (1984)..(1984): n is a, c, g, or t
tttcacttttcgctaaagtcacattccggcagcaattttatgctgtcaaaatgttctcaacaaggggagatttgactggcttctctgagaaccagtcataggaagcttgggctctgcttcttattgagttcttttttaaaattttgctgggggtccgggggaagaaggaaaaaaagcaacaacaataacgagaaacaagtcacccaggcatcttgtggagggtggctgctcttttcaggccggcggccagtccccgggcgtacagcgtgcggtgcaacctgcagctgcgggacgggtgcattcacgaggggggtgtgtgcgcctgggggtcacccctgctgtctctctgggtaggggtgcaggtgaagctcacatgtgccactctgtgagtgtcaccgcgagggaaaccctcccaggggcccgggcccagggtggccacggtgaggaggaggaggaccacatgcgcagggaagggcatggggcacagcatgtgtgtggcccacacaagggcggtctgctctcactcccctcgctgctctgtaattaagctcggctgcgcccactcaggcttccagacctttccctgagccctccgccccccgggcccactccccgttctcccagccttgctggctacttccactccccaaagagccttcaggggccttcttgtcgttgatcaaaacaacagggccaccagctcctcaagagtccaagctatagtttggcccaaatgtcccggccagggtggctctgtgtcaaaggccctgcagctcctccctcctgtttctctgggccctctctttggggttctggttcccgattaaaccttgacctctctagcacatgccttttgccacctcccccactggtcctggctcttccttccccgctgaaatgagttgaggctgagacctgggaagccgcaaggtgctgggatcccagacgagtccctcctgaaagggcgaaactcagtcgttcagggagaaagggaccacagccaacccaccacacaggtggagcccatggacaaggtctcattccagtggcccggtgtcacagcgtgtcctcatttgcagctaggatgaatgccaattaccaccaccccataggaaagctgcccccctggccagcaccagcccaggcgcctgttaggttttagttcactcactcctctctgcaaccccataggatacgagttaccgattctatgtcacaaattggaagagtgaggctcagagaggcaaggccacttgcccaatgtctcacagtggctcagtgtcgaggcaaggcctgtgtatcttccccattcccagaacctgctggaagtcaagggcagcacttcaggccccagctctgccccgttccagtgaggaacctgaagccagcacagcccctcccactaatccatgcgccccagcccgggcttcagctccacatctgtataatgggagagtgaggtcctggggatctatggctccttctggcttatgcctgtgtaacagatgggagagaaatgaagatagggctgagggtccccccaagccagggctttgaggcagtgtctccccagggcagccacaccatggtggagaccctgaaggcaacaggctgggaggccaagcagagctcagaagaggtgggagagaagggtctagaagcaggaggtggaggaagagaaactgcaaattgcgggtaggaagtgcttagtaaaatcagaaaaatttcagggcacaatcgctcatgcctgtaatccccgcactttgggatgccaaggcgggtggattgcttgaggccaggagttcaagaccagcctgggcaatacagtgagaccctgtgtctccacaaaaaaaatttttttttaaaattagctggttgcggtggcgcacacctgtagttctggctccttgggaggctaaagtgggaggattacttgagcccaggaggtggaggctgcagtgagctatgatcgcttcactgcacnccagcctgggcgacagggtgagaccctgtctggac

SEQ ID NO: 232244 - DNA, 486 bp, Homo sapiens
cactgagcataaaactgatatgacctcactaaagctaaaaaactgaagtagacaaaggcttggttttcaaagaattgaataattgggggtggtaggggactgatgcttaaagcaacaaactataatataagatagaataaataaatgctaaaaagggaggtggggtttgaccaggagaggacttaaggaggtgaggatgtgtaatagtggcatttaaggacacatagtttttcataactgaacagagcagtaaaagattattctgaatgtgaaattgcacatcatgttagatgagtaacaagttgtcagctttttgtcttgagcatgggatgagttgtgggagcttaggctgcaaaattggaatggaggcagaactgtcatgcagatagcttcactacatggtcaaagagctgatatgaagcctaagacaaaaatgcacctgggctatcttatggatgcagtcactgctaagaactaaagcaaaaa

SEQ ID NO: 232245 - DNA, 333 bp, Homo sapiens
tcctttttaaggcaaagtaatattctgttgtatgtacaggttgagtatccctaattccaaaatcaaaatgctcttaaatatgaaacttttggagcactgacacgacactcaaaagaaatgctcattgaagcatcttggatttgggatttgcaaatctctgtgggatcctgctttccattggtttgggtatatacctggaagtgatactgctagatcatacggtaattctatttttaattttttgagaaaccacagtaccatttttcatagtgagtacaccctttaaaattactccttttttttttttatttttattttttgagacagtatctc

SEQ ID NO: 232246 - DNA, 149 bp, Homo sapiens
ccctccccccccccccggcaccccccggtcaggctctactcttgggcgcttgtgattctctgaacactgttccctctgcaggaatgtccttccggactttcccagcctgatggcttttttcttaatatgagtcatgtttgctcctcaca

SEQ ID NO: 232247 - DNA, 380 bp, Homo sapiens
tcatgtggtggttaggatttaatgcattcgtggatgtaaagtacttacaatatgacctagcagagagtaagcactcggtaaaaaagaaaagctctctagttgaaaaaaccttgtttttgccttataggaatgtggtcgtccctaatgggctaccacagtaatgaggacttttgagagagagactttttggtataataaaataatttcctactgaaatggactgtgggactttgcttgtaaatgactccgccctaatgtatctgccgtatagtatttacaagtttgggatttcatgctattaatagaacaaaccataacatttttccttatttaaaatccagtttctccattttctcgtagcatgtgagcaggataggtag

SEQ ID NO: 232248 - DNA, 217 bp, Homo sapiens
ttcttgggccacacctaagtatgtgcagggcctgtgatacagccagaatttcctcctctgataaacttctctgagcctttctacttgtctttaacccttttattgtctaaatgctcactaaacaagaaaaataatacagggaacttggtttaggggtattggtagaagttaaagttgatggcagagcatgaataggggtgtctgcaaggaattgttg

SEQ ID NO: 232249 - DNA, 347 bp, Homo sapiens
ccacatttgcacagattatcactgtgaccccaaattgaatccaataaaagtattacatgcatataaataatacatatgtatgcatatatcagcaggcaatgctcactgtgaataaatatataaatatatttgttcactttcaaatgaaataactttcaagcatttttgatacttaataaatcacagcattcaaataaaccactaaaatgttttatgacttgtaacacaagagtagcatcagcaattagtttcaatgctttaatcttcaattatatgaggtggacatagaaggaaataaaaaaattaatgtagctaattgagaagataacaaagtattcccaagtaaa

SEQ ID NO: 232250 - DNA, 343 bp, Homo sapiens
ctggaattttacttccctttggtatggattgttgaagacaggaaatttgaatcatctgttaattccttttttctaaataagggcccttaagttaatacattgagcacacctgcatctctgcagaaggccaagcatcaggactctgacttgtcttcctcactttgagacagccattggccagcccattgatacagatgatggacatgttactttatagaaacagctcttacctgaaactcctcattttctgtttggtaatcactccttggcattctgaccacacacaaccatattgcttatgaaatgctagattgcccctcaagctgtgtcagtattcctttct

SEQ ID NO: 232251 - DNA, 424 bp, Homo sapiens
gcaaatttattcttaaaaagtatggtaatcatggccacaattgctgtaagcaatgggaaagcagtatctgtatcattaataccactatgatctgagtgcgcttgagctagaattcatgagaattctgctaatattatggttatggtgtttataacacgtttcactcaggaggtatgcttcttgcctggacctctagatatttctgcagaggacagagtgaaacaactgaggttggactagagtaacatgtccaacttcctgcatgttattcatgccagggtgtctttgggcaggaccgggtaacaagagcttagaagatgaatttcccatactgagtaaatttatttaccccttccctatcatatacacagatgagatggcgctgcctttcaggtgatttggtttgtgaaacagtaagtgtctg

SEQ ID NO: 232252 - DNA, 635 bp, Homo sapiens
ctgtgtccttatatattccctaaaagattaagaaaaacggatcaatcatctatttgcttttttagacaacggagaaagtccttgcaattgcatcatggtcatttactctggaattattatcactaaatttttttatttaaacaatattttgtagttaaaaaactccccaaataatctcaaaaagttatagtaggaattaaattgtgatagattaaaataaacagtgcagtggtccaaaagaccatttttctttatcttaattctgttttcccaaactaaattcgtattcatttacaatctcctaaatctctcactatagtagcaggaatttaaaacaaagactctacaaatgaccataaccataattaaaatgcagccatcacttttttttttttttttttttggaaaattgaaaaacaagtgaaatttcactgtggagataggcctactacaaagaggacattaactagccttgaatcacttgtttatttttgtctttaaacgtgtttggaggtttggatccactaaatcctagctgttcatttcaacgaaggtcgaggaagcaagaaggctcttccaaaacagcttcggggttaaagaaggagtacagttttcaacaatcttaagtcaaacat

SEQ ID NO: 232253 - DNA, 311 bp, Homo sapiens
ccaggccaggggaggagcaactccaccatgagggcttggccctcatgcctcctcctgcccagctctgcatggcatgtccctctggccttagctgccccagctgcatgtggcctcaggccagccccacccagccctcttgcttcctgtggccctgtagagtggctaccaggacccctgctggtgagggcgggtgcgggtggcctgtctccgagctgggctttcctccagcatggtcaccccctcacccgctcagttacctctgatatgctgtgcaaacatatttctcgatgaaatgctgggaagaaaaataa

SEQ ID NO: 232254 - DNA, 582 bp, Homo sapiens
ttctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgataccttcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcac

SEQ ID NO: 232255 - DNA, 502 bp, Homo sapiens
aaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaa

SEQ ID NO: 232256 - DNA, 573 bp, Homo sapiens
gccctggggaaacagtccctgcagagacgctgcctgcttcagagccctggtgtggcctcctggcaggatatctatagcccaagagtcactagatttgcttccatcaccctgctagaaaattcattaaagtgaacacctcccagcattaggggtgtctgtgtgtgaatctctgtttgggagagactgtgacggccgagaggaagcacatggagatcacagtggtgtgtggtgtgcagcatggggaccagtcctgctcttgcccgagcctcattccttctccctaatacatggcatcacagttccagcccagaatccttcagaagtccatgctgatgttggaggatgaatatagggtgtctgccccatgggtgttttttagttcacaacatgaaacccttataataacttaatgtgcaatattactaacagcctttagtttctagacaggcagtgtagtgtaatggctaagaacatgaatgctggagccagatattcattcaaatcctgtgccttaatggtttcttaggtatgggacaaaaagcacacataaagaacacttaaactttgcttaaa

SEQ ID NO: 232257 - DNA, 996 bp, Homo sapiens
tggaacatgggagagaactcaaaatagctgcccagtcctcagaagctctcagatcctaggctcttgcaggaaagttttcagaagaattatagccagcttttctggggcctcccctctctgcacagtgaatctctggtggctaatgcctgggtcactgactgtatgtaagggtcttacatccttacatcaatgaaatgtccaatgtctgcccaattcaaagggagactacaatgtccccactgcttttccaggcccagcccctgtcccatctggggcctgagtcccaaccctttatttcatccacaccccaattccggcccacacctatggctcaggcccatcttcaatcctctttcccagtcctatctcctgcttttccatccccgatgaagaacactggagtagcttgccctgcgtcgcagaataaagtgcaagctctctccctacctgaaactcagcaccctgaatggcctttgttgaggaaacaactataaggtgggttggctttaccccctagggtccaaaaatctcaggacatctttagtgtctccactcctaaccttccccaggaaaggggacacccattctgcctgagaactttccagtcagtcctgaactccagagcaacatattgaaaagtggttcattcaacaccagggcaagattcaagagtctctggatctgatgcagctttgggatgaattgccagggaaaagtcaggcgaagggcaaacccaggtcctggcagtcctccatgtccacaggtgaaagcagcaaggaggcacagaaggtgaagttccagctagagagggacctgtgcccacatctggggcaaattctgggtgaggccccgcaaaatctatccaggggcatagaaagcttcccagggaagactctgggggtgacctctgaagagtcagaaaggaacttgaggaagcccttgaggagtgactcggtagggatttattaagactcacggacaggaatcatatagaaa

SEQ ID NO: 232258 - DNA, 349 bp, Homo sapiens
  misc_feature (84)..(84): n is a, c, g, or t
ctatgtatcggtctttgtctcagtcagcttgggctgctatcatcaaatggcatagacagggtggctttaacaactcacatttantttctcacagttctggaggctgtgaagtataagatcagggtgccagcatggttctggtaaattgaagttcatgaaataatgagaccttttataaaagacagtggcataaatacaaaatataccacgaacatttcccttaagaaatgtttcacagagtagcatattggtgtaattacacataagactgattcagcattataattacaaaactgttttcataggattcagtgttaattcaggctctcaatatgttgccaaagtctgc

SEQ ID NO: 232259 - DNA, 290 bp, Homo sapiens
gtagagacgaggtttcaccgtgttagccaggatggtctggatcttctgacctcgtgatccgcccgccttggcctcccaaagtgctgggattaaaagtgtgagccaccatgcccggcctagagctcttttttctaagaaaaaatccttttaaggccaggcacggtgggtcattgaatcgtgaattcaatgggtggtctctgagcagtcaccctgaatcaggcctgttaaacttctttcagggctcactgaatgtgactagataaataaggagtgttctccaagttaggcct

SEQ ID NO: 232260 - DNA, 633 bp, Homo sapiens
gagctatttacatttcttattggttatttacatttccatgcatggttttctggcttatgatgtgaaattttgtactttggatagttacaaaggatgcaataaaccaacaaccagtctctttagtttttcattatggaatacatacttttttttttaaaggaaaagatatcacatgttatctgtaattgaaatcagatagatggctaccagacacagtaatatggagagtatatttttgtttttttggctaaaacaaacaaaaaacccaggtaattaagcttagaagtctagttttttattctgtatctatgacaagtggtactcagttatttgaactaaaggagataaaagcagagtaattacttaatgtttaatttaggaaacccagacaaggcttatgtaataataaactgaggatttttagcaccttcatttaggaagggataaaatcccttctctttttcacttatattcaaattgtgtttggtgttctatccggttctagtttcttcaggctaggccatttcttttctgtataatttagatggattggactgaattaaactaccacatgtcatttggtgtttctttactttttcttttctgagatcatctgtggctgatacatctctg

SEQ ID NO: 232261 - DNA, 976 bp, Homo sapiens
  misc_feature (800)..(800): n is a, c, g, or t
atgtggatgctgggagaagtatgtgagatggaaaagttgtttcatggcatccaagaagtgaatgatcctcaagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccacngagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 232262 - DNA, 1004 bp, Homo sapiens
  misc_feature (828)..(828): n is a, c, g, or t
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccacngagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 232263 - DNA, 1094 bp, Homo sapiens
  misc_feature (790)..(790): n is a, c, g, or t
  misc_feature (918)..(918): n is a, c, g, or t
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagccaggtggaggaaccactgagtcaggagagcgaggtggaggaaccactgagtcaggagagcgaggtggangaaccactgagtcaggagagccaggtggaggaaccactgagtcaggagagcgagatggaagaaccactgagtcaggagagccagatggaagaaccactgagtcaggagagccaggtggaggaaccacngagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 232264 - DNA, 449 bp, Homo sapiens
gacttgcctgaagaggcgtggcaatgcagggatattggttaaacttgctttggaagcctgagcgtctggcagggttgcaggagggtgtgggggagagcagagactctggagctctgccgactttgaatctcatctctactgcttcccagctatgtgaccttcagctgttgcccaactggtctgagtcttgggtttctcaactgcaaaatggagaggatttgtgtaaacagttagcacagtgcctggaatgttgagtgtggtggtgaggaagagggactttgcagccagactgcctggtttgaaccccggctccactgcctgggctggttacttagcctccctgtacctcagtttcttaatctgtataatggggatactaatggtacctatgtcctaggattgttgtggaaggcaacgaatccatatatgtaaaatgcttagaaaaactt

SEQ ID NO: 232265 - DNA, 546 bp, Homo sapiens
ttctccctccttcctcctaacagactgataaaaacctgtgttccctaatgcctttgttttttgaagaagctataaagagcatctggtgttttctgcatgttctccctcttccctccaggtccctcactccatccccttcttttccctcccatatttgacctagatgcaaccactcaccccactgcagagacagagaaccttcccattctcagccagagaaagacatccgtggcctgaatggtgctgctggacccacagtgactctacataaaggctgtccctaggtaggggtagagctagtggctgaaggggaggaggaggactctgaaagaggcctcctgtggagcaggtaagcatcagagcaccctagggtgcagccaagggcaagtcatcccacctttctgagcctcagcttcctcacttgtacaatggggctactaaaaatagctactgcattcaattgctataaggatggcatagtgcctgaaaagggacctggcgttgagaaagcccctaataaataatagttattattatattgtaaaa

SEQ ID NO: 232266 - DNA, 544 bp, Homo sapiens
ttggatatttgtagtttttcactgatttttctctctgcataaagagctaatagctcattgtctataaatattttccaacattttgttttccaaaatggactcatttctacataaagacgtcatggaaagatggtttttcttcctgaagggttaggtcagccctgggaagaagtatagaccttggctcctgttattcctctttagatatcccagggttccaacaggaagttacaagatacctgcactacctgtaaagtttatttaaaatgattggaaggctctcataagcattggaggggaagaaaaactttttttctaccctcttaggtgaagtgcctaggagcctgtgaattaaacttacagcagacagactagcaggagaaaaagcttacaaagttatttattttaaattttgcttgcacaagggtgtcatagaaagaaatgaataccccaaggagtgatgagatttgattttctgtatcattttactacaggaaagggaggtggagaaaaggcaatattgagagagcaaatgacttcttta

SEQ ID NO: 232267 - DNA, 757 bp, Homo sapiens
tgttagagaacagaatagagaacagtacccagtatatgttctttgaatcgaataatggacccaactgtacagagaaatggaagggaatattctaagaggctgttctattttactttgtaagtcttttcttttaatggaggtataactaattcagtaatttaaaaatcacatatccctgttgttaatggactcatgagtgcagggatggcagaaacaaatcagataatgtacctgattctttcattgtgacagctgctatcaagttgtaaattagagccagccacaaggaagctgtgttaggtcagtccaatgactaatgtcatgtaataaatggctacttggtgcacaaatgactttcttggaacctacaagagttgtcaattctcatggtaatttgtgcattcgtaattttgtgtttgggaaaatgttgctagataagccttatttgatattagaaaataaacatttattgtttctactgaggaaactcagattttcttttgtaaaatgtacaggactgtgttatgttgcattttaggagataaaataggcagaaggaacgatttcaagcatttgcgtaagatactgttctttcaaagaccttctcaggcataaaagtccataatataattctgacaagaaactcttttagttacaaataattccatagtaaatatgatatgacactggctgatattcctgaaataccatgttacaaaaacctctagaatctaaacatagaaaatgatttccttta

SEQ ID NO: 232268 - DNA, 458 bp, Homo sapiens
gatggatgtaaatgttggatggtgggtcaagggtagaggtctgtagttagtcatactcttttgtcctgtcaaaatgtaaagggtgaggaaagtcctgtggcttttagatttctataatttaacgtgtagtggtaaaacagatttagaggtttgcagtataaaatgaggaaaaaagtaggctgggagcagtggagcacacctgtaatcccagcactttgggaggctgaggcaggtggatcacctgaggtcaggagttcaagaccagcctggccaacatggtgaaaccccatctctactaaaaatacaaaaaccaggcatggtggcataaaataggggagattatcctggatttccctgcaggcccagtctaatcacatgaacccttaaaagcaaagaataatccacagctggaggcaacaattcaatgccctgttgctgcttctgagatgtagggtttg

SEQ ID NO: 232269 - DNA, 453 bp, Homo sapiens
ctctggggattttatttaatacaccacttagaagttgaattaaacccaactcttgagacttgctgaagtctatcctgcccccggccatcttttaaagtgttttttatatggaccccagggctttatttggcacattttttttttaattacttctttgtaaccaggcagtaactacctgaataagtataatttaaaaggacaaagagctaatgacggcattgtcttgtagctccaatttgtcctcggacatgtgctatataccttgttactagtccacccccagggccttgcactaaataccttcacggatatacaacatgagagcatgggaagaacttgggagtggccgcttttatggctctcaaatggtgaattcatacctatgtgaacctttggactctcctagttggtgacacatggaaatggcacatggacacatggaccttttattaa

SEQ ID NO: 232270 - DNA, 560 bp, Homo sapiens
aattacatctctagtgaggtctctcaacattaccgttgtactgactttgggaaccagataatgctttgtagtgggggcggccatgtgtactgaagttaaaagactgagaacatgcacaaagatagatattatttctgatgtatttagttatttatattagctacaaaaatttgtaataacttacacatccaaaaataaatgtagactgaaccactaaaatcctatttatgcaagtatctttggacttcacgtttctgaaagttgcgtcttcgttcggatctatctggggcttggtgttgatgggcccatgtctacgctgtggaatctcaccggctgggaggacatcttatggttctactcacagggaggttttaaactgagacccataggctaagccattgttaaccaggcgaaggacaactgtgcataaagggagtatctctggcagagagacaagcatgtgtgtgggaagatgtaagtacctttgataatttctccaaaaaacttagtggtctcaacgaaaagctcctatttccatcaataaaatatgaaaacaacta

SEQ ID NO: 232271 - DNA, 779 bp, Homo sapiens
tagctgggagaagaccagtggtgtagaagtttgtaacctctcagaggaaattcaggatgctggtgggtgcctaggggaggtctctgctcagaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaattttgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatg

SEQ ID NO: 232272 - DNA, 358 bp, Homo sapiens
aaaaaaaaaaagaaaggccaccgctttactttagctaacaagagatgatatttcacaatacagtgacaaatggggccctaattgaggaatttgttaacagcccttccccttatagtggcattagcccaatttggccttagctgtaccactcacacagcttatattctgcaggatttagcgccaagaagacggggaatttaactcaataattaaacctccaaattgtcatgtcagcctgtgtatctctctctcctacctcctatccatgcctcagtttctctcggtaggagcacaggggaaagtcaccaatcagtccagtaatcaacatgtaggaattgagcaaggcttgagtggtgtg

SEQ ID NO: 232273 - DNA, 427 bp, Homo sapiens
cggtagatgcccctctccctctgtcagagctgagcatggcacttgtaaatagcgtcttcctggaagtgctgggtagggaacacctgtgggggctgttgctcaccccctcttcagggaacgctggtgctcatatttatgtatttggtggcctgaggggaggtactacttcacttgaattggatgtgtgctgctcatgtctttttggagtgtgttctgtgccttttgacagctttcagctttctcctcctcttcaggacctgttaaaggtttcagccctcctctcacaggctagggggcggtcaggatccccgtaccacaaggtgctggggggtatgtgggggctttttcttcatcgtgttcaggtgaatacaagtgtggcctctgtactgggatgctttctttcaccaagcaacctcattacattaaa

SEQ ID NO: 232274 - DNA, 418 bp, Homo sapiens
aactctagctctgcacaaatccattaggcaggctggcggggcgttattttacaaagggactcgcttctacaaagaaagacaaaagcttggtgcaaacaggcgtcttgactgacttccacctctccctacggtccccttcacagatcacaaacaaataaagcccaaaggacctcagccaaggatctccagatccaattttacagatggcgaaactgagacctcaagcaagactcaaattgatttttgtcaatattccccgaagtcagaggttgagaccctctttgagaccaaagatccaggcgggagtggagttctctttaaagtcgccaacaaccacgccaaaatgtccctttcccctgccccccattgcaagtgtttgattcaaagtcaaatggaaattggtttcagcagttgaaaa

SEQ ID NO: 232275 - DNA, 375 bp, Homo sapiens
gaaatattttttaaaattaacaaattaagaaaaactgtacacactgtttgtattatcccctcagagctgtattcttggcagttgaatctctagttggacttgtcagaagatattttggaggacgctttcttgagcaacacagtagttacactggcaactctacaaacatgtagtgctgtctctgtattttttagtgtgtgttctttgatttattttaaaccatggacatatgaagttataccaccaaatattagcaggtcattcctaaataataacagaacggaaacagtaatagtttacatttacttttccttaatcatagtatctaaaggtgctgtattagtctgggtccaataacgagatttaaaccacact

SEQ ID NO: 232276 - DNA, 266 bp, Homo sapiens
gactctccatcctggaacaccgggcatgacctgactcgcctttgcctcgccgttccctctgcctgcgatgctgtttccccgaccacacaggcctccctggctcctggcctcctccagtcttttctcagggtcttctccgtgaggcccctctgacaaccccgttcacattcctaaccagcacccagcagcctgtctcattgtctcttactggaatgtgtgtttgcacggcagggattttccccctgctgtgtggtgatggatcccca

SEQ ID NO: 232277 - DNA, 394 bp, Homo sapiens
tggctctgtgacagccaagcctctgtctgccatagagtttggcggtgggaagggaggcggactgcactcccgcacactggtggggcaaggaaatcaaaacccactcttgcatacatgtgccagcaaagtgatgtggggagttgctgtgggcccaggggaagctgcagtgtagggagggaatgtgtgggctggtgcatggctacaggggctaccttgctgaaactctctgccagtcaggcacggtctgtcagtgcagttggtgtagtgcaggcctccagggaacctgagattgcccagcaagcaggcatgggtatgctggggccttgggagaggccagcagaccaaggggagctcaagtcggaccggcctcatctgatggggaagaccaccctgc

SEQ ID NO: 232278 - DNA, 507 bp, Homo sapiens
aactgaagtaaatgtttttgaaatacagttgacttaccaaatgaatatagttttatggtgtatacttttacttctctaaaaaaaaaaagtatactttccattgttggctcttttccattgttggctcagttcttttccattgaatgtatgcagccttaatagaaaacgtttcttggtattgcaaagtctgttaggttacaggctggttgaaggaaggaaggaacctacaataataagtgtaaagccacagaaggaagagcagacagtggctgagtgaaagctggagaggatgtcgggctcagatgaggggaagggatgggagtgtcggcagtttttaaggaatctgagaaaacaaagcctaagtgttggagtcgtgccccattttggtcctcgtgatgccatcaacaagcatgtatttggcatatatttcactggagatgctaggtgtttgggggactttgaggataagagataccccttcctgtcgagaagtttggaatataattg

SEQ ID NO: 232279 - DNA, 1034 bp, Homo sapiens
agtggctttatgtgtccatgtaaagggacgtcagctggaatagcactcttggcctccgtccatccctttgcacaccccacccatgagaaggaggagtgacttattggcaagtttaggagaggaaccaggtaattcagctgctgtcctaagagcactaattctggtccgctcccccagatctgctcctccatgccatcagcccttcatgggcagtttcccaggaggggagcctctggctatccagtgatgcttgtgactcagaggtaagtctctgaaatcctggggttcaatttgctgctacgaactaagttgcatcctccaactgtctgatgttttgatccccatgtatctgaccaccctctgtctatctcaattggttcaaaagttgggtgaggaaaaggaaggctcttcagtgggtctcctcaggccccaacagtgcatggaatgattggtaggtggaaagaactaagggatggaaaccaatcagaaggtctgccaggcgtcatgatgtgtgatgaggactcagattagtgttgaggactcagattagtgtgatagtggcaataaagagaaagtgggacttgtgaaaaggaaaagaaaggctgtaattggggatagatggaggataatggatgaaggaaagggaaaatctaagtgaaggcccaccatctggaatgctctttaccccttcctgccgtctctgaatatcaattctatcctgtcttcaaagtctacctcagataccacctccttctcaagacttttaagaacttcccaggcaaaagccctctctttcttctcttgcgtgttagaaggctctgagtactttatgctgcatattgcagatactttggggcccatcttttctccactatgggctataaactctgttgacacgatctgtgtctgattggtttggtatctccacagattgtagcaaagtcctttgctgatacagtcaacaatatttatggagctagcctctggtattcaggaaggagagagatatcaaggttcctgttctcaggaggaga

SEQ ID NO: 232280 - DNA, 508 bp, Homo sapiens
acatgtactatgtgcgaacatgtactatgtgcgaacatgtactatgtgcctgccatgtgtgggcttgaatactctagcatttgagtaggggagcaggcaacaaacaaatcaatatttgggataatatcagttagtgctaagtgcaaggaagaaaaataaagcagatcagccttaagaataattttgtgtttaaatatacatcttccatttcagtatttgtgtatggttaaaatatgcttttatttatgttatgtaatttagtcctcaacatactttaagaggagacagggctaatattatacctatttgatgaataagtaaactgaggtacaaagaggttatgtgatttatcaagttacaaagcaagttgtggatttgcaactgcgttctttcctgtccagtgatttatctctaaagtattctttttataagtaaaattcttatatttgtttaaaaaaaagctgctgtggactataatgataaaaataaaaataaaccatatatcatg

SEQ ID NO: 232281 - DNA, 549 bp, Homo sapiens
caggagattgcaggaaataatttccaacagcaaatgagacattaattattcaatgcagataaacatcaacaacagcgcttcatccaaaggaattccactgggatccaggggctctgagttggagcccagttcggtcctctactcatggtgacctcagacacagtctctgtgtctcgggctcactgctgtaaaatcatgcggcctgtcgatgggtccatgtcacttgcagcatcttagtcctcattctggaggacacgtgccctcttagcagtgagccctggaggggctgactcgcagtgtctgctgtgttttccagtttccatgatgtaaatgcaccagggctgattctgggctgccagtgttttgacaattgatttgcagactgcgtgaaaatttaaaactcagctctcttgagctgatatgagccaccccagcccacccctgcagcaggcacgaacgttagtttgcagggagaggccagctgagctgctgcacagacctgctgggatcatcacagctgtgcgcttcaggccagtgcctcttcctgta

SEQ ID NO: 232282 - DNA, 248 bp, Homo sapiens
tttagaggttgctctagagattacaaatacacttttgactgattaccacccccctccagccttttgttctacagttgtcgtatttttgtttccacatattttaaatcccacaagccacaactattattttaaacagtcagaatttgtatttactcacatttatccttaccattgttcatttctttctgcagttctttgcttttatctgttattttcttgcaacacaaagaacttgctttaatattctc

SEQ ID NO: 232283 - DNA, 681 bp, Homo sapiens
cagtcatgccctgcctcttcctgagaatgccagcgacatttcttgggaggtgggattgggatggcggtggctcggggaccttggccatctcattggctcctgctcaccagtttcctgctgctccccagggcccttgttccagcggttcctccaccctcctcctctcaaatcccatgtgcctgccccaggcagcccaggccttctccctcgtgcccacggtgacaggcagcacagcgagtggtgacaccgcagggtcagcctccctgtcccccggcccctcgatcagtctcctctgcctttggggagagctgagggcctccgtgccctggcagaggagcctgaggagtcagaggtggcctcctatggtgttgccccacagcgcagccctggaagggaggctgagggcagctcttgcctagcatggtcccttgacaaatggtcctgggtgacaaagtcgcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagtccccggggaagcaggtccaccactaggcccattcgacagatagcagcacaatcaccgtcac

SEQ ID NO: 232284 - DNA, 591 bp, Homo sapiens
tggagcatggtttcaaaatttgaggcaattagaagcaatgccacaatggattcactttaagatttatttagtgtagtgttttttaaaaatgaattacttgatcccttctaataatactgagaaattgctctttttgccaaattgttttcaatatcagaactatgcattctcatcaatagcaaacaggaatgtcagtttctcaacattctcaccaatatttgatgccatcagtcttttcgaacttggccaatctgtgaagcaaaagcatctgtcactgctgttaatttaaagtcttttcatgtattgtttggtcatttctatttctttggtgacatttccattcgtatcttttgaccatgttctaatggcatgtttgtcttcttgttgaatttttggatctctttatatagtttggttatttatcctttgccttatacgatgtaatattttctgtaagtctgcaatttatcttttaattttatttacggtatcttttgttgtacatagttaaaaattctaaagtaatcatctctgccagtcttttataatacctgaatttcttttcataagaagctcttctccaccatgaga

SEQ ID NO: 232285 - DNA, 485 bp, Homo sapiens
ttgtcttgcttttgccctggtggtctttatttccatattctaagcttttctgaccaaatattttggtttgctattaatattttaaaagaccattacaacagtagccaagaggtggaaacaatcaaagtgtccatcgttggatgaatggatgatcagattttggtacataaacaataatggaatattcaggtaaaagaaggaaggacatttaagtgaaataagccagtctcaaaaaggcacctctttataagtgtgattccacttataagaggtatctagagtagttcatttcatgagttgccaggaactagggtgaggaggaatgggagttcttgtttaatgagtatagattattcattttttaggatgaagagaattctggggatgggtagtaccaatggcgaatatacttcctatcactgaactgtacacttaaaaatggttaaattggtccatttcatgttatatgtattttatcacaatta

SEQ ID NO: 232286 - DNA, 428 bp, Homo sapiens
tcaacatctttctttgagctccatgtttttccctcttactgttccagttgcatgacagaattcaggagtttgatgcaggtgaacagtaggaaaattataaagagagaggctgggtgcggtgactcacgcctgtaatcccagcactttgggaggccaaggtgggcagatcacttgagatcaggagtttgagaatagcctggccaacatggtgaaaccctgtctctactaaaaatatgaaaactagccaggggtggtggcgggcacctgtagtcccagctacaggagggaggctgaagcaagaggttcgcttgaacctggaaggtggagattgcagtgagctgagatcacaccactgcactctagcctgggcgacagaacgagactccatctcaatgaaaataaataaataaataaataaataaataaat

SEQ ID NO: 232287 - DNA, 1328 bp, Homo sapiens
gatgtcagagaaccagtgactgagtgcagaggtgacttcacaccagcatctgctgtagccagaggtgggctgcaagagggaattagaggagccaacatgtcctctttctcctttagggtccatggagcagtccgctgcttccaggttgcctgtggggtccttcccagctctccgccctgacacgtcttcactccctagcactcgtggagctgactgggtggggacctcagtgttgactgaaagcgtgaatcaagtgccaggcactggtgacagagcacacagaggctgctgggcctcccaaggtcggggagcttgtggggaattcacattcttggttccgggactgattcactgagtcaatcaatattgattgagcacttagttggttgtggtggtggtaggaatgaattcctgggcttcctgcagcccctttccatgaatctatacatatcaaacatgtgcatgcatttgtaaacattaatgggagtgtactttacttttttcattttactcataaacagacgaggactttaaaaaaatcacaattattaaataattcccattactatacctgacaaaactaataataatttcataatagctaataccccgtcaatccatgccatattttccctcatctaaaaaacagaaaaaattacttttttttcccccaaagacagggtcttgatcagagctcactgcaatatcaaactcctgggttcaagtgatcctcctgtctcagcctctggagtagctgggattataggcatgcaccaccatgcctggctactttttgtagagaaaaaaatttaaaaaggtctcactatgtggcccagagtgttcttgaattcctggcctcaagcaatcttcctgcctcagtttcccaaagcactgagattacaggcatgagccaccatgcccagccaaaactttacttttttacacttgcttttctggaatcaggatctaaacatattgcatgcggttgatatattaagcctgttttattttttattttttcttctttcttaagcctctttattatagttccccctacattttggttcacatgccactgttatgttgaagaaactgggtcctttgtcttctggataccgttttacaaacatacttgttttcatttaataaatggctaaatttctttctatgtcaataattatacacatcattattttaaatcaccacatcccattgtgtggatagactatcatttataaagcaaattgcagtattttgagtgtttggatagtttacagagttttgctctaataataaagttgcaatgacaacccttgttgcatattttt

SEQ ID NO: 232288 - DNA, 705 bp, Homo sapiens
aggcaaatatcccataaatcctatttgcctctctttctcctaacctctggctccaccaactccccaacaggcctcctgcacacacaataggagtcaggagggaggaggcaggactgtgctacacaagggagatgggattataggcatgcaccaccatgcctggctactttttgtagagaaaaaaatttaaaaaggtctcactatgtggcccagagtgttcttgaattcctggcctcaagcaatcttcctgcctcagtttcccaaagcactgagattacaggcatgagccaccatgcccagccaaaactttacttttttacacttgcttttctggaatcaggatctaaacatattgcatgcggttgatatattaagcctgttttattttttattttttcttctttcttaagcctctttattatagttccccctacattttggttcacatgccactgttatgttgaagaaactgggtcctttgtcttctggataccgttttacaaacatacttgttttcatttaataaatggctaaatttctttctatgtcaataattatacacatcattattttaaatcaccacatcccattgtgtggatagactatcatttataaagcaaattgcagtattttgagtgtttggatagtttacagagttttgctctaataataaagttgcaatgacaacccttgttgcatattttt

SEQ ID NO: 232289 - DNA, 1201 bp, Homo sapiens
gatgtcagagaaccagtgactgagtgcagaggtgacttcacaccagcatctgctgtagccagaggtgggctgcaagagggaattagaggagccaacatgtcctctttctcctttagggtccatggagcagtccgctgcttccaggttgcctgtggggtccttcccagctctccgccctgacacgtcttcactccctagcactcgtggagctgactgggtggggacctcagtgttgactgaaagcgtgaatcaagtgccaggcactggtgacagagcacacagaggctgctgggcctcccaaggtcggggagcttgtggggaattcacattcttggttccgggactgattcactgagtcaatcaatattgattgagcacttagttggttgtggtggtggtaggaatgaattcctgggcttcctgcagcccctttccatgaatctatacatatcaaacatgtgcatgcatttgtaaacattaatgggagtgtactttacttttttcattttactcataaacagacgaggactttaaaaaaatcacaattattaaataattcccattactatacctgacaaaactaataataatttcataatagctaataccccgtcaatccatgccatattttccctcatctaaaaaacagaaaaaattacttttttttcccccaaagacagggtcttgatcagagctcactgcaatatcaaactcctgggttcaagtgatcctcctgtctcagcctctggagtagctgggattataggcatgcaccaccatgcctggctactttttgtagagaaaaaaatttaaaaaggtctcactatgtggcccagagtgttcttgaattcctggcctcaagcaatcttcctgcctcagtttcccaaagcactgagattacaggcatgagccaccatgcccagccaaaactttacttttttacacttgcttttctggaatcaggatctaaacatattgcatgcggttgatatattaagcctgttttattttttattttttcttctttcttaagcctctttattatagttccccctacattttggttcacatgccactgttatgttgaagaaactgggtcctttgtcttctggataccgttttacaaacatacttgttttcatttaataaatggctaaatttctttctatgtcaaaaaaaaaaagtcgacgcggtcgtgaat

SEQ ID NO: 232290 - DNA, 491 bp, Homo sapiens
taaaatagaggcattagagctataaatgtcctgttaagcactgctttagctatatctaataagtttaggtatacatgtcttcatttttatttatctcaaagtgtcttctaatttcacttgatgtcttctttgactcatttactatttaggaaaatgttgtttaatttccacatatttgtaaattttcccattttttctgttattgatttctaattccattgccgttggaaagaacatactttgcataatttcaagctttttacatttattgaggcttattttatgactagctgcagaatgttccatatgcgctttagaaaaatgtgtattttgctgttttggggagacgtgttccatagatatctcttaagtctagttggtttatactattgttcaagtcttctattttcttgttggtcttctgcctacttattttattcattattgaaagcaacatattaaagactctaatattattatgaaattttcta

SEQ ID NO: 232291 - DNA, 262 bp, Homo sapiens
gggctcacattttctgtgtaaatagctattttgcagttttctttaataatttttccatttataagtgggtgttcttaacactgaatcgtgaaactaaccgtccattttaaagatgccataaaaatacataagcaaattggcggggcgcggttccttacgcctgtaatcccaggactttggaaggccaaggtgggcggatcacagggtcaggagttccaggacagcctgaccaacatggtgtgaagccccgtctttactaaaa

SEQ ID NO: 232292 - DNA, 410 bp, Homo sapiens
tttactgtactcatttcacagtctgtgatgcagcaatccacaaaatattctatatcagtctcatgatgaactattaaatgaagggacatactcattttttgagtttccaaaaattatagaaataaggtagcctgtgaagacttacatacacacatgcacacacatacacacatatatatacccttaagcacacatgctatcaatagctctcatcagaattttcctagtataagttattaacaatggtgtaaaatggacaataatgtttctccttgtactttcaaaagatgaaatttacagtagtaaagagcatattttaaaatacaaatctctgaacaatgttgaggttgaaaattcatgcccatggcaatgccaaggcaaaataaaaggtctcgtagagaataatcttg

SEQ ID NO: 232293 - DNA, 372 bp, Homo sapiens
ccaaatggaaaatgttgaatgaatgtctggctcagtgatggacagtcagtatcatctttaaaatctagggctctcattcatgaattagactcctagtcctggagtgactatgtacaggagtgtggtagtggtgctgtatgtgaacacatgcaagcttgatttgccttcaggtggctgatagcctagtaaatcatcaaaatgagatcctgagtgttaatgtacactggacataaaaacaaatactggatcagcagcagacatttgtttactctgcaacttatgttttctatttccccttaccccttttcctccccgcccctgtaagtttttatttacctagtatggctttctttttagttgactctcaagtca

SEQ ID NO: 232294 - DNA, 806 bp, Homo sapiens
catccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaatgagacccagactcaaaataaatcaatgaatgaattaataaacaaataaataaataaataaatttcccataaattacca

SEQ ID NO: 232295 - DNA, 466 bp, Homo sapiens
tcctcctgtgaattgactgttcatatcctttgcccattcagctctcagattgtttattttacgcagatctgctttctaactcaagggtcacgacaggaactcctctaatataatccatcatcatgtaacatttttgtcccctttctgttttgcaacaactctgaaaataatgacttgcctatactgctaaataagagggtaagaatccatgccccacgcctccagccccagaataaaaaacaagtggaaactaacgatttttttcttacacgtattatagaatttctaagtctgtctggagcagtgggcacccaggcatagaccacttctttagactgagcacctgctctttgagggcagggactgtacctggttccattttccagatatttttccacttgtttatttcctaaacctttttcctactccggaaaccatgcatatcctttccccatgcatcagctgg

SEQ ID NO: 232296 - DNA, 505 bp, Homo sapiens
ctcaatccaaagctgccatccttatctatgaaccagtaaactgcccttcacagaaggccttggctttttacctttaaggatgatgcccttattctaagaaaagaacaaagaaggttagtgggagtacagggaagagacaactgaattgattcatacacttaagctctaaacgtggccaacatctcttagtagctgaagtgaaatggtaaatactttgggttacatagttttctgataaagtaaaggcaaagcaaatgcctaagtagaaagaaatgaccctgaacttttaaactcaagcaagcagtcatggagtgacaggctttttggccttgcctgatgacagtgtacatgacagaaaggcatgatggcagggcatgtatcatctttgtccatttccccccaattgagaccccaatcgtaccatcttcaggtttcttccaaagttatgcgtaagtgagtgactctcgtcagcatcaaagaccagtatttggtctgtattacattt

SEQ ID NO: 232297 - DNA, 436 bp, Homo sapiens
acagctaggaggcaagggagcccctgcagtggagtccataggttgggtcatcctttcagggcccacagaagggtagataatggctctggggacagtgtggataaaggggacttacacagaggagttagtagggagccactttagatggagtggcccagggaggcctctgcacagcctggaccaggttgacaggaagaagctccctggggaggtgtttgtgtggccggcatcccggcagagggactagcaggtgcagaagctccagtgcagggtgaactccatttttaaaggacttgaagggttgcatgagagacagagaggcgattggtagctgaggttggataagcaaccagaaaacatccccctggggccatggtaaggattcaggtgtgattctaattgcacatcttggtggagaatggctttcaggagggaa

SEQ ID NO: 232298 - DNA, 428 bp, Homo sapiens
cccaggcagatatggcctctgatatgcttggcctttgagaccatgctctttcctgttctcctgaagaaccagtagctatgagcacagaaattactacctacttgaaactggacttgttttctgcgctcctatgaaactgaacagtggagggttgctcgtgaaggatctgggacatgtttcatatggagcacaagaaaaggacgtcgaacatgcaacggtctgcatccagaggaagaaacaaagatatgaagaggttaaataacttgccaaggccaatcagctagcgagcatcagagctaggattcaagcccaggcagaccagctccagagcctgagctagactcaatgtcagtgatgatgtcgttgaccttcggggacagattctgcttttgccctggtgggtctgggttgagatgcattgcatttga

SEQ ID NO: 232299 - DNA, 434 bp, Homo sapiens
ccaggcccacacttggcagtgctaactcagcatgacaacacgcttaccaagttccttttcagagtggactttcacctccccttattctgtgcattcagcacagcgtatggagaaaaaggctaagctgggaatcaggacgcctggatttgagctctgcaccattcctgtggccttggctcagttattaaatctttctgcatttcagtacctgtaaaatgtcaggattcactcaaaaatcacctccaagtttcctgcagttataacacatatatgattgtctatattaaccttctaaaacaagcccaaatacaaataatgtaagtttacaaagaaacataaacaatcacgaaagcaaatgctttccttcacggtcattacaccaagtcaatgtaacactcctaacgatataacaccgtgctctaaaatggcggccg

SEQ ID NO: 232300 - DNA, 832 bp, Homo sapiens
tttaccctttgatttttctatacctagcatctaatctaatgcttagaaaataacaaatatttaataaacgtttgctggttaaatgcatttgttcaatgctatcgatcagatttttactgtggaaggctcactgaccagagtaggggatgagtacaaagagtctcagggcatttgggaaacaggataaaggccctttgtagaaaactggccaagggtgttgagtgcctgagctcagggaagtggcagtggatggaaaaatatttaggtggtggaattggtggttgattgaacatgtggggaaatgaaacaatctacgattatttgaaggcttctgggtttagaaaattatttggatgggggtgtgattcaccaaggggaatgaactgtgttctagacattttgaaattgagatgttcagagtattggttgaagttgtccaagagataactgggtatggagtttggagaaagtactattttggagagagaagttggagatttaccaacctctaggtactctttgaagctgtgaccataaaggagataactgtcatctgttgctgattagattgtcatagtggtggtggtacattggggaagaagagaataggtccaggagatcttgatattgaaggtccagatcaagaaggagagaggcctgtgaaggtttctaatttaaatcttggttctgcctcttgtctctgttctatgatgcttgaacaaattattctatgaatcttagcttcttcatctgtaaaatgagagtaatagtatatactttataaggatattgaaaggattcaataagtttccatatattaaatccctgccac

SEQ ID NO: 232301 - DNA, 549 bp, Homo sapiens
atgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttgg

SEQ ID NO: 232302 - DNA, 446 bp, Homo sapiens
gggatgcagatagaggccatctaaacccagagaactttcagctgccctgaaaatgaagtggactttttcattcttagcaggagattacaaaagaatactccatttacatttgaacttattgtcctgaagaaatcctctgggcgccatgcacggtggctcacgcctataatcccagcattttgggaggccaaggcaggagggtcgcttgagcccaggagtttaacaccagcctgggtaacatagtgagacactgtctctacaaaaaatagaaatacattagctgggcgtggtggtgcatgcctgtggtcccagccactcaggaagctgagacaggagaatcacttgagcccaggaggttgaaggtgcagtgagctgtgatggtgtcactgcactccagcctcggtgatgggtggcagagcaagactctgcctcacaaaaaaaaaaaa

SEQ ID NO: 232303 - DNA, 465 bp, Homo sapiens
tgtaatcccagctgctcaggaggctgaggcgggagaatcacttgaacctgggaggcggaggttgcagcgagccgagatcatgccactgcactccagcctgggtgacagagcgagagaccctgtatcaaaacaaacaaagaaacagcaacaacaacaaaaattagcctcgggtggtagcatgcatctgtgattctcagctacttgggaggctgaggttgaaggattgcttgagcccaggagatcagggctgcagtgagctatgattataccactgcactccagcctgcatgacagaccaagaccttgtctcaaaaataagataaaaataagaatattttcaaatgtttgccaatctgatgggtgaaaaaatgcaaattcattgttttcactagagtttccctgaatagtggtgaggctgcgtatctttggtatttggaaatgtctacgatatttgtccacttttca

SEQ ID NO: 232304 - DNA, 628 bp, Homo sapiens
ggaggatcatttgagcccaggaatttaagactagcctgggaaacgtaatgagaccccatctctacaaaatatttaaaattagctggctgtgttggcatacaactgtagtcttagctgcttgggaggctgaggtgagaggattgcctgagcccaggaggtctaggttgcagagagctatgcttgcactcccacctgggcaacagagcaagactgtgtctcaaaaaaataaaacaaaaacctctaagcaattgttacaaatctcagattattcttttgtatgactgtgttttctaatattatagatgcagcatattctcaaatatcattgttaaaagctttgtcctgaaatatgtctattttaatgggaaatatttgcactgattcttcagactggtccttctccccatctttattgtgagagatatagaatttaacttttaaaatagtaattaaataccacaacaaagtaaggatacttgtggagttgttttctctttaagtaagtacaatgactaatgctggtggcataaatacatacttacttttattccttatgacctgatgtagtcacagtaccccaaagtactgtatgtattatcaaataagctaccaacactcaccgtttttt

SEQ ID NO: 232305 - DNA, 500 bp, Homo sapiens
ggaggatcatttgagcccaggaatttaagactagcctgggaaacgtaatgagaccccatctctacaaaatatttaaaattagctggctgtgttggcatacaactgtagtcttagctgcttgggaggctgaggtgagaggattgcctgagcccaggaggtctaggttgcagagagctatgcttgcactcccacctgggcaacagagcaagactgtgtctcaaaaaaataaaacaaaaacctctaagcaattgttacaaatctcagattattcttttgtatgactgtgttttctaatattatagatgcagcatattctcaaatatcattgttaaaagctttgtcctgaaatatgtctattttaatgggaaatatttgcactgattcttcagactggtccttctccccatctttattgtgagagatatagaatttaacttttctttaagtaagtacaatgactaaaaatacttcatttgccaagagtctgctttcgttccttt

SEQ ID NO: 232306 - DNA, 503 bp, Homo sapiens
ggaggatcatttgagcccaggaatttaagactagcctgggaaacgtaatgagaccccatctctacaaaatatttaaaattagctggctgtgttggcatacaactgtagtcttagctgcttgggaggctgaggtgagaggattgcctgagcccaggaggtctaggttgcagagagctatgcttgcactcccacctgggcaacagagcaagactgtgtctcaaaaaaataaaacaaaaacctctaagcaattgttacaaatctcagattattcttttgtatgactgtgttttctaatattatagatgcagcatattctcaaatatcatttgattcttcagactggtccttctccccatctttattgtgagagatatagaatttaacttttaaaatagtaattaaataccacaacaaagtaaggatacttgtggagttgttttctctttaagtaagtacaatgactaaaaatacttcatttgccaagagtctgctttcgttccttt

SEQ ID NO: 232307 - DNA, 533 bp, Homo sapiens
gaatatctgcatatacataatgatctattttggggatgggacccaaatctaaacatgaaattcatttatgtttcatacacatcttctgcacatagcctgaagataactttatttttctcttggggttactgaataaactgcgtgttgtgcacttgcattttgactacaatccaccacctaaacccgggtgtagggttttccacatgtggtgtcatgtcagtgctcaaaaatttcaaatttggggctgggtacactgtctaatgcctgtaatcccagaactttgtgaggcagaagcagaaagatagcccgagcccaggagtttgagatcagtttgggcaatatactgaaacccccatctccacaaaaactcaactaaaataaaaattagtcagacatttttggcgtgcacatgtagtctctgctacttggaaggctgaggtgtggaggtggcttgagcccaggaaatccaggctgcagtgagccgtgactgtgccactgcactctgcctgggcaacaaagcaaaactcgatctc

SEQ ID NO: 232308 - DNA, 148 bp, Homo sapiens
acacagaagttcctgtttctcccatattctcaccaacaactggtatcatctaatgtttaaaaatatttgccaatgtttttttttgctttgatttacatttctgattactaattgagattgaagatctcttcatacacttgtaagccag

SEQ ID NO: 232309 - DNA, 392 bp, Homo sapiens
atttatatatagatgctccaagttgttttatctacactaaaagttggagcaccctaaatgtccaactacaaggattggttaaataaattctactacacatcagaaaaatgactagaaggaaaaatatcaaaatgttgattgtggtttttggaaggcatagtttcataggtaatttttcccttccttctctgctttctttctgtattttacaagttttcttcttgaacatttgttattttttaattgaaaaaaatgtttaatgagttcagtttcacaatttctgagcatctcctgtgtgccagacctctttggaagaggcaccaagaacagaaacttgttctctgcctttagcagcactcagttctgtaagagtagaggatgagttgtcatag

SEQ ID NO: 232310 - DNA, 445 bp, Homo sapiens
aggctagaggagggtttcacttcaatgaagcagtctgtggacttcctactgcccggcgtggataataagactcctgtgctttcatctgttcaaccggcagccctgagtttgaactggttaagagcactgcagtgaaatcttcggcaaattcctcaaaggagcttactctgcaaattatttctgtgagcaacacatcacccactcttgaagctccttttagtctttgccttcaaaataatcctgacatgaaaaaaagatggcagcactggcattggaccaaccatatcagagtccaacttgatttgcacctgtaatttccctgaggaaatgaaatacctgaaataattcagacactaatttcttcatgaagaatttaagttgcttcccactttagaccaaacactttgtctgcctagcatagtcctgaataaataaactggtgata

SEQ ID NO: 232311 - DNA, 274 bp, Homo sapiens
agagcttcttttaaaaatatgtgcctggggtcctggccttcacctgtactttgcctgtaattttccacctcttggtctttactgtatagcacttgagcaatcagctgttcagggtggtacagctggaggcaccatatgcacttcggcaattacatgtctagactcattacttactttcttttggcactgattccacatgattcgggcatttccaatcatccctagttccacttcttagatcttctgacctcctggcctagccctggagaaattt

SEQ ID NO: 232312 - DNA, 411 bp, Homo sapiens
agtcagagaagagtataatgagtatgttagggaatgctttggggaacaacatctgcaggagaaatggaagcaggattgagcagagggaagagttgacctgcagtgacgtctcagtgaaggcctcgttttgaatctgggatatcccttcagagttgtcttgagttaggggaactgggctggacctttatacacctatgacatttagtcactggatgaacgctgccaaaggagaagagtgcaaccttgggttaaaggactcctgaagatggccaagagctggattgtgttggcttgctgcactctcagcagctcaggaaataagtctttcattgaggaagagggatctgggtagtgcctgccagtattcactaccaagagtgatggcaaaataaatattctgacaaagacaaa

SEQ ID NO: 232313 - DNA, 472 bp, Homo sapiens
ataaaagaaaaagttggttctttgcaaagataaaactgacagaccactagctagattaaccaagaaaaaaagaagattcaaataaatacaatcagaaatgataaggtgatattataactgataacacagacatataaaatatcagcagaaactatatgcacatattagaaaacctagaggaagtggataaattcctagaaacacataaccttccaagattgaaccagggagaaataggaatcctcaacagactactgagtattgaaattgaatcagtaatagaaaaaaatcttgcaaaaacaaaaagcccaggaccagacagattcacagctgaattctactagacatgcaaggaagaactagtaacagcactattgaaactattccaaaaattataggagggaatcctccctaactcattctacaaagccagtatcatcctgatactgaagccaggcaaggataaaacaca

SEQ ID NO: 232314 - DNA, 341 bp, Homo sapiens
agccaagacccgccattgcactccagcctggatgacagagtgaaactccgttaaaaaaaaaatccccaaacaggactacttggaagaaactttctcttcttcccattggatttactggacttaaacctgagaaagggaagggaaaagcagctgccaatatcttgactccttgggggacactcacccaggctgcagccaacacaaagaagaatgtaagagctggagaaagagaacctgggtcctgataacatttttgaatgaatctttacctgaggctgaatctatccctacatattgctgcttgtgttgtaaagcaaataaatttattttcctgcttcacc

SEQ ID NO: 232315 - DNA, 418 bp, Homo sapiens
accccgtctctactaaaaatacaaaaattagctgggcgtggtactaggtgcctgtaatcccagctacttgggaggctgtggcaggagaattgcttgaacccaggaggcggaggttgcggtaagccaagatcatgccaccgcactccaggctgggagacaagagcgaaaccctgtctccaaaaaaaaaaaaaaaaaaaagggagggcaagtcataaagaaagaagattttgaatcaatataaacaactttctggctgggcatggtggctcatgcctataatcccagcactttgggaggcggaggcaggggtcggaagtggtcacctgagcccaggagtttgagactagcctaggaaacacattgagaccccatctttataaaaaatagaacaaattagctgggcatggtggtacatgcc

SEQ ID NO: 232316 - DNA, 343 bp, Homo sapiens
cggcacgaggagacgatctaaacctgaaacagaaagagggaaagctctgtcctggagagaaaattgcacagcgagagcacagtgtacctggacacagagtgaaagagcaggctgaaggagcctgctgtatctgagcacaggctgctctcagcaagtacacatagagacttgcttttgggcccaatgatcccctttactagcaaaatgacgtaagtagcaagagtcaccgtgcccggcctggtagaagtttttatatgaatatatgttgtcatttctcttgagtagatacccagcagtagaactgctgagtcatatgataactcaatgtttaactcttaaaaaa

SEQ ID NO: 232317 - DNA, 422 bp, Homo sapiens
catttcatagcaaaagcactcaataaattgaggattgaagggaactttatcaacctgctaaaagtcatccacaaaaatcccacagctaacctcatatgtaatggtgaatgactgaaagctttacccccaagatcaggaagaagacaaggacatcactctcgccacttacattcaacattttactggtggttctagcaagagtaattaggcaagaaaaataaataaaagacatcctgattggaaaaatgaaattaaactgtttgtatttgtagaagtcatggttttgtacacagaaaatcctaaagaatctatgaaaaccttagagaaaataaatgagttcagtatgcaggacacaataacatcatacaaaggtcaattatatttccatatactagcaatgaatgacctgataatgaaatttt

SEQ ID NO: 232318 - DNA, 1261 bp, Homo sapiens
gggtaagtatacgtaaaataggtgaagggtggagatcagaggaaagcgtgccaaacaggaagacaagttctcaatctagtctgaaaatttaacttgtagtttggctttcaggctttaaactgtcttcagcttggaggtggggtttcaccggggacctgcctctatctgcctaggcgtttgactgtcttctgttgctgtcactagtagcacaatataaagattttgtgctactgtttcacagtgatttgcaattagtgcttttttttgtcatgtagttttgtttttagtgcattattctttaggagaatttatccgtgaagcttgggtatcacagcttactgctatgtccttgatttatacttctcattgactgtgagaagtgatggctagttttcctgctgtgagcaggtttggtgatatacaataccattcgcaagatgttatatatgtgcattgtcacatttctttcaaaaatgatatttccaatttttccaaacattcatatcttctttctggccatcatactgattttattaccaaaataaaatcttatcattaactctgaaaacaatttaaataactataagccatagttagggaatgatttttaataaaacctagatacaaacaccatcattttctcctctaatagcaggttgtcttgcctgactctcaaaaatgagggagctaaatcatacagataggtgacatgttcatggctataaggaacaccatagcataatatttggacagtaagacataatacatatcctgaaaaaactttgatgtgtagtcagtgtaacccttgtcccctgtcctcctccctaacctcaggaaagatccacacttccacatttattccctacccacctttggttttgaatcctcatttccacagatgcagcatgacatctgtaacccctacaaatctgcatacccctccagccttcccagaacttcattccctccatcttcattgccttagctccttttgtctttaagtattcactcactaagtcaagaaaatattggagggggggtggggcaaaacaactaggctttaaaggtgggggattacccagatcaacacaagtctcccacttgaacaactgctctttgacacctgtaccctgagatgtgactatggattaaagtcatagcacccctgcctccaggttggaaagttttatggaaaatgaacatattttattagaagacaatgagaacttcctggagcagatgagtaaacacaccctcatgt

SEQ ID NO: 232319 - DNA, 419 bp, Homo sapiens
caaaaaagacataggacatgtttaagaaacaatatgcttggctagcatgcatagaacgtgagggtgaacagtggggaattaagttttaaaaagtttctgaagtctagtaatagcacttgggatgtcaggataagaggtttttttgaggagtttttgtttgtttgtttgtttgctttttgagatggaatctcactctgtcacccagactcaagtgcagtggggtgatctcagctcactgcaacatctgtctctactaaaaatacaaaaaaattagcggggcgtggtggcgggcgcctgtagtcctagctactcaggaggctgaggcaggagaatggcgtgaacccgggaggcggagcttgcagtgagccgagatcccgccactgcactccagcctgggtgacagagccagattccctttc

SEQ ID NO: 232320 - DNA, 394 bp, Homo sapiens
cactgcactccagcctgagtgacagagtgagactccgtctcaaaagaaaaaaaagtaatagccactgttgctcagccaaagagtgcttatgttgcatatttggctagtgaaggacatgtatgcagaaaacatgtaacaatgttgtttggactgagaagtgtggtgttttggtcagtcttcaacttatagtatagaacagggattgcttactgcagcccatggaccaaatctggctatttccatttgaagtattggctctttaaaaaaagtttgctgggtcaagcagggtggctcacgcctgtaatcctagcactttgtgaggccaaggcgggcggatcacgaggtcaggagttctagaccagcctggccaagatagtgaaaccccatctctact

SEQ ID NO: 232321 - DNA, 289 bp, Homo sapiens
agtcaagtccttccatgttcttctgcctagtttattctggctgcattgagagctgattggattgtgcccccgcagattgagggtgggtctgcttctcccagtccactgactcgaatattaatctcctttggcaacacccccacagacacacccaggaaaaatactttgcatccttcaatccgatcaagttgatactcagtattaaccatcactaaaccaactgtctaacttttagctgtataggtaaaatgcttaagtaaactaaggcaaagataactgtagcaataaa

SEQ ID NO: 232322 - DNA, 291 bp, Homo sapiens
gagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacac

SEQ ID NO: 232323 - DNA, 460 bp, Homo sapiens
agacagaaagagcccttcacacaatcttcttgccagccctcaaaggggaaaacgggcttggaatggcgaaaggatttgcctggggtcactctggaggtggctgagccagggtttgaacctggggccatcctaccccagactttatgtcttaactactgctgggcaggagccaaatcagaccccatggccccaacagtgtgaggcccattgtggctctcagaacatgccagcagctctagccagacgaaatgctgacacagcctctgggtattaatagcccctgtctgggccgggctcctgtgcccctcctgaggccacccagggagaatggggtgagtgcttggtggggagatgagcagatcagttccctgtggtccagggatctgagtccagcggccctcgtgccaccccccatagggaccacttaggagccggaccccttctcttttcagcttcctgg

SEQ ID NO: 232324 - DNA, 392 bp, Homo sapiens
aatcttaacaatgttaagacacggacaagactgaacatccagttcacatccaggaataagtggccaacatggggtaaggacactctccagttagtattcttctctccttggctccaaaaagcacccaggccctggaggagggtcctggtggccttactgattcatggtggaggagttctaagaccaagcagaaggttaggctttggtaaagctcagatgggaacttgcaagcataagaacaagagggaaagtaacccccactgcacagtatccactcctcagctgtgtaaacaaataaaatggtccatttcttctggatcctctcctagttgtctttgtgtggacgcacaagcgcgcacatgcacacacacacacacacacaaaccacttca

SEQ ID NO: 232325 - DNA, 319 bp, Homo sapiens
cccctggacatgcttagcattctttcctcctgtagtcgaaggcccttcgtggtgctctctgccaggtggttttagtgatggcctctaaagacccagctcagttcagccacccagtgcactctcatttggcctccatccatgtcctcttatcactggtggtgggtgtgtccacactcataaaaaggagggggtagagaattttgaccatattaacaaggaggtggttaatactctaagatttcctgttggttctcttcagatagctctcctggtgtatctaaaatcccctcactgtaataatacatttaaatcctgatgt

SEQ ID NO: 232326 - DNA, 413 bp, Homo sapiens
taagaatactttacattattttctgtaaaaattttctgtaaaattatgcctaattaataaactgataatattaaaatacacgttccaccaagtgttcactttttttaacacaagtgttagaatgcatttcagatcacgactattactcattatcattttaattgatgtttaattaaattttaaaaatgttttattttttagttgaaaaatacaattgtatgtatttatggtatgcaacatagttttaaaatatgtattgttgtggaatggctaattagagctgattaacatatgcattacccaatacacttatcatttcttttgtggtgagaacacaaaatatattctcttagtgatttttgagtattcaatctattgttattaaatatagtcaccattaacaagaacttgta

SEQ ID NO: 232327 - DNA, 389 bp, Homo sapiens
aagcaatcacagatgtcttgccattgcataggaagaagactgcatggcagatcagcaagaaagaaatgaggtcagaagttagaccctacatgggaaagtcagaaatgatggaatctcaaggaaagcagcaaggagtgggacaagaatttcctggagctgaatagtttcaagtggcttttatgtattctaggcttctacaagcagggagcatatatatgctgggaattatcagtatcactgagagaaatacattagttatatacagatgcatacacatctaactatattgcacaagtacaagaagtctaaatggtattaaataattaaataattattctatgtacacatagttcagtttaaaatgtggggtttagccgttcttgatttaa

SEQ ID NO: 232328 - DNA, 427 bp, Homo sapiens
gtggctcccccatgctgttctcatgatagcgagtaattttcatgagatccgatggttttataagtgtctggcatttcccccgctggcacttctctctcctgctgccatgtgaagaaggatgtatttgcttccccttccaccatgattgtaagtttcctgaggcctccccagcaatgtggaactgtgagtcaattaaacctctttcctttataaattacacaagctaagatttatcataaattgtaaagtgggaaaattaaaatgaaggaattttaacatacttaaaaagtacattaaaaatgtactttcatgaaacagaaggcaacaagtttgaagacacaactgttgtcttaaagaaaacctttataagagataaactgaatcatccatggagctccagtgaagtgccagaatatttctttatgcc

SEQ ID NO: 232329 - DNA, 601 bp, Homo sapiens
attacaggtgcgtgccaccacgcctggctaatttttgtatttttagtagagacagcgtttcactatgttggccaggctggtctcaaaatcctgccctcaggtgatctgcccaccttggcatccgaaagtgctgggattacaagcgtgagcctccgggcctggcccctcaacacagtttaaacaaggaaaacttatcttcctaaaaatagagaagatagacagttcccaagtggtgatggtggtgtattttgtttgtaagttaatcagcaatttggtgatatcagggttctaggttgacttctctctgattctcttggttttctctaatttggtcatttattgtgatatttaagttaacaagtaaagtgcataggatgggagaaatctccagtggactagtggagtctgtgacagtggggtatgtggagtatagatccacaggctgttggaataggctcaggtcctcatctgctcagaagacaggcagggaaattccagtcttcaagggttttgttggtgaggagaacatggatatggatgtaatgtccttcccttttgttttctttgcacaaatttcagtggaaacatgttgccaagtcag

SEQ ID NO: 232330 - DNA, 457 bp, Homo sapiens
tggatatcccaaacataatggaaaaagcacacacaaataagcttatattatataattccatatacctatgtatatatcaagtataaaagtaggcaaaacaagctactgatggtggcacacacctatagttccagctatttgggaggctgaggcgggaagatcacttgagcccagaagttcaggttcaacctgagcaacatagcaagaccccatctgtaaaaaagaaagcattattaacataaaaataggcagaactactatattcttagagaagttactgttagggagacagacagtgagtgactgaaaggcaaaatgaggggaaattccaggggatagtaaatattttgtttcttagtgtgggttctacttaactgggtattttccatttgtaaactgtaaaattatgtgcacttttctgtatgtgtattacattgcaataaaattgtttaaaagt

SEQ ID NO: 232331 - DNA, 348 bp, Homo sapiens
ggtttctctttctttctcctaaccttaggagaaatgcttccaatgtgtatccagtaagtaaaatctgatttttggactaatatttacttttaaacctattatataaatttctatttattcttgttttattagtaggaatgggttttgatttttgcaaaatgccttttcagcatctatgatgcttttcttcatagatgtatttagagaatgaattatattaatggatgttcttcttgaatcatacttgcattcttgaaaggaaccccactggttgacaatgtatttatttattcactgttatatattctatctgcaaactcacattaaacatttttattgatatttata

SEQ ID NO: 232332 - DNA, 445 bp, Homo sapiens
gtgaggaacagtatgaccatagatcccctctcctacttgggtggaggaagtctccagtagttgaatcagagtaggtgttacctcaggcatgaggcatagctgaggaccactgaaagcagacagattgagttaaagtctacacatgtgggtccaggctcacttctcccacttagccagatagcatgagatagtgggaggatccctctggagcagctggcccacaagagtcctgcaaacactggcaactatgacctagtagaaaaacaaacctattagctggcagactgtacccattgacagtttccaacaagcaccatcatcagcatgagccagacatttggggaaaacagtgcaacattacctccagccatgcaagtgatccatcttggaccactgacccagtcaagccttcagatgactataacctcagccaatacctgactgc

SEQ ID NO: 232333 - DNA, 733 bp, Homo sapiens
gatgaggagttgcttatgcttgagcaaagaagtggtttcttgagatggaatctgttcctggtgaagatgctgtgaacactgctgaaatgactccaagaatttaggatattacgttataaacataattcataaagcaatggtatggtttgagggaattaactccaattttggaagaagttctactgtggattaaaaaattatatcaaacagcattgcatgtacagagaagtctttcatgaagagtccactgattttgcaaacttaatcattgtcttattttaagaaattaccatagccaccccttctttcagcaaccaacaccctaatccatcagcagccttcaatactgaggcaagacctgccaccagcaaaaagattacaaccagctgaaggttcagatgattgttagcattttttatcaataagttatttttaaattatggtatatacatttttttagacataatattattgcatacttaacagattacagcatagcgtaaatgtaacttttgtatgcactgggaaacaaaaaaatgtgtgtccctctctttattgcaaaatattcactttttgtagtggtctggaatggaacctgcagtatctccaaagtatgcttgtatttaaatcttgcttaagaagctagagaaagagtagcaaattattcctgaaataggtagaagaaaacataaaaattttagcatatgtcaataaataaagagcagataaagtc

SEQ ID NO: 232334 - DNA, 442 bp, Homo sapiens
cttacgcgcacctcccaactctaccacttaacaagctgtctgcctttgggcacaactgctcttcccttccacttctgattccctaattcagtctcagtttccttacttttgaatactgtcacttgtacttctgaaactcagtctatgtctctcctttcccacagtcagagattagccatacttaactatccttggactgttgttagactcctgactgcttttcccgacttagtctttccgccgtctgttttatactgtttacaacctccgggttaattttttttttattgtgatacactttctcaagaattttaaacactatcacacttaactaataaaataagtcttaagaccctaacccagccttcaaaagtcttcatatatggctcgtccctcatatttttcttccttgactctccctctcattgcatattgctttttg

SEQ ID NO: 232335 - DNA, 377 bp, Homo sapiens
ctgcccgaggccttgtgtcctgcgatgcttgtggccaagactgcatacattgctgtgacggtggctggttaggggcagggtgcatgagagattgggtcagctttctacatgggccggatgccggctgtcagtggagcacgtggctgctgcagagtgtgacccagctgtccccatctcctgctgtgggtcccttatccggggtccttccgggaaagtggctgatggctcatggctcacttccctcagctccacgcaggcctgggtggcccgctggggaatgagcagaaaccctgcccagggcaccctgacactgttggagaggagctttactgcagggaggccctcaacacacacccacttagtgtcaccggcggccg

SEQ ID NO: 232336 - DNA, 418 bp, Homo sapiens
tcatctcaggacagcatggccgatgtgttcattcatctcaggacggcatggccgatgtgttcattcatctcaggatggcatggaccaggtgttcactcatctcaggacagcatggctgatgtgttcattcatctcaggatagcttggctgatgtgtttattcatctcatgacggcatggaccaggtgtccatccatctcaggacggcaaggcccaggtgttcgttcatctcaggacagcatggccgatgtgttcattcatctcgggacggcatggctgatgtgttcattcatctcaggatggcatggactaggtgttcatccacctcaggacagcatggccaatgtgttcattcatttcaggatggcatggcccaggtgttcattcatctcaggacagcatgaccgttgtgttcattc

SEQ ID NO: 232337 - DNA, 735 bp, Homo sapiens
actgtcaggtgcagaaagcaagcctctttgttctatgggcattttcctccccctggatttgactgttatttactggccacgtgagcgccaggcgcgggtccggcggggaaggcgaccccagaacagggtagacaaaagctggcccagagcgcgacccgtgcgccccagggacgtctccccagctcctgcgacacgcgtgaaattggcccggacctgcctcctgagaggcttttcccagaaatgtcttgttaaagcctttgtaaaggaatcagtgtttacttgcgccgggagagctccggccctgggtcctggcaggcggcggatttctgagctgctggagagcaacccgggaaagcaaaatcagccttggactgtcggggcccctggggctccttgctccttatcgaaagcgagttattagatagacccccacagtcccattcagcagaatgggaaactggactcagacaccttttgccctccccacagggaggccacgccgtgcggctttgaccactgatctcccacccggagtgcccgacgcccagggtcctgccaccgggcagcctcggtcagtccacagttgtggctccttccagggcctggactagggtgagcacaagccttgagcgcaacatttaagaagggcgccgaaaagtcagtaatcaaaagaaatatcttgatgcaatgcctctttaaaagaaaaaaaaatgcaaaaaatccatgatgaataaa

SEQ ID NO: 232338 - DNA, 553 bp, Homo sapiens
attgctagcctggaaagcaaggacaatatatattgaaatttaaagtacatataatttcacattgagcaaattcgttctgaatatagtttttactaggggctgtgggatacccaaaagttgattaacaaatacaaaagtacagctagataggagtaataagttctagtgttctctagcactacagggtgactataattaacaatttattgtatattttcacatacctagaagagcacattttgaatgtttctaacacaaagaagttacaaaagttttgagatgttggatacgttaattaccctgatttgatctttacgcattgtatacttgttgcacaatgtcatgttgtaccccataaatacgtacaattgttgtgtgtcaattattaatagaaataagaaaaagttaactctcaattccattttcaaaaaaatactctatcaggtaaggattatatgtactagaacaattattctagttttgttcctgatagcaaaacagttacaaaaaaacctggaactctcatcagtaaagaaatggttaagttaaaaat

SEQ ID NO: 232339 - DNA, 339 bp, Homo sapiens
gggtatatatttattaagatatttaaatgtatcaaagttataatataagcatgccaaatataaaaaaatagattttggaaataaaaaagtacagcaaacgctttttaaatcaaatctaaacgcacattcacgtctttctcaatcaggtgattcatgagtcaacaaggctgactcttaacaaaaggagtaaagctctaaaatctccaagatttaaaagcaaaaacaaacaaaaaccagctatgcgttgttgttgttttttaatagcttttggatcggataatttagtgagtacttttcaccactgatgcattatgtgtgcaggggctcgtgaagcttgat

SEQ ID NO: 232340 - DNA, 371 bp, Homo sapiens
cccacagccaacctgaggcctgactcagaatgtttttctgggctgagagccacctcttaaagcacatggcccataagctgtagttggtaggaggggaacaagggtgaatccatacaagatctatctgccttgcaatttttctatcaaaattatctgctgggattttctcccatacagagatttaactactgccccaatgtccaaggctagtttctcacagcagagagacagaaatgtacctaagttcacggatgggaaaggcaaaagggaaatgcattcaacaaatgtgaccagcacttttcatgtgccaggaacttcccaaagtgttggggacacaatattgaataaaacaaaactcttgccctcatgga

SEQ ID NO: 232341 - DNA, 846 bp, Homo sapiens
gtttccgatgagaatcaaagtcctacagatacaaacaaacaaacaaaaatgatgaaaaacccacaaatggataaataaatactttcttggtgttgaatcttttctttttaaaatcctgatgtcaacataatacaaataatatgaaatttgttctacagcttaaggtcaactgatttcagcaaatatgagaaatgctctcaaaaggataaattgtttctgtctttttaaaggaagcaaggttcttattcccccagtgaagccagaattgctccagccagggctgaaatgggaatcctgtccaccaaaagccgggtgacccttttatgacattctcatcacaattggaattatccccttcaaaagagaccatgccacagtcttccttttaagcaataacacaaaaggaagtagaaaatgtagatgcaatagttcattacagttggagccctattttctcttattctttgaagatgtcccatttatattcaaggttttgatcagactggaaagaaaacacatttaccagtttagttggtgttgtgtagagaattctaatgttgaaacagtgaaaacagcgtttttcttcatagtgagtgtttcccaagcagtttttacacttgggatgcactaagtgaggccagttcctccagggactcacatagtcccttagcaacctacaagggatgagagttgtaaaaaaatgtgctttggtttgagttctcaagaaaacaaatgacttccttccttctagactttaaagaaagatgacactgaagtggagctactgaggctgcctagagaccacatcaagcctgcagacagagccaacacacagctgagaagatc

SEQ ID NO: 232342 - DNA, 923 bp, Homo sapiens
gggtaacactctgtaattctcccccatgtatacattaatacatttatattgcttttctccaattaatctgccttcacacagctgattttttaatgaaatatcagagagtgaaggggaagttttcctatagctcctacagtagtcaactcatcctgctaccctccacttcccccacctgcctctgaaaaccacagatctgctctccatttctatattttgccttttaaaaaatattataataatatcatatagcatgttgccttttaagtcctaattttttactcttattaaggagtttgagaggtatcatgttatatgtataattattttttttctttttattactgagtatcattccatcatgtaaagttacccctgtttgtttatacattccccagttgaaacaatttcagttgtttccactttggggtggttacgaataaagctgctctaagtattcatatacaggtttttgtatggacataagtattcacttatatgaattgtccaaataactgggtatttgcccaagtgaaccacttgtgaaattatattcacataggtgaatctaacttttccaccaggaaagttagaatgtttcagttgctccatgtccttacaagtttatattcaatttttttcttgttgttttgttatgctttgctttagtcatttcaatgagtttataacactattgcaatgttatttaattcagtgtcatttaattgagagtttctcaatgaattagtaatggaaagaaagtatctcaaaacaataaaggctacacatgacaaattcacagctaacattgtattaaatggagaaaagctaaaagctttttgtttaagaactggaacaagacaaagatacctactatcgccactcttattcaacatagcactggaagtcctggcaatttagac

SEQ ID NO: 232343 - DNA, 270 bp, Homo sapiens
acaccactgcttttgcttccccatagttttcttcattgcatgataactaacttttccaaactaggatttgctacatctagtgtgacaatctctggaacatttcagtagcttatggtgataataataaggatgaatatttgaaaattaaactattttggaaaatctgggacatatgactaccacacccagagatgactaccagggaggcagagttcttaggcctctgaggaggtggcatttccttcaataactttaaaattttttcacatt

SEQ ID NO: 232344 - DNA, 408 bp, Homo sapiens
actgaagtaaagttgaggaaaatgaaggtattctcttttgtaagagaataattgtacaatactgaatatgaacaaaatattgactagtttggacatagtgagctagatgacaatatatcgcatttaatttcctaactcaaaaatagattttgcttttccactttgccattgtaaagcactcatcggtctgtggattcttcagagccccatctggccaacataaaatccccacaggaaaaaaaaccaagagggagaactaataatggagatcctggtgagattaaatttcttttcttctcaatgaaatgtgaaagatgtattacccgcagtttggcaaagacagctaataaatatcacaaccgtgatttgagagccatgctatgcatgaaagcaaaactgagttaaaag

SEQ ID NO: 232345 - DNA, 444 bp, Homo sapiens
gtatagtttgtagcatttaatcttctatttcagtgattggtttggatctacttaattttaagctttactggtcatttgtccccctcatgttgtacctaataagtgtgtagtttttaagtgaaatcatacataatttcaaggaaactgctagagacaatgttgagtatcatcaagaacatttaatcaaacctgttgactaagagctttagtttggcttacaatttcatatgtaaatccaagaaaaagacttgtaagctaaaaagcctgtttcgttcggaaaaaaaagtacataacattttaaagatttgtgagaggaaaaaagcattagatgcgatagaatggaataatctctttttagaagtaaattagtttttatttcatttgtgggtggtattgagaaaagtggtggaaataaatacattgagcagattcagaatttaatag

SEQ ID NO: 232346 - DNA, 138 bp, Homo sapiens
tcttcatcctctccccatgctccctctgttgtcatttccccttactctccactgcacctggtctccagcattgttttctgtttcttttttgttctgagttattctgtgtcagtcagtgaagggtttaattatttttac

SEQ ID NO: 232347 - DNA, 478 bp, Homo sapiens
gttatgaaatatcaactttaaaacctcaaaagcacatttattgcctgaatgaactagttggaaaatgaaagcaggaaataattccagggttctcttttccatggaggtattttaacctctataaggaacattttccagaggctgggacactgtatttatactccctagatgcctggaaagctacagttggtctcattgccgccttattaattatattgagcctaactctaaggtaaatctgagtcctctggggtgggtgggagtgggggtgatgagagtactgtttagctctttgttagtctagggatacagaaggtatcatctaaacagctgaaagaatgcagatgagaacagtattttaaggcttattattttaagcaacagtctaatattagccaacctaatatgagtgtgattgttttctccaaaagtgaccatatctgttaaaatgtgtgattctattacatttgaaatatta

SEQ ID NO: 232348 - DNA, 377 bp, Homo sapiens
aaatcaaggaaattgagcaagccgtctttcaaaggaagctagatcgcattgatccaccgtattccaatcagctatttattttttccacctaacactcccctacagggttactaggacaaatgactcccaggctatgtttcctagaatgggttttttgcccccataccgggactaaaacactgtctccttatactcagttaattactaaagtcatctattcaggtcacaaacgttaaaaatcagttgcgacataaccgatatcatcatgattcctttaagtaaagagcaattcaaagcttcattatctttgtcaatacacccacaaatagttttatctcattacacagagcaaataaagcacatcctccctgctgata

SEQ ID NO: 232349 - DNA, 263 bp, Homo sapiens
cttcagcactttttttttatgcctcctcagttccacccaaaactccatgccctagttttgtgcttcccctgctctctgtatgacctccaatccctggaattcatctctcagctcactcacttcctaatccttttgcaggatttctccccaatcagacaaaatctatctctgtacttagaaacacactacttctaccttgaggtaggaaggtacctaccacactttctacttttcttcttcctctttctaatccttcttcctct

SEQ ID NO: 232350 - DNA, 483 bp, Homo sapiens
ctgagtgccttgctcctcctgatgaatacagagggcaattttctgttgatttggaattgctatttccacatcatcagcaatatttctgcctgagacttttcataaaaattggggcctctcatctgctgctctgtgtgaatctaccagaagttgaagatggtaaagcaacattggttcaaggataaattttcttcaaattacaacagatggaagaaaagattttaaatgacctcttttaaaatgcctggataacataatatggatcatattttggtgtcagaagtttgtatcttagtgatctagcatgtaagctctcccttaagcaatgcaaaggaaagccaaaaccaattatgtagcaaactggaaagaaaggctgttttcggctccttgggcaaatactaacttactgaaagctgaacattactttattgttttgtatttctctttctgcctaataaatgatgaaatggtcaaaagtttctt

SEQ ID NO: 232351 - DNA, 444 bp, Homo sapiens
aaacaacatatgatccaggtctttgactgcacttccccagggcttgagtacatctcgggatattatagaaagtgctacttaaacaccagttgaaatggaagagcatagtacttgataaatccagaatgttaggggatttttgtggcaattttgaggaaattattaaaatatcatttgattattaaagagtaaaactcacaaaatacttggcaaaaccacacacttcctgagcccttgttaacctgactgccttgttcctcctggctcaggaggaaatatatctacttttcatattatgacaatgtagctggcttttccttagcacaagtggaagaaagggctataatgttacacatgatatgtgacttggtaataggtgtcttctctccaccagcattcaatatgtattctgaactttctctttttaagattaagaagtctgtt

SEQ ID NO: 232352 - DNA, 310 bp, Homo sapiens
tgtgtgcctgagtttttgttcagacactgtctccaaatcatacaacactcaaatgagggaaagtgggaactatagtgtttgttccctcagcatctgagggggactgctttcaggacaccctcttggataccaaaatctgcaaatgctcaagtcccttacaaaaaatggtataaatttgcatatgctctgaatcatctctgtattacttataatatctaatacaatgtcaatgctgtgtacatagttgttataccatattgtttagggaataatgacaaaataaagtgtacatgttcagtacagacacaac

SEQ ID NO: 232353 - DNA, 488 bp, Homo sapiens
cagaacacagagagacattgatcagcggggttgtccacacctggaagtggcgtgggggccctggcttcagagagctgctgcccaacacaggaggcgctggccagcccccagccctggaggggcagctgcattcctgggaagcccttgacccacatccccagcacgggaggggaggctctggagtggggcattgctctctctgctgcgctcctggactctgcaggaagagggtgtcttggctatcatggagacgctgacctcagccccagccctgcctcctgggcaggcctggaccaggtgtgttcgccctgggttggggtcagtcccacagcagcgccagggcctggcccatcgaggactcggtggcctcggccaggtattcgcaacacagccagtcctcgaggctgggagcttccccacctgcggcccgctctgctaggcgcaggaccagcagcccgcggcgcacccgcagccagggcccgagcgct

SEQ ID NO: 232354 - DNA, 296 bp, Homo sapiens
taagtttgaccattccttaatggaagaatataggcttatttaactatcaatatgcatgccatttggagcctttttggcccattagaaaaataaacaacttaacaaatttttcaaaataaaaaaaagcttggcctaggcaactgcccttttctaagaagctaagtaaaatccccatccccatcggatcctgactgaccaagtgctactttataaggtgatgctaaataccctcaatggccttctcatggaccttcttttccagcttagatcttggcaatacatttctgcataatgcg

SEQ ID NO: 232355 - DNA, 465 bp, Homo sapiens
gggggtctgaacccaagagacagctggaggatgtctttcttcttcatttaagaggcaatgagttgcttttagaatgagtcaataagattgattttggtcacatttctacggccctgagtaagttacttcatctcgggatgctcagtttttccctccccaaaatgggtataaaaacactgacagccgggtgtggtggctcacacctgtaatcccagcactttgggaggctgaggtgggtggatcatgaggtcaggagattgagaccatcctggccaacatggtaaaactccatctctactaaaaatacaaaaaattagccaggtgtggtggcatgcaactgtaatcccagctactcgggagtctgaggcaagagaatcacttgaacctgggaggcagaggttgcaatgagccaagatcacaccactgcactccagcctggagacagagcaagactccgtctaaaaa

SEQ ID NO: 232356 - DNA, 490 bp, Homo sapiens
ttttgtgtgtgtgttcatcctgttcatagtacataaagcaccatagacctgtgaggttttagtttttttgtcaagttgggtaaattttaaaatagtacatatggatacacactttctgttccttcctccctttctttttatcccccacaggtcactggaaccttgttgttgctatttttattattctctatgtttttcactataaaaattgctattgactcgtgtttagatttatttatcctacctttggcaacgcctaatactgctgctaagccagtccaatgatttcatgtattttattttgtaattttaaaacgaaattttttcttttgaaattttccatgcctgtcatatttatactctcctttatattattttctatattcatgatagttaaagttctattctgttaagtccaaagtgtcagtcattcgtataattgtttctatttacttttttgcttgattaaaaatcaaattttaccttttca

SEQ ID NO: 232357 - DNA, 1703 bp, Homo sapiens
tgggtgcaggtgggcacaggtgcagaaggtgcaggtgcagtgggtacaggtgggcataggtgcagtgagtgcaggtgggcataggtgcagtgagtgcaggtgcaggtgggcgcaggtcgagtgggtgcaggtgcagtaggtgcaggtgagcacaggtgcagtgggtacaggtgggcacaagtgcagaaggtgcaggtgcagtgggtacagatgggcataggtgcagtgagtgcaggtgagcacaggtgcagtgagtgcaggtgcaggtgggcgcaggtccagtgggtgcaggtgcagtgggcacaggtacagtggacacaggtgggcacaggtgcagtgggtgcaggtacagttgggcacaggtgcagtgggtgcaggtacagtgggcgcacgtgcagtgggcacaggtgggcacaggtgcagtgggcgcaggtgggcacacgtgcggtgggtgcacgtgcggtgggcgcaagtgcagtgggcacaggtgggcacaggtgcagttggcgcaggtgcagtgggcgcaagtgggcgcatgtgcagtgggtgcaggtgcagtgggtgcaggtgccggtgggcacaggatccaattgggcgccagggtgcaagttgagccaaggccatcaaccccgtgtctctcctcacaggctcacatcacccaagatactcaaagcatctcccccatctgcataacccagcaaagcaaggactccatgacctgctgtgtacccaggccaggaacctgacctgccacaggcccagggctgcgtgcacactggctgaatgcattagttaatattttggtgacgctggttacttgccacctctgctgtaaataacagcagcgtcaaggatacagtggccacgagaggtagcagctgctgatgtgtggagaagcctccatagagaaatacgtgtgaaagatgcatcaagaaaacccaagctgtgatgctgttaagggctgaaatgtgtctgctgaagtcctaaacctgcaaacgtgaccttatttggaaatagggtctttgcaaatataatcaagttaagatgaggtcatagtggattagggcgggccctcacccaataggaccagcttccttaaaagaaaaggaaaaggccaggcctggcacggtggctcacgcctgtaatcccagcactttggaaggctgaggcgggcagatcatctgaggtcaggagttcgagaccagcctgaccaacatggagaaaccccatctctactaaaaatacgaaactagccgggcatggtggcgcatgcctgtaatcccagctactcaggaaggctgaggcaggagaatcgcttgaacccaggaggcagaggttgcgttgagccaagatcgcgccactgcagtccagcctgggcaacaagagcgaaactcagtctcaaaaaaaaaaaagaaaagaaaagaaaaggaaagggccagatgtggtggctcatgcctgtaatcccaactcttggggaggcagaggcaggaggatcgcttgagcccagcatgggccacatagggagaccctgtccctacaaaaagtaaaaaaattagccaggtatgatggtgcatgcttgtagtcccagctacttgggaggctgaggcaagaggatccttgagtctgggagaaggaggctacagtgagctgtgcttgtgccactgtactccagcctggcccacagagtgagatcctgtctcaag

SEQ ID NO: 232358 - DNA, 1086 bp, Homo sapiens
cggaagctgaacggaccgacggaggtggcgtggatgagcagcagccgcctgagcagtgaggaaaccccgcggacagcgcgatggagcctcacactgttgcccaggctggagtgccacagcacgatctcggctcactgcaatctctgcttcccaggttcaagcgattctcctgcctcatcctcccgaagatctgggactacagaaacatgaacacagccctgatcaagcggaaccgatacactcccgaaacaggcagaaaatcctaaacacacttgcagcaccagccagcaaagctgcactcacagcgtcgggaaccggaggtggctgggagaaccgggaataaacgacgggacacacgtccagccttcctgagttcaagcgccctgaattcacccaccagcacacccatgggggagacgggcacttttgtatgtgacacgggcccccaataagaaaagcctggggtgctctccctagagctgacacgtgtacacgcatgcaaaacccagccctgggactgatgggctctaggccccgacaaaggagcacaggaggcctattccatttcagtacaatgggttccgtgattggccaaggctgggctcagtcctacaccagactgacagcttcctcaccctcccacgcttgggtttaaagacatgtccacaggaagatgcaccatcagtcaacggctgctgttaggagaaacaggaacagcactgaccacacggcgagcacaggacacggccaacccggcaagcacgaaaacatgagagtgaagcctacagtgagtctcggaattccagaccacgggccaggtgctatggctcacacctgtcgtcccagcactttgggaggctgaggcaggatgaatgcttgagcccaggagtttgagaccagcctgggcaacacagcgagaccctgtctgtacaaaacatgttttaaaaatggaaacaaaaagtcgggagcggtggcacacacctgtcatcctagcactttgggaagccgagacgggtggatcacttaagctcaggagttcgagaccagcctgggcaacatggacaaaccccgtctgtactaaaactt

SEQ ID NO: 232359 - DNA, 1420 bp, Homo sapiens
cggaagctgaacggaccgacggaggtggcgtggatgagcagcagccgcctgagcagtgaggaaaccccgcggacagcgcgggatcttactggatgcactaaaaatgctattgtgagctgatcatggtctcacatgcctggggtcccagctactcaggaagctgaggcacaaggatcgcttgagcccaggacgtcgaggctgcagtgagctgagattgcgccactacactccagcctggatgacagagcaagaccctgtctcaaaataaacaaacaaaacatgctattctgaaaaggggccacagctcaccagctgctgagaagacacaaaaggccgagagcccaagtctgagctgaaggcacaggctcacatcacccaagatactcaaagcatctcccccatctgcataacccagcaaagcaaggactccatgacctgctgtgtacccaggccaggaacctgacctgccacaggcccagggctgcgtgcacactggctgaatgcattagttaatattttggtgacgctggttacttgccacctctgctgtaaataacagcagcgtcaaggatacagtggccacgagaggtagcagctgctgatgtgtggagaagcctccatagagaaatacgtgtgaaagatgcatcaagaaaacccaagctgtgatgctgttaagggctgaaatgtgtctgctgaagtcctaaacctgcaaacgtgaccttatttggaaatagggtctttgcaaatataatcaagttaagatgaggtcatagtggattagggcgggccctcacccaataggaccagcttccttaaaagaaaaggaaaaggccaggcctggcacggtggctcacgcctgtaatcccagcactttggaaggctgaggcgggcagatcatctgaggtcaggagttcgagaccagcctgaccaacatggagaaaccccatctctactaaaaatacgaaactagccgggcatggtggcgcatgcctgtaatcccagctactcaggaaggctgaggcaggagaatcgcttgaacccaggaggcagaggttgcgttgagccaagatcgcgccactgcagtccagcctgggcaacaagagcgaaactcagtctcaaaaaaaaaaaagaaaagaaaagaaaaggaaagggccagatgtggtggctcatgcctgtaatcccaactcttggggaggcagaggcaggaggatcgcttgagcccagcatgggccacatagggagaccctgtccctacaaaaagtaaaaaaattagccaggtatgatggtgcatgcttgtagtcccagctacttgggaggctgaggcaagaggatccttgagtctgggagaaggaggctacagtgagctgtgcttgtgccactgtactccagcctggcccacagagtgagatcctgtctcaag

SEQ ID NO: 232360 - DNA, 359 bp, Homo sapiens
caaatctaccctttggttcctgaactcattagagaagagaagacaaaaatacaaggaggaattagagcagaactaaatgggaggcatacttgatatagttacagaaagtattggtcttgtatttttaagagctagctttaaatcctgtcttttgcaggacttggacagtcctttagctgctctcaaccattggttcctcatcaataaagtgagaacaagtaatgccaaacttgaggctaggcatggtggctcacccctgtaatctcagcacttgtggaggccaaggcaggaggattgcttgaggccagaagtttgagaccagcctgagcaacatagtgagaccctgtctctacaaaaat

SEQ ID NO: 232361 - DNA, 196 bp, Homo sapiens
acaagctatagagccaaggtcagttgtttgaaatgtcactagactgctcttgacagagcacatattaaaacaattactcgagaattttccaaattgtgatattgtgcttggcaaactagagaacacggtgcaatcacatggatgccagccacaaggcagctgggcataaggtcatttctgcatattttagagcttc

SEQ ID NO: 232362 - DNA, 534 bp, Homo sapiens
actaaactgcctggaagaggtgggaggagagcagccattaaggtatgaggtacagagtcccatcaggtgagacccatgtctgtagccactgaggttcctgttgcaacaggtgagatgtgatcttcccaaagccccagcttcttccgcaggaggctgagacagcaggcccacggatgtccattcaggaagaggctaaggcttgggggtcaggtgaagaatcttgagagacacaaaaattgttctagtatagtcatgacttaaaattataaagaataattttcaagtcttttagcaaatccatgaattggtgtttttgtggagatatgaatgactttcagtaaaagagtcaccgaatcataataggtatggaggtggaaattctattattaagatttatgattactgaaatattttcatgattactcagatccatttctggactgaccttatgcttaaccagatgatgtttattattaaagctgatttttaacgagtgttcattaataaaaaatgctcttaaccacaaagctttgt

SEQ ID NO: 232363 - DNA, 271 bp, Homo sapiens
aggtgtggtggctcacgcctgtaatcccaatactttgggaggctgaggctggaagattgcttggggccaggagttggagaccagcctgggcagagactccgtctctacaaaaaatgaaaacaatagccaggtgtggtaatatattcctatagtcctaactacccagtaggccgaggcaggaggattacttgagattaggagtttgtggttacagtgaagcatgatcactccactgcactccactctgggcaacattgtgagatcccatcta

SEQ ID NO: 232364 - DNA, 347 bp, Homo sapiens
agctggcctctgtagacccgggctaatgatgggagatgctgctcctggcctggactgggctcccagataggagaaggactgctaaggttggctgagacaaaaggtggttccttccctggcatggggcacggtgccacccagacaaagttggagattattagcaaagaagaaggcaatgactgttggatagtcggccaatgagaacttcttcagtactgtttttttcctggttgtttttgcaagcacaagtggcaacatacagtgcatatggctctaccacttgcttttgcaccccaaaattaatagcatgatctaccttaaaaataaaccctgtagcttctacttca

SEQ ID NO: 232365 - DNA, 567 bp, Homo sapiens
agtgcagctcactgctagtgcttgtttcttggggcaaacaggaaatgagttaagcttgaatgtgaatttcagaggtcagagataaccagtgtcttcagagaacagaaagatgggatatatgcaatttaagtgcttttcactgctttaattagaaacgtagtccctgtttcatggaaaagtttgccatttcttgcatgagcctcttccattggtgtatctttccctgtgtacaggttaccagctcttcaaacccagtctgatctcttggctggaggaagaggaagagttgagcacactgccaagagttctccaagaatggaaaatgtgcctgaaaaccaaagggccagccctttggcaagataatttttgtttaaaaacattaaatgggatacagttggcaagaaaccaaaatggagaggaactctatgactgtaagcaatgtgaagatgtcttctgtaaacatccatgccttaagaccaacatgagtactcaaaatagaggcaacacgtctgaatgtattcagtatgcaaaagacctcctttctctatacaataaaacctctaccat

SEQ ID NO: 232366 - DNA, 561 bp, Homo sapiens
tgaggctttaatggcaggcctaggctcctgatgcccacttcctgtttctcacttctctcattcatccttttggattcctaaaactactcacctcagaagtgcttatgagactttaggctgcctgttgagatatcagaaatatacaaatgaatgcaatttttgttcagaaaaacctccctataagtacatttcctcatcctaagtcaaacagcctgagaacagttctctcagaagcctcttcatggatgatttcctgcttgtttacaaatcagcagtagaaggagaatgagtttactaaagtggtggctgcctttctcactcttcctgggagtgaattcttttgagctcaaaacacagaaggacataagagttcctagaactccctttttttgggtcctctgtttcctgactctgagtctgcagattttcctgatggttttaggctggatgatggcaatcacatagccactctactatggttctctcatagctactcacagagccactctgctgcaggataacttgctcatgaaaggaaatgccagattaaaccccttgcca

SEQ ID NO: 232367 - DNA, 493 bp, Homo sapiens
tcaatcagctcggtaccactccagcctgggcataagaagctactccagcctggtaggataagaatataaacttcaggtgaccgaaaaatcagaatcggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagagtaggcagcgggtgaggctggacgggagggaggtctagggaggcctctgccgcgggcactgtgagtcctggccgatgatgacgagaccactgcgcaatctgagttctgggaaccaggtgatggagtatgttctgagaacagactgaggccgaaaaagca

SEQ ID NO: 232368 - DNA, 303 bp, Homo sapiens
gaccctcaaagtttatcaaccaaaagtggagtcaggagaaagtcacagagaagagatgctgaacctagaaatggggcacctattgtgcctgcctcgcatgatggagaaattgctggaatcgactgaataccagtgacaatgggaggggaaatgtcggggagatgtggaccctggggagtccccacagactatctggcaatatctgtggcctgctaactgctggcttcaaggacatttatcagtgagcaggaggacccctgaattagagagatgcttaggtgtggcactggtgttgtgggagga

SEQ ID NO: 232369 - DNA, 412 bp, Homo sapiens
ataagaatatttgttgagcatagcatggatgatagtcttctaatagtcaatcaattactttatgaaagacaaataatagttttgctgcttccttacctccttttgttttgggttaagatttggagtgtgggccaggcacggtggctcacacctgtaatctcagcactttgggaggccgaggcgggtggatcacctgaggtcaggagttcgagaccagcctggccaacgtgttgaaaccccgtctctactaaaaatataaaaattaggtgggcgtggtggcaggcacctgtaatcccagctactcaggaggctgaggcagcagaatcgcttgaacccaggaggtggaggttgcagtgacccaagatcgcaccattgcactccagcctggggacaagagcgagattcttgtctc

SEQ ID NO: 232370 - DNA, 384 bp, Homo sapiens
gagatttggaaggaagagactagaagttccaagctcaaggtgccaatagatttggtgtgtgtgtcagtggagttctcgtcgggagcctgggcatccacacccacctggcggtaataagaatggtggcacaggaggcctgctgaaaatgggatgtaaatatgattctacatcttaacccacaatactcgaaatacccaggcttcaatggaaaatcacttactacaccaagaatcaggaagatctcaagcagattgtaaacagatccttctgcctcagcctccagagtactgggactacagccccaagacctggatgaccaggaagccagcaactcgaccagaatggcaggctgtggaaagaagtcatttggtgagcttcagactg

SEQ ID NO: 232371 - DNA, 543 bp, Homo sapiens
agtcttatccatgctgtagtatctattacaactgcattccttttcatgaccaaataatattccgctgtgtagagatacagcatattgttactcattcatgagttaatggacacttgaattgtttccacctttggctatagtgaatagtactgctttgaagacttgtctacaagtttttgtttgaagatctgtttttgattctcttgggtatatacctaggagtggaattgttgggtcatttggtacttttatgattaactttgcgagaaactggcaaactgttttccacagtggctgcaccattttacatccccaccagcaatgtatgagggttcctatttctccacattctcaccaacacttgttattatctgtttttgttttgttcttttgcttatagccatcctagtgggtgtaaagttacatggtagtgttttgagttctaagattctcacagactgggaagaaatgtggagagatttttgtccttttttttttttgcctgctgctgatccaaacagtaaaatataaaccttcagaatg

SEQ ID NO: 232372 - DNA, 540 bp, Homo sapiens
agaggggtggtgaggaagggttaaaatcaaagtaagctatgcttcaaggaaaaagaaaagaaaaagtagtcgcagcctggagaataaatttgacctctttagttttatattgttgcagctaaaacctgtgatgaggtcattcttagtgaactacttataactacttagttcttataaatgctgccaatgttttttttaatcgtgatatttaagaaagaaaaaaattaagataaatagtcaatacatattgatgagttatatgaatttgtttattcttggtattgcttcttagttgtaaaatgtgaaatggttccaaagaatgggcttttagttctgttttttgaagtagcagctattaaagtgcaaaatgcatagtaggcaaaatggtgttgatagtttacattctgtattttgtgattaaaattagacagcaatccaaaaagagaatataacttcaagtacattcatgtcatacttttgtttattctttaatgtttttcatcctagtatgaatttgagattagttttactggcattaaa

SEQ ID NO: 232373 - DNA, 254 bp, Homo sapiens
ttcctattcctctggctgctcccttccagatgccttcagagcctctccctctgtctgcctcttaagcgttggtgttccctaggccccctctgcccttctttgttctctttcctcttacatttctcaaactgtttaggtgtcagaacacctggaagtcataaggagtaccacgaaatatcaatatacttaatttcatgattagagctgggaacagttttattagcagaaactatgacgattgtctatgtatgcat

SEQ ID NO: 232374 - DNA, 926 bp, Homo sapiens
aggcggggccggcctgggccggtcatccctggctggcgcgacccgcagcctgtccgggaagccgttgcgacatgcgggctgggaaccgcctcacctccaggggggaccgcggcggcccgctagactctggtcgggtctggagtattgggccctctggccggactcggtgctcctcaggccccagcgcccggcactgagcctcgcatccacattcgcagagtaaacccaacaagtgttgaatgaatgaggttccccgggccccggctgtcactgggctctgcgccaggccaagagccgaaggcgggggaggaagatgtcgaaatgggcgggatgattcacagatgacggccggtggcgaggcggggctggaggccgcatcccaaaggcagcagggaagtgcggcggctgtggggaagctcggacgcacggcctggccgagtctgaagcatcagtattttgtccctgagccggcgcgctgatgggtcccccgcctggcgatgagggcttctccctccctcgggtcagcccgggtcctgagaggcaaggccagcgattcccggccttaggacctcctgcgctagggagcacgggcgtcttcttccatttgccttccccgagcgtgttggcacaagctgcccgcggtttccagctctgtcttctctgttttacccagatgatgcaactgtggacttctccatctgtttataggttttccttggataggaaagatgttttccttttttctttctaaagtttagcccttctctgggcttcctttttaaaaactttttctactctcttcagcagttgttattaacctttaggtcgcgaccgtttggaaaataataaaactacgaattctcttctcctaaaaaaaaaagaattttcaggttggatccggacaaagggccagaactaaaggggga

SEQ ID NO: 232375 - DNA, 491 bp, Homo sapiens
ggcagcccccattcgcccaagccgttccagtttaggccacgacaggaaaagtctgggagcccagttctgtgtccccccgcgccgcttcagcggaacagcccaagaaacttcctgtggttcagacaccttggtttgttgcaactttgggcgcagaaagttggaaagtgtgggtgcactcactgaaaacggaaagcgtggtcccaagtttacagaaatgctaaaatgcaaaccaaaaaataaattctcttttgatttctctcctcgcggaaagctggcgaaagcacacgttttatgatcgtcatctttcattgattatacacacgtgtgacttggagtttccagtaggaatactgttctttgactctcccgtacttcactgaacgagtaattagttaaaacaagtccccaaattccttaatctcaaaatgcatatgtaaatagaatctgcataggatacaaaataaaacgcgcaagtgggaattcggcatttt

SEQ ID NO: 232376 - DNA, 430 bp, Homo sapiens
gagtaggttgtgatcaaatcataacataatacctaaagaggcatcaatatagtgttgtagaaagaacaatagatttaaagttcctccactcaacaaacatgcttgtgtgtgtgtctactaccctgcaagtactgttctaaataatagagtacaggccaggcacggtgactcacatctgtaatcccagcattttgggaggccgaggtgggctgattacctgaggtcaggagttcgagacaagcctggctaacatggcgaaaccccatctctactaaaaatacaaaaattatccaggcgtgatggcatgcacctgtaatcccagctactcaggaggctgaggcaggagaattgcttgaacccgggaggcggaggttgccgtgagccgagatcctaccactgcactgggcgaccgggtaagactccatgtcaa

SEQ ID NO: 232377 - DNA, 737 bp, Homo sapiens
gaaaaaagaaagagaaaggggaaggaataagccgcaatgccttttgtgaacaagattcgaaacttacacacttctgccacactttttaaacgttatttatttatttcttagagacagagtcttgctccgtcacccaggctggaatgcagggacctgatcttggcttactgcaccttggaactcctgagctcaagcaatcctgcctcagactcccaagtagctgagactacaggtgtgagccatttcctccggcacatgttattcaatataaacaagtcactgaaatctggcacatacccagaagtagaattaagctacaccctttcagataagaatagtaaaagaacttattgaaatattccaaagccaaaaatgtggacattgaccccaactgcaaaaatacctcagcaaattccaaagtcttgaagacttctgagtagatccccccgtgggtgaggaggccaaccacaagcaacactcagtggtagcaggaggtggcaggggtgagggcaggaaacagtgcccctctcagtctcccagcagacctgccaccatgatcagccagccctctataccacccactggccagcccatcctggaagatgccaagtggacaagccagcactcagacacacagatttgggaaagtgaaaaaccatttagccctggggcttgaggcagggaaagggatgggatgggcaaaaagtgcatggccatgcccagtcccaggaaaagga

SEQ ID NO: 232378 - DNA, 393 bp, Homo sapiens
ctagcactagatcacacagcctcggagtggcagagcaagcctgacatcccaggaacttgcaactatcagcagcttctttcccctctctgtgcctattttctcacctgcattattgaggtttccaaagacagtcccagatctcctatggtagaggcagggggcgactgtccaagcaccccaccacgcccactaaaggctggtccagcttaaacgtactgcggagaggggtccacagggcaagatcaggccacagtgggtgtctggggctgcttgggcccagcacgtctgaggccatcatttgtttggatctttctattaccttttcctggaacagagtagaagactggaaaggacttttcaggagaagtgagaggtgaggttaaaaaggcagga

SEQ ID NO: 232379 - DNA, 1281 bp, Homo sapiens
atttgcagacatatgggtgattggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactccttggcttgttattagaaaccgcctgactaccgtgatggggtatataaaggccttttggcacaattatccggctttttaccaagatgtttttggatgccctcccggcacttggtttcaatatttaggggctggggtcaatcaaccttgcacgggtgtactatccgtggcatcattctttgccttttctgccgccactattcctggtctatctctctctcttacctctcactctctactcggctctacctcttctcttatctagcttcatactatatcaccgtactactctcacaccgcctctaccactcctctccgcgtccctatcctcctcgcctagtgttctgctttgtccttctctgtacgctcctcttatgctacttctatctctccttgctcagcctctcctgtagtccgccatctacgctcctactccctattcatcattgcgctccttctcctatcccg

SEQ ID NO: 232380 - DNA, 1062 bp, Homo sapiens
atttgcagacatatgggtgattggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtgtatgtactgcccctgttttggtcaagaggaagtatctagaatttcaaatatttagcaacaaaagtttattccttcagtggaagatttataataatgataggtgataggcccacaaggaggacttacaatgtggaacttagtctctttccctcactcctgtagagtaattgctttccctacccctttaatctttatactacctctgcaaatgataaaggatgatggctctattgagaatttacaattttttgtcatttttttaatgtggagttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattgaagattccactcgtggtatgagagtggataatataatcaactcctctgcctggtaagtgtctattcttgttagaatt

SEQ ID NO: 232381 - DNA, 1120 bp, Homo sapiens
atttgcagacatatgggtgattggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtgtatgtactgcccctgttttggtcaagaggaagtatctagaatttcaaatatttagcaacaaaagtttattccttcagtggaagatttataataatgataggtgataggcccacaaggaggacttacaatgtggaacttagtctctttccctcactcctgtagagtaattgctttccctacccctttaatctttatactacctctgcaaatgataaaggatgatggctctattgagaatttacaattttttgtcatttttttaatgtggagttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctggtaagtgtctattcttgttagaatt

SEQ ID NO: 232382 - DNA, 907 bp, Homo sapiens
ggctgcaggaattggcacgagggaagaacagcctttcaaatttgacttctgcatgtggatagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtgtatgtactgcccctgttttggtcaagaggaagtatctagaatttcaaatatttagcaacaaggaggacttacaatgtggaacttagtctctttccctcactcctgtagagtaattgctttccctacccctttaatctttatactacctctgcaaatgataaaggatgatggctctattgagaatttacaattttttgtcatttttttaatgtggagttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattgaagattccactcgtggtatgagagtggataatataatcaactcctctgcctggtaagtgtctattcttgttagaatt

SEQ ID NO: 232383 - DNA, 455 bp, Homo sapiens
cagctacttgggtggctgaggcaggagagtcacttgaatccaggaggtggaggctgcagtgagctgagatcacgccactgctctccagtttgggcaatagagcaagactctgtcaaaaaaaaaaaaagggggaaagagagaaagaaaaagaaagaagaataaacagcaaatgtgatcaatgtcacacagagaggaaaggaaataataagaattattatgactatcaacaaaacccaaataaaactatgttcttcttccagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggtaaagcccaggtgtttctaccatcatgggatagagaggggtg

SEQ ID NO: 232384 - DNA, 727 bp, Homo sapiens
gggagagcacatgtgtttttatgagaattatgctgagatagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctggtaagtgtctattcttgttagaatt

SEQ ID NO: 232385 - DNA, 169 bp, Homo sapiens
cccacctgcctcccacgtgcctggcctccctctgccccgccccctttgtcactgcagacaaagcttttcaccactgtctttggttcttccccttactccaaatcacaatgatccccagtgtggctttgccttgggaattaattccagagttttaaatgatgaacataat

SEQ ID NO: 232386 - DNA, 447 bp, Homo sapiens
gaactataataagctattttgaagtgtcattgtcaatacaaagtacataccagtgtgagattttaagcagtaataaaatctatgtgtggaagagtaaatgaagcgtttctgcaatattaatgaacggacagatatatgggaagaagtgatattaaaccttgccatacactctgacaatgtacatgaacagagccagtttgcttgtaaagattagtaacatatcattgcaatagatgtgcatcctgtggtctaaacttattcctaaatgacatcttgaagtttggcctgtccaaaaacatcttttgaggaaggacagatgctatagctgctttcttcaaggaaaaaaaaaaaagtaagtgacatcacaccttgttttaaacttaatgaagtgaagtaaggatgtcctctgaaaaactggccggaagtaggagtagtaggagggggagg

SEQ ID NO: 232387 - DNA, 114 bp, Homo sapiens
tgagagagcaggatgctgtctcaaaacaaacaaacaaacaaaagttaccaattatgtattttacatttttaagcaatttgttttcctcttatgtattctgtggtgctttagttt

SEQ ID NO: 232388 - DNA, 401 bp, Homo sapiens
aaggaagtggacattcattcattcaggatgttctgagtatttcagcaccaccaggccctgggaaatcaaggtctcagcagatgacggtggcagtttgatttttggctgaattgtcctctacagcagtcactgggggttgcgtttttctcacactgcccagtcatgcagcacacggaagccatccatatgccatgggaaaatgctttgtctcctgcctgggcgccccccgagccagtgagtacagtcctgcctagtggcaaggtgagtgtcctgttcccaagtcatgaaaatgctcttcactggggcgggtctgccgagttgggaagggcacttacggtttaaaccgagagactctccctgcatttgaaatgaggacatagagttctttttctctttacttt

SEQ ID NO: 232389 - DNA, 472 bp, Homo sapiens
cttggtggctcacgcctgtaatcccagcattttgggagggcgaggcaggcggatcacttgaggtcaggggttcgagaccagctgaggcaagtagtgaaaccccatctctactaaaaatacaaaaattagccaggcatggtggcgtgcatcttctagtccaggctactcaggaggttgaggcaggagaattgcttgacccctggaggcggaggttgcagtgagctgggattgtgcagctgcactccagcctgggcgacagttcgagacaacatctcagaaaaacaaaaacaaaaaaaaaacaaaccaaaaaaacattttttttgttgctaataggcaaacatatattattatttcattatatgtatgttgaattatatgtatgttgccaggttatctactggcacctgagattgtttttacccatttgtttgagttctttgtatataaaacttaacccttcaagcatacttta

SEQ ID NO: 232390 - DNA, 471 bp, Homo sapiens
cctttcacgctcgaagatacctcatttggatgatacaatgttaccttacctactctgtgacctttgacaagtctggttgcctccgtagccctcagctttctcatgtgcaaatgacagatgaagtgcgcatatcttggaatcttggaagtgatgggggtgtttgatgggacctatcttgtcaatgccctgcagccaaagaccactgggagcacacctcacctgtggttaacaagctgggtttcttcttgcagtaagggggaatgaacaccacagcgaaccagggggagtctctgaaagaggtattagaaaggacttgttactggatttgggccagtgctcggtggcttggcgagggtttaagaagcaggcctttgctctgaaccggctgctgtcaggaggcggggctcattctatgactgggtgtcttcttcaaccttatctaggataaaataaaatcataaaacactgtgc

SEQ ID NO: 232391 - DNA, 417 bp, Homo sapiens
aggttaaggaagtgttccagtgctgtagagtgcactccagaggggtgcaagctgaagaaaatctgttacccatctagaaaaagaagtgagaataaaagcatcctcttagtctccttcctttccgtatgacctagggtggaggaaaagacagggagtgttcgactgttttccctccctggttcctgggttctgccaccaagttaaatatgccgcccatggttgaagacatggtcctccaagccatggaactggataaactaagtgatgggactaaccgtgctttactgcgcaaccttaggtcatccaccttctgtgatttccctttgacttcctaaacctgtgtgatctgcctggctccccaaaaaacgtatctccagagagactgtgtcgtctttgagcaaggctcctttaatggag

SEQ ID NO: 232392 - DNA, 514 bp, Homo sapiens
acaactgtgatggttcattttatttgtcaacttggctaggctgtggtgcccaattatgtggtcaaacaccctgaggatgttgctgtggaggggtgttttatatgtgattaacaggcaaataagtagactttgagtaaagaaaattaccctccataatgtggtaggcctcattcaatcagttgaaggccttaagagcaaggacagttttcatgaagaaaaagaaattatctccaggaattcaaggtagaaaccctaactgagttttcagcttgctgtcctgcggaattcagtctcaagactgaaacatcatctcttaccaggatttcccatctgtggacctgtcccacagatttcagactggccagcccccacaatcatgtgagccaattccttccagtcagtcaaacaatcagtctacctatctaagagcctattgcttctgcttgtctggaaaaccatgactaatacaccagcaatgaaaattaagaaaataaaacttgaaaacaatgtcata

SEQ ID NO: 232393 - DNA, 315 bp, Homo sapiens
ctcaccgcaacctccatctcccaggttcaagcaattctcctgcctcagcctcccaagtagctgggatcacaggcatgcaccaccacgcccggctaattttgtatttttagtagagacagggtttccccatgttggtcaggctggtctcaagcaatcctccgaccttggcctcccaaaatgatgagattacagatgtgagttgccatgcctggcctcttttttttattttagataacagtcttttatcagatatgccttttgtgaatattttctccaattttgtagctcgacttatttattgacagtctttatttt

SEQ ID NO: 232394 - DNA, 457 bp, Homo sapiens
tacacttagcttacttaacagtccaagaagttattctttaaatatgtactgttgataaggatgattgttataattttttttaaatagtgaaaaaatggaaactactgaagtcacccaacaatgggggattgtttaattataacatgttcccagtgtcatagttaacaattaatggccgggggcggtggttcatgcctgtaatcccagcactttgggaggctgaggtgagcagatcacttgaggccaggagttcaagaccagcctggccaacatggcaaaaccccatctctactaaaaatacaaaaattagctgagcatgacggcgcatgcctatagtcccagctactcagaaggctgaggcaggagaatggcttaaaccccggaggcggggattgcagtgagccgagagcgcgccactgcactccagcctgggtgacagagcgagactctgtctcac

SEQ ID NO: 232395 - DNA, 506 bp, Homo sapiens
tggagaagtgaagttgattgaggggaagggaacatgaaaaattgaaaaacataaccactaggaaccataaatgtattgaaatactgcataccctccccagagtgttgctcatccaaatatcagccgtgaatgatggggcaggtcaagaacaacttacggacagtagcatttgagggaattctttctaaacatcaataacatagccattcttttcctatttataagctgtttgacaaattctgagcagagactgaaacagaagtctctagaagcaagagaagtctttattcctttcccaaattaatagattttgaatacatcttttttaaaaaaagaatacagtagaaaatatttgtaatatgaccatttagttgatgactttcataacactgtaatacccaccaatgagtgtctacatctcattttctaggccttgcagtgcatcagtactgacagtggtgtcgtttaaacaaagatcccatccctttccaactccctagccctaa

SEQ ID NO: 232396 - DNA, 452 bp, Homo sapiens
tggagaagtgaagttgattgaggggaagggaacatgaaaaattgaaaaacataaccactaggaaccataaatgtattgaaatactgcataccctccccagagtgttgctcatccaaatatcagccgtgaatgatggggcaggtcaagaacaacttacggcctatttataagctgtttgacaaattctgagcagagactgaaacagaagtctctagaagcaagagaagtctttattcctttcccaaattaatagattttgaatacatcttttttaaaaaaagaatacagtagaaaatatttgtaatatgaccatttagttgatgactttcataacactgtaatacccaccaatgagtgtctacatctcattttctaggccttgcagtgcatcagtactgacagtggtgtcgtttaaacaaagatcccatccctttccaactccctagccctaa

SEQ ID NO: 232397 - DNA, 479 bp, Homo sapiens
tcaggaaaccacagccaggagcagctgatggggcagctcagcaggtagggcaggtgcaggccatggacagtcagcaagggcctgcagggagcctgcagagcccgaaagcacctcccaactctgcagagcagcagctcgcagcctcttctaaacaccgtgcacagttctgcagttcttggcccttgtctcatattatgttgctgaaaaatagaaggaaaattctgcagggtctgacgctgaccctgaacaggatgcatgggggtaggtcttgcacagcggcctgtgtggaagggtcgagtcataagagggtcatgcactcaaaataacgagatggatgtcgcctggaggagagtcccttcctgcctacattcacagaggccatcctttgctgtctgtgatgggcatattcaaatcaacataaaaataaacggcaaagaatgtaggtttctcagccaaactgctccatacaaacacaaata

SEQ ID NO: 232398 - DNA, 285 bp, Homo sapiens
tctattatctattcttcctgatgctctccctccccctcagcatatgacttggtccctataaagaaatcacatatttttttatcacattatagttgttgcagataccttaaaatatcacctactggctatgacttatttgacttgatactattattagacccaccactggatattgtaatctataaataatcatatatattactatataataattttttattttgatatttgtatcttaatgtaattattccctttctagtcttatatatttaattttatgccttt

SEQ ID NO: 232399 - DNA, 476 bp, Homo sapiens
ctggggcagggagtgtgcttggtgtaacatcccgctctttgagtttgattctctgggtgtttgctcccataccccgctaccatcacagtggctgctcacctctagtatcccttccttagttacctccaagtgtctgcaggaatgtggcagtggggtgggggttgtgtagcaagaaaaatccgctgggcatggtggttcatgcctgtaatcctagcacattgggaggccgaggcaggcggatcacctgaggtccggagttcaagaccagcctggccaacatggtgaaaccctatctctactaaaaatacaaaaattagccaggcatggtggcgggctcctgtaatcccagctactcgggaggctgaggcaggagaattgcttgaacccaggaggcacggaggttgcagttagccgagattgcgcccgtgcactccagcctgggcaaaagagcgagactccgtctcacaaaaaaaaaa

SEQ ID NO: 232400 - DNA, 1512 bp, Homo sapiens
  misc_feature (112)..(112): n is a, c, g, or t
gggaggaagaaagggaagagggaaactttaaaaaatataattcctcaatatgtaaactggaaaaatggccccatcagcatttcttgtgcacaataaatactaattgttcaanactcatgtatgtgagaaaaggagacaaatacattgaccaaacataactcctatatacaactgaactaatgaactaacccaacaacccttgaattagaacacatgaaaatatatttaaaaaaagaaagaaaatatattaaagatttaaccaaccatcaagcatcaaaataatacactatactaaagtattacagcataaaagaagcctgaagtcaccctctctgctacctttcttttgagaatagaaaaaataaaaatgcagttaaattaagagtaattctcactggagcattaggaaccaagaaggctcagctgtcctcagggtcaaacgtaaggacagaagttttcatgtggactctctaaacccgaaatggcaggaattaaaatagcagcagcagcaagggaaataacacagttgagaagaggaagtaacagacactactttcatcatgtattggcccagttccagctctagattaaatcaattatattctagtgaattttgtatattcctctttactaagaagaggaagagaaaaagaaaacatcattttatcaggctttgcatgttcttttcctagaaatttttatagtgagactggagtcacttcattatggactaaaatttactaattcattaagtttttgtgtgcctactaagtgctaaaagtgatttacagtgattcatatagccatgatcactaccgtcaatggggggaaatacctaatatgaggatagatatgagtgaacagtacttacagtatattatgagtggagaagtagagaatgttattaaaaaacctaagtagggcatctaaactgtcttcagggaaggaaaggtttcctggagcaagcaatggctgagctaagatctgaagaataaacaggagtaggccgagggagtgaggaggcaagggtgttccttaaggagagaaaatagcatatgcaaagacctaaagaggcagtatggcatgtttgagttgctgatagaatttttgtgcggcaaaagcacagaatgccaggtaagggcctagaaggctaaagcagtaaaatatgagctagtctatggggttaaactctcaaaaagagctcaacaagctcagaataaactcaggtaaagagtaaagaggagggtgggcacagtggctcacgcttgtaatcccagcactttgggaggccgaggtgggcggatcacgaggtcaggagatcgagaccatggtgaaaccccgtctctactaaaaatataaaaaattagccgggcatggtggcaggcgcctgtagtcccagctactcaggaggctgaggcaggagaatgacgtgaacccgggaggcggagcttgcagtgagctgagatcgcgccactgcactctcacctgggcaacagagcgagactctgtctc

SEQ ID NO: 232401 - DNA, 326 bp, Homo sapiens
agagtggctgcctcgcagattgcggctgcctcacagattgctgcagcctctgcaggcccaagatggaggtgtcggaagcagccaaatctttctgattgccagtctgtttctccaggaagcttcattatatccagaaagatcttactggggagtatatccatcccatctcataaggtactttgtttccagggtgctgatcctactggtggatcattcagaaagttaatcaggtgctcctaaaatggtttttggaacttccaagttcttactcagaattccaagccataggagacaggtatctaaggtgccaagctgattccattgtg

SEQ ID NO: 232402 - DNA, 267 bp, Homo sapiens
tgtatcttgttactgtttgaggttagacaagtatatgcatttctgaagattcttttttgaatagtacatttaagatctgtgcatttcacagtatgtgaagtatgcctcaaaaaaaaaaattcgtaaaaatattgaaacctggctggccacagtggttcacgcatgtaatcccagcactttgggaggtcaaggtgggcggatcactcaaagccagggagttcgagaccgttctggccaacatggtgaaaccatgtctctactaaagta

SEQ ID NO: 232403 - DNA, 468 bp, Homo sapiens
ttgttaaggccaatttttttatggtaaaatacatatattaaatttaccattttaactatctgtaaacgtatcgtttggtggcattaagtacactcgcgctgttgtgcaaccatcaccactatccatcgccagaactcttgcatcttcccaaactgaagctctgtctccatcaaacaacaactcctcatgcccccttttcccagcccctggcaaccctcattctactttctgtctctatgaatctggctgttctagggacctcacagatgtggaatcatgtggaatttgtctttttgtgactggtttctttttcatggaaaatgggccaatgacatatttgaaatgtagtttatatttgcattaaagcagtaaatgtacacagtagtggaatcaccatcctactcgtgaagcccatgaaagccacatggtatccctgatgaaaaattgaaaaataaaatattcttaaca

SEQ ID NO: 232404 - DNA, 429 bp, Homo sapiens
gcaggagaattgcttgaacccgggaggcggaggttccagtgagccaagattgcgccactgcactccagcctgagggacagagcaagaccccgtctcaaaaaaaaaaaagaaaaagaaagtaaaatttaaaaaaaaattagccaggtgtggtgacacatgcctgtgattccagctaatcaagaggctgaggcaggaggatcgcttgaacccagcaagcagaggctgcagcaagccatgattacgccattgcactccagtctggtaacagagtgataccctgtctcaaaaaaaaaaaaaagagaaagaaagaaaatgcaattccctctggagtcagatgctcttggatttgaattccagctccagcactgtctaactgtgtaaccatggacaaggtcatttacctctctgggcctcaatctgctagtcagt

SEQ ID NO: 232405 - DNA, 1670 bp, Homo sapiens
tgctgaattataggtagccatgtcccctgcacactctctgtgttaaggattttactgtctagggattctgaatgttcaagctcttctttgctattattaaaggagagattaagctcaattaaaaattaccaaaaaaatcagctgtattgtcattagagggttaatcgaaattttaatgttatagatcatattaaccttttctaaataagagcaccttcatctgagtttatccttgtcagacttgccccttataacattaggcagaccatgactcctcttcaatcctaataggtgaagaagacatcaggacagcatggaagtgtgtccacaattactctgggttgtcacaaagatcttgactgttatctaggatgaccctttttagcatttgagcggtctctttaaaaatcaaacgaaatatatggtcctcgttctcataaaataaaacaaaaacaaagcaaaactgaaaagaccaagaaacaaaaaggtaaaacagatacacatgggattgttcattacctgtaggttaagaaaccctggtctgggaatatgagattgaatcagtgtaccagctttggaacatagtaagaactgaaagactaatagatgacagaatgttacagacgaattcacaatgagccatgaaggaataggagaccaatggcaaggatatagaagaacctgggcctgaaatatgctagtccttcagtagcatgacttagataaggatctgtatccctggactccccaatttttggggagactatacctggactattttatttgcctgaacatcttaaataaaaattcaagggaaaagcagtaaaagtacataacacaatagagaaataaatgaagaaaaattaaaagtactttagattttcccaacatgaataaagaaaactgtctgtagagatatctaaattataaagagaagaaagacatatttttttatcatggttaatggagttataactagaaacagagaaagctatatatgtgtatttatttttataggaatgaacatatgtactctctcacaaacaaacacgtgtgtgtgcatatgtgtgtatgtaagagatataccatttatctatcttcctagctctctatataattcctttgacaatatcattactagtagattcaggtactatctctcaagggatgtagtataaaacatagctttctctgtagaatgaaaaaaatagactagatatgtgtgagcagattggtgtatgcaatttccaagtaaactccaaggcagtgaaatacgaaagtttaaaaaaaccaagtttccaaaaatatcatagaatttctgaaatatgtatatatcatagagtatatttctatgtaatcaattagtataaacatgccaaaaatattagctattaattaaattggagctataaaataagactattcattgagagttttacatggtatctctgtaaacatgattaaagttctaacccattgtgagatgaggaataggctgcctagcaactgttttaactagttcccctgagattctcaagcaaaaaatgggtgtatggatgggagtatttatttttgtttctatattaaagcttctagatgattcctaactagtcactctcattgtttttcttcttttcatcatctgaaagtaataatttttaaaaatagta

SEQ ID NO: 232406 - DNA, 376 bp, Homo sapiens
tgttgatgactagtcaaatcgaaaacaatgtgcaggccaaatagtttgtaagctctgcctttgagctttaactcttagttgcctaaaacaccaaggacttagaaggatccacctgcctcagggactctgggcatcaatatgtggatggtctgtggctttatagcagctgatgacaggagaaaaccttgcccaagaggaagagaaggaacagatgggactgccatctgtgaccccaacccactgagcatcagaccaggcagtaccagccaagaaaagggaaagaaacacagaggatggtgtcatgagacaccaaagttctaatccagactggacgacctcggtcaagtcacttaacttctctcggcctgtttcctta

SEQ ID NO: 232407 - DNA, 434 bp, Homo sapiens
agggaatagtttgctcatactaaagtgctgtatataaaggaaatcatattagttcattcaatgtaaaattaaaattaaaagttctaagtaatatatttagtgttgctgtttatttcagtaataccacccacaatgagttgtgacatttcagtgagtatttcataatgcagaattcaaaatctagcccatattggacttacgtgaagaattatgatctgcaccatttgttaaacagtaataagtaatccaaccacaaccaacagactctgagtgtgaattaaaaaaaaaactccaaaccaaagatctaattgtggaaggattgcaatgaaaccttaaattagtacattatattagttcaaccaattccttagagattcttagctctagaaaatggttttgtgaacatttctttatcagtgttagatatgctaggt

SEQ ID NO: 232408 - DNA, 539 bp, Homo sapiens
cactttacaaataatgctgctgccaactactgtgtacaagtctttgttgtatggacatacaccttcttttctcttgggtaaatccctaggaatggaatagctagatcacatggtgggtgtatgtttaatgttttaagaaaacatgagactcttttccaaagaaattggaacatcttacattcccaccagctatgcatgaaatttccatttctttcccattctctccaacacttgctatgtcacagttattttaattttggccattctaatttatatttttcttaaaactagtgatatgagacatctttacataaagtatctgttaaaatctttagcccttcttttactgggctgtttgttttctcattgttggagctttgagagaaccttatatattctggatacaagtcctagatcagatatctgctttgcagatactttcactctgtggcttttatttttagtattttaacaatatattttaaatcttgatgatgttcagctgatcattttttttcttgtatgggtcatgttttaac

SEQ ID NO: 232409 - DNA, 557 bp, Homo sapiens
cagctttacaaataatgaagccaactgaaatgatttatcttgactattactaataaacatttattctttaataaaatcaagctatattcacctacatttttatcagcagattcccaaagcaaaaaacttttgggttattctaccttttgttaattacaaagttcaatatttctagcagaagacttcttttttccagaaaaggagggctaggttatttggattgcctttaaaaattgaaaagctgataaaagttgacgagtggggactcaatgtccacttttaggataaagcctgttttctgaataatatattgaacggggttaggggagatccaagctacattttccctgagggaactgggggcaacacccagttggccaaggttgttagtcttgtggagtgagggagacagaagtccagcacaggaggacaggtccgaaagtgtccctatagcccttaaccacaggtgcaacccccacagcatgagagttaagcagaactaaacatgctcttctgcctcataaccgcaagagactagaaaacgtaaacaggagaaa

SEQ ID NO: 232410 - DNA, 467 bp, Homo sapiens
ttgtcattcctattgtttatattattctcaatatttcatattatgttattattatttaatacagtgctgtgcatattatttgtatatttctggtgttttgtcttaaaatgtaacaattgcaatgattgactcaaagagtttccattggcttcccaaatgaacctttagcacaataatacaattaagatagtaataatgaatatatgtgaaggctaacattcaatacaaagattagaaaatagataatagtatttcacataaagatgagaactaatgcattatatttggctgaaacagaaaagtgaatgtggtattgtgttagtgaatcacagagcaatgtgataactttgaacctattaacatatggaatttttcacctactaacttcacttttcaactgacttactttactaagatccctaacattttatcctaaatatttatttattgattaatgggagattatt

SEQ ID NO: 232411 - DNA, 382 bp, Homo sapiens
atccccccaggatctggagggttccccgccttcccctgctcaaaactcttgagaagacaaaacccaaacacctaggggttgtggaaatgttctaaaatggattgtggtaatggacacacaactccaaaaatactgaaagccattgacttacgcaccttaggtcagcgagttgtatggtatgtgaattatatctcagtaaagctgttacaaaaggaggaaggggcagggtgcggtggctcatacctaaaatcctaacactttgggaggccaaggcaggaggatcccttgagcccaggagtttgataccagcctgggcaacatagggagatcctgtctcttaacaacaacaacaaaatcaaccgggcacggtggcgtgcacctg

SEQ ID NO: 232412 - DNA, 372 bp, Homo sapiens
caggcagagatttgggaaattcctaaatggcaaggcatagaaagttgtcaggcatagttagtgcctacatcttggtttctaaataccattcttcagtgaaaagacctagggctctatggacatgtagttggttctaggactatgacagggaaagtaggaggagaagcctagaacatcttgtggtgccagaaaataagaaagtgcttaaatagtaatgggaatacatcaaaggacacaagagacaactttaaggattttccattggccaaatctaggacaatttgtgcaacaaattaaacgatgacaataatgggttatagcccatagaataaaataaatgcacgagtccataccaatataaataaataattg

SEQ ID NO: 232413 - DNA, 366 bp, Homo sapiens
agaatgttcttaacatgcagattccagctccctccccctagggattctaatccaataggtgtatgttggcttgttgcaactataacacaattcctccaggtgatctgagaaccataggtgtaccacaactgaatcatttgacagctgcagaaactgaagcccacggagggaaaggggcttgcccaaagtcacacagcaagttaagggcaaaggcaaaattcaatcttaagtctccttattctctggccagaaccctttccaacttctctttttcaaaagatcaccaacagctgtggtgggggaggaccatttgagcccaggagtttaagaccagccctggcaacacagagaccctatctctacaag

SEQ ID NO: 232414 - DNA, 394 bp, Homo sapiens
ttcacctgttctcccccttcctgtgaggggtggagcacagcaggaccaaatgagtggtgtccatccctaccagcactgaaggggctgctggctatttctagtgcccgggcactcgagtttcacccatgaagaggtcagagaaaattttctgcttcagtaggtgctttatcacaaacttctcattgtttataattctaaaattcacttgtcaattgattggttgaaattcaaaacaaattttcttttttgtgttatttatgtattattgttacataataattgtacatgtgactttgtccattaaacaactatgacgaaataagccaacaactgaagaacaaaaggaagaatgaaataatcttcattgtgaacaataaaaatcattctacaaagc

SEQ ID NO: 232415 - DNA, 545 bp, Homo sapiens
cacacttttgaacgtagtggggcttggctgctgcgagttacgcaggtatcctggagaggcagggcacccggggacacggatgactcgaggccgacttcgggtggctctctctgctccttcctgtgggggtgaagacgcccgggtcctcgccggcccgtgcgcaggggagcgggaccgaggagcgctctcgctccgtcctgcggcgtcccgcgcccaggtgcacatcggggagctggggacgcaggcgactcaggcagtttctgggagtcgttcttacgtcatcatgtcacgggcagaacagggcagagcgcccgcctttctcgcaaaaccctcctgtcccttgtgtacttacactgttacaagtaaagacttccccaagtgaccaaattttagagcattacagtaaaattggtacttgcagatgcctcagcttgattccttaattgatacgtatctagccacaactttaaactaccgagggacgatgtaagactgctgtgtcgcttttctttccttcaaataaacttttactcggtacctgttct

SEQ ID NO: 232416 - DNA, 497 bp, Homo sapiens
  misc_feature (107)..(107): n is a, c, g, or t
  misc_feature (109)..(109): n is a, c, g, or t
  misc_feature (120)..(120): n is a, c, g, or t
  misc_feature (126)..(126): n is a, c, g, or t
  misc_feature (130)..(130): n is a, c, g, or t
  misc_feature (151)..(151): n is a, c, g, or t
cttaagataaagattgtacttgacagtttagtatatccataaaactatttgaggtggttaaggttcttgggttcattttccttaatactttgctgaatattgagttntnttgggggttgnaagagngggnccccaaccaaatagaaaaagnatctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatccaatccacccataaattcccatatgtgatagaaaaaaa

SEQ ID NO: 232417 - DNA, 648 bp, Homo sapiens
caggcacctgccactacgcctagttaatttatacctgaagtttctaagaaaaaggaataccagtcaactcaatgtactccctggtcatggggaaataagattgttttcttccagatatttgatctccaatctaccatcattataatctgggaatgaccttcaagaacaaggtgaatgtgttcttctgatatgaaaaatgatttgcaggaagaagcgaaattacgaacaacagcaccaagcatttacagagaccctacaacacaacaaacacacactttacttatattgcctccatctttaccctcatctttctcagatgaggaagctgagattcagaggagctaaataactcattcatcttcccatagctagtaaacagaagaattgggatttgaacccaggtgtctttaactccagagcccatgattacttttcttttacatagttatatcccatcaactcagagcactttgattttcatacatacccacaggtgctgcattgcttggacgatattcaaagtgatatgagttttctccaccttccatttgtcctctgcacaaaaaattcacctgtcctctgtttgattggcttattaatctatcatactgtgagaaaggttaccaaaatgctaaagcagaggatttt

SEQ ID NO: 232418 - DNA, 594 bp, Homo sapiens
caggcacctgccactacgcctagttaatttatacctgaagtttctaagaaaaaggaataccagtcaactcaatgtactccctggtcatggggaaataagattgttttcttccagatatttgatctccaatctaccatcattataatctgggaatgaccttcaagaacaaggtgaatgtgttcttctgatatgagagaccctacaacacaacaaacacacactttacttatattgcctccatctttaccctcatctttctcagatgaggaagctgagattcagaggagctaaataactcattcatcttcccatagctagtaaacagaagaattgggatttgaacccaggtgtctttaactccagagcccatgattacttttcttttacatagttatatcccatcaactcagagcactttgattttcatacatacccacaggtgctgcattgcttggacgatattcaaagtgatatgagttttctccaccttccatttgtcctctgcacaaaaaattcacctgtcctctgtttgattggcttattaatctatcatactgtgagaaaggttaccaaaatgctaaagcagaggatttt

SEQ ID NO: 232419 - DNA, 371 bp, Homo sapiens
tagagaaagagaaaatttgagagagacaggttgaatgctcagacagtaagtaggcagaaaatctcagaagagcagtacagcttcctaaaatgctcctggcttccatgcatctgtcaaactttcaggtagattttggggtgtcaagcatgatcatacagaaaaactgactcaccacctggaattctatgggttgagaaggaatgaaaagtggataacaaccagaaagaactctaatggtccagaaggccagcagcggcaattctgatgaaggaagcagactaccctcagtggcagacctaggccttgtccctggagaatcctgctgctgggatactgctgggtacacaaagtaaagaatgatttgtggaaca

SEQ ID NO: 232420 - DNA, 515 bp, Homo sapiens
ttgttttcttcttgttaatctgtcttttattatatgagtcccagctaagacctaagatggggagaggtgatctttagcctcttctacgtatatacttgtgacatagttaatgatatacatgtcgaagtatttcagggaaagtctgctaatgtttgcaactttgaaaggcatcaaaaactaagattgatgaaaggatggagggattgataggtatgttatcaaataaggagaataaaatgtgagtaaaaatagtttccactgttggtctgaaaatttttataataaaatactgaaaaaaataattgatttttttttttttgagatggagtctcgctctgttgccccaaggctggaagtgagacccttttggtgagaatggagacaccagtaacttacagcttaacaatcaccaatgagaactaagagctctaaatcaacctgattttactgttccaggaattcttactcacgaagataggctataggtcaatccataccttcattctgagctttag

SEQ ID NO: 232421 - DNA, 1359 bp, Homo sapiens
tgcagtagcttcaccagatttcgttgcgtctgctgtccaagattgttgaggttagcgttatttatagttaaatatgagagttgagagtgtgggggaagttgttgtctggtactgcacccaaaccaggaggataaaggaggccgcgggcccctcccttcgcgcgggctcgcacctctccccagcctggtgcacctgggctgacgccggctcgggactcgtgcggagcgccgcgagcgcgcggaggcagaggcgcgctgactgccacctccagcccgtgccggagggacagcacgcgctgcgcaacggagaccgttctccttggccgccgctcacggctcgcggcgaccaccgccgttgaagctgcaggcgggcagccgtgcgtctcccgggacagccagccccggcggctgctcctcccggatgccagggccagggcgccgggcggccgccagcaggagaatgaagagctcggtgggaggaaggagagaaaagctcctgggggcgccgaaagctcagcccagccgcgatttcacctgtgtacacgatggcgagagtgaggctgaattaatacctgatgactttgaagaaaaaccagaaagagaaaagaaacataccaactttactttgtgcaatgtatgtaacattcagctgaattcagccgctcaagcacaaatccactacaatggcaaatcacatcaaaagagattaaaacaactcagcaatgggacgctgaaaaatgacaatggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaaagctgtaataaaccatacattcggggttcctcttccccaccgaagaaagcagatcatatcatgcaacatttgcccagttgagatttaattctgatagccaggctgcgggcccactacaaagggcacgaaaattgccaaggaaggctccacagcactggaagccatgaaaaataaagcagaaatctgtaactgcccaggacagcgcccaaggattaccttcactccatcaataccattaccatcaattaccagctctgaccagaaccggggcggaaacaacggtgcgcatggaagccgcgttgggtttaatcttaccattcttgccagacgaagggttctggcgggaccaggaatatcacgagcgcacactgtgtacacccgcaaacagcggtttgtacaacggataccccctctaagtgggaaaagcgcctatgagccctgggaagacagtcc

SEQ ID NO: 232422 - DNA, 1065 bp, Homo sapiens
tgcagtagcttcaccagatttcgttgcgtctgctgtccaagattgttgaggttagcgttatttatagttaaatatgagagttgagagtgtgggggaagttgttgtctggtactgcacccaaaccaggaggataaaggaggccgcgggcccctcccttcgcgcgggctcgcacctctccccagcctggtgcacctgggctgacgccggctcgggactcgtgcggagcgccgcgagcgcgcggaggcagaggcgcgctgactgccacctccagcccgtgccggagggacagcacgcgctgcgcaacggagaccgttctccttggccgccgctcacggctcgcggcgaccaccgccgttgaagctgcaggcgggcagccgtgcgtctcccgggacagccagccccggcggctgctcctcccggatgccagggccagggcgccgggcggccgccagcaggagaatgaagagctcggtgggaggaaggagagaaaagctcctgggggcgccgaaagctcagcccagccgcgatttcacctgtgtacacgatggcgagagtgaggctgaattaatacctgatgactttgaagaaaaaccagaaagagaaaagaaacataccaactttactttgtgcaatgtatgtaacattcagctgaattcagccgctcaagcacaaatccactacaatggcaaatcacatcaaaagagattaaaacaactcagcaatgggacgctgaaaaatgacaatggaagttgcctagaggattgcatcagttactatattttactgaacctaagatgtcatcagttcgaagatgcaatgttatgatacaccatcaatttcaaagatgtcaaaatgggaaaagatcagcatcttaaaatggaagaatatatttaaggtacttacaaatagcacttaatataagttgtttatcattttatcatgaaatcttcattgctgttgtaattaaaattaatagtatatcaacacataaaatagagataacagatgtattgaagaagttcatctgtaacttcccaaataaatttattgtggaaaaccataaaa

SEQ ID NO: 232423 - DNA, 452 bp, Homo sapiens
agtattacataataaaatgtctccaatatcaaacatgtttgaggaactttgggttacatttaatagattttacacaggagttctcagtgactttaacaatcctagtgaatactaggtcccaagaatagtgcataaaaatgtagaaaaactccatatgtctcacaattatttgatgacactccatttttcttacaatatcttatatgcttgaaacaaacttagagaaacacttggaaaaggtacaaaagtgggccaggtatagtggctcatgcccatctctacaaaaagtagttaaccaggtatggtggtgtgctcctatagttccagctacttgagaaactgaagtgggagaaacgactgatcccaagaggtcgaggctgcagtgagccatgaatgtgccactgcactccaacttgaccaatagagtgagagcctgtctcaaaaaaaaaaaa

SEQ ID NO: 232424 - DNA, 146 bp, Homo sapiens
acaacaccatatttttactcctggacagttcggtgcggacatgacgatccggtctctggcccattagggttcccagaccttggcctggcagtttcggcctaaatctccttgccgacccagcctcgatcccctgcggcgtccaggtc

SEQ ID NO: 232425 - DNA, 329 bp, Homo sapiens
agaaagctgaataggagaggaaaggagattcaagatgtgttcatgggggttatgcatcagaacctctttacatcctttgaaagatgaaagtagaacatgcaactcctttcttaagactctgttgagtcttaaaacagttaacattctgatgaactttgctaaatttatgatgctgtgcagagaaggaaccataaagatgacagcttcaatagggttacacctggaggatttgtctaaaattgtggacggaaagcacagctttcagctgaaattttagaataaaaccattgctttgtcactggagtcaagagtacgttattaccagactt

SEQ ID NO: 232426 - DNA, 206 bp, Homo sapiens
aattaaacctggggggcggaggttgtaatgaaccaagattgcaccgctacatgctgcactccaacctgggcaacagagcaagactccgtctcgaaaaaaaaagagattgctgtgaggattagttgatttcctacatacaaagtacttggaacagtgactgacacatagaaagtcttcatataataaatagattattattagtggcc

SEQ ID NO: 232427 - DNA, 605 bp, Homo sapiens
tgagacagagtattgatctgtcactcaggctggtgtgcagtggtgcaatctcggctcactgcaacctccaccttctgggttcaagcgatcctcatgcctcagcctctcgagtagctgaagggggagaaagttgaggctgcagtgagctgtgaatgtgccactgaactccagcctgggagaaatagcaagaccctgtctcaaaaaaaaaaaaattcttagtttaaaactcatacttaagtaacataatagtttccttacagttgcttaaaactattggtaagtatctctggaactatgagcaatttatctagcaagttgtgtatctttcataaataattacatatctagatcacatcataccattttctttattaaaaagtttcacccaagactagtttactatgtggggatttcttgagagttggggtcatgtcatgctcatgtttaatttcctctaggctctgcctatacaaaacctacatattactgaattgagagatagtatatgtgacatataaacagaaagacccaaaagggaaagagaattgacatcccatacttaaaagagttccatttatatattaaagtttgccaaccccagcact

SEQ ID NO: 232428 - DNA, 501 bp, Homo sapiens
ccaacccagagagggaaggggactcacccacagtgactcagcaaggtcaccacagaggagggaacagaatctgggaatgtggagggatggaccaagctgtgagcctcagggccctcgtctgcaaaatgaggaaataaacactgcccaggcagttttgaaggaagatgtaaaagaacgacccacagcatctggccaagaacaggggctccacaaataacatcaacgggccaggcagtagccgtctgcaccctgctgttctccagaagaccaagccctactcaggctcagcagccacccttgcccctttctgtggcccactctgtgtcatcgtctgaggaatggggcccagatgtggtttttttccacctggcagacacctgctgacagcttctgtcgcttggcggctgtaattgcagtgctctctcccctttatgccctgctaggcacagactccatctgcctctgccagggagtttattaaatagtttattaaatctcact

SEQ ID NO: 232429 - DNA, 495 bp, Homo sapiens
ctgggggctttatttattcctaacttttatacttacaaccattgtccgtaattttatatattgcttcatatctcctgtattccacacgaatggaaggtactgcatcttatttatccttcacttccaagttcctaccaaagtgcctgacatatggtaggtacttagtgaaaattgaatgaaaccaaattactgattatatattctcccttggatatctcacgtgcatctaaaacttagtacgtggaaaactgaactcattatccttcttccatgctcaacattgtcttttccttcctatgtttcctattttgatgaatagcccgtattctcaaccagtcacctgggccaagagctttggagccaacctgactttctattttcccctcacaactaattgataaccaactcttgtctattctccccacccaaaaagagcagtttaatccatgaccacctccccactctcactgtactgccttggttacgacccccaaa

SEQ ID NO: 232430 - DNA, 191 bp, Homo sapiens
aactgaggcttacatttaaatgcctatcttatagaatcaatattagacataaaaaacctagttgagtaacgggcacataataagggctcaataaatcacagctactattattgtcattattagtataaataggctagaaaatgtcttgtgtagactctttttattgcaaaaactacacatatctctaatat

SEQ ID NO: 232431 - DNA, 380 bp, Homo sapiens
gctttgttgatctcttctattgcttttataatttctacttcatttatttctgctctgatttttaatatttcattcattcaactaactatgggcttagtgtgttatttttctagttccttgaagtgtaacactagattgagatttttcttcttttatgtgtaggcatctgttgctataaacttctctcttatgatttgctgcatcctatacaaattgatatgttgagtgtccactttcattagtgtcaaggtattgttttattgtcctttaaatttcttctttgacccactgattattgagaagcatgttgtttaatttccatatatttgcaattttttgaaattcttcctattaatgatttataatttcataccactgtg

SEQ ID NO: 232432 - DNA, 316 bp, Homo sapiens
atggcatgtaagtatcgttaaggtaaaatgaaatagcactaaaagcaaaaaccacaatgcaagttaagaatcataatggatgaaaaagaattacaaagagtaataacactttcaacttgggccatttctggttaattagtttagattacgcagtttgcttattattaagtagaatgatttcccaaacttcttcactgacctttacttgggggtatggtgtgatgtaaccttatcaattagtcatttaacttactagtataatattaaggttaaaaaccaaattccatagctcatatctgtaatcccagcactttgg

SEQ ID NO: 232433 - DNA, 355 bp, Homo sapiens
ttaacattgtaatggactttaatttcttatttatcttgcaacaatatctgtaaaccatttgccagattgagtggtccaaagtcttcggagaagttctcatattcgagttcattatctatgctgaaataatgtacatttgatgcactctttggtctgctgtagagaatggcaaaacgaaggcgatcggtgatgtccaggtacacgtcgtcctgggggtcccagcggcgcgggtcctgcagcgtggagctgcgcatcttcttcacaccctgcaaggtcaaagagcagcgctgccagcagaggggcgcggcggcccagctcgaccgccgcttgcttttccgcttcctggaggcggccg

SEQ ID NO: 232434 - DNA, 676 bp, Homo sapiens
aggaagggcttagagagaaaatgcaaagagaattctctttagattcaaattagattttgtggctttcttaacttatggtttcattcattgaacattaaagggtttcctacttagctccaaagatgccatctcaaagttccaaagtttttctgggttagtacagaagttcctgtccctggcaggctgacagagcagcaaggtgaaacatgggtaggtaggtagagaggtagctaattaggaggaaagaaagaagattatctacttagcttgaggcggtaaagtgtgatctctaagagccagaatgcctgggtttgaatcctcactccactacttatttgctggctgttggtcttggaccaattactttatttcttgttttctcatctataaaatggagatgaggctgagcgcgtggctcacggctgtaatcctaacactttgggaggccgaggcagatggatcacctgaggtcaggagttcgagaccagcctgaccaacgtagtgaaaccctgtttctactgaaaatacaaaaattagtcaggcatggtggcggacacctgtaatcccagctactcaggaggctgaggcaggagaatcacttgaacctgagaggtggaggtcgcagtgagctgagatcacagaattgcattccagcctgggcaacaagaataagact

SEQ ID NO: 232435 - DNA, 423 bp, Homo sapiens
  misc_feature (274)..(274): n is a, c, g, or t
  misc_feature (315)..(315): n is a, c, g, or t
  misc_feature (323)..(323): n is a, c, g, or t
  misc_feature (329)..(329): n is a, c, g, or t
  misc_feature (363)..(363): n is a, c, g, or t
  misc_feature (390)..(390): n is a, c, g, or t
  misc_feature (401)..(401): n is a, c, g, or t
  misc_feature (419)..(419): n is a, c, g, or t
caatgctgaactttcccccaccacacccggtttctcctctttccctccagactcactcttgccagctaaggtgggaggacttgccagcctctgccgttactgctctctgcccagtgcccctcagggaatagctgcttagcagcagggcctgggcctgggctggtctagggcttggccaaaaagaagccagacaagtgccctgccttgatgtcacagaaattcccaacaacaaatagacaacaactagaaaaacaagtcactctatttacagttnggaaggaatcattaaggaagaaaagcaccagtaggtatganggagatgnaatggnaagagggcagaataacaggctgccttaagaaggnttggccagggcaaggcctctcctggtnaagccgggttntttcagttaaaggaaagnaagc

SEQ ID NO: 232436 - DNA, 537 bp, Homo sapiens
tgtttttttcttaagagacagggtcttgggccgggcgcggcggctcatgtctgtatcccagcaatttgagaggctgaggcgggtggatcacttgaggtcaagagtttgagaccatcctggccaacacggtgaaaatgattggaaaatgatcagaagtaaaaagatttgcccaaagtagcacacaaattcaatttctatgggtcctatatggattcatttattcacctaacacgtttactgaatatctactatgtgccagcaattgttctaggagctggggatacaataccaaaccaaagttcctgtcctcatggagtttaatgaacagttaaccaaaactgtaaaaccatgttgttagaaatccttgacacactcctagaaaatgaattttattaaaattaaggcttccctggaagtgaattctgcctattttgatataaatttccaacagatttttttttttttttttagacactgtctcattctgttgcccaggctagagtgcagtggcatgaccacagctcactgcagccttga

SEQ ID NO: 232437 - DNA, 304 bp, Homo sapiens
tgaagacttttgatacatcacttgaaatgttcctcctgaagttgagggtcttttgtaatatcaccagggcagtgaatggcagagaccagatcatgaatcgcttcatttagagcctgcctccgggcttccctgcactctgtggctgctaataccacacccctgtgtcccttgtggtcttaagtcacaaaaccagctattattagatttgcctggagtgtctgaaaacaggcttagaatgaggaaaccttgtctcacttttatacaactggaaaacattacagaatttgactttttgaaaatttcc

SEQ ID NO: 232438 - DNA, 272 bp, Homo sapiens
ggagatgggaaataaggtcccagagttttgtggtgctttgactcagctttcggtctgctgagactcactcacaaatgtgtcattccgttctgccatccgctttgttttctttctcttttctcagttctcagaatcttttttcctaattattcaaccaacttgttgacatccttctcatgcctatgacaggaaggcagtcctcaccccagagtggccctaagctatgtctgtggctcaggagccctctccacggggcctctgcctgggatggt

SEQ ID NO: 232439 - DNA, 526 bp, Homo sapiens
ccacatttttaagccaaattgttgggtcttttaaaaactagcattttggctgtagtataacagtcttagtttaactgattcaaaactatggctggcttagtaaatttaacgctagtggccaataataacagaaaagagataaatattcttaagtatgtattttgagccagggattctgctaagtactttattcactctcattaaagccttgaaacaattgttgcatgtttaagttattaatgagccccattttacagaggaaaatgaggaaactgacctatgtaacttgctcatggtcacaagccattaaaggtggcagaattaggatatcaatccagtcggtgtgactccagaaccctcctatttactctatactactcataaaattatttggtcttggggctgggcgcagtggctcatacctgtaatcccagcactttagggtgttgaggtgggtggattgcttgagctcaggagttttagacctgcctgggcaacatggtaagacctcatctctacaaaaaaa

SEQ ID NO: 232440 - DNA, 396 bp, Homo sapiens
catcagcctcccaagtagctgggattatagacacgcaccaccatgtctggctaatttttgtatttttagtagagacagggtttcaccatgttacccaggctcaaactcctgggctcaagctgtctgcctgcctcggcctcccaaagtgttggaattacaggcatgagccactgtgcctggcccaggactctaacttttaagtatgaacttgtaagttaaaacgactctcagaccacctgtgtggagtctctgagaaaagagtaaactattttaatagtccagggagaagtgatcaagtccttatctaggacagtggcaatgggaaccaaacatgggaacagacagcttaaacctggtggaagtaggatccactgaatttgatgactaactggatgt

SEQ ID NO: 232441 - DNA, 344 bp, Homo sapiens
cagacagtctgttcctcgcatatgcagtgctgtgtggttttaggtaaggtgtttaacacttcagcctcagtttcctcactatagcattgactgcacaaagtggtggtgaggatcatgggaaagggcaacagagaaggtgcccaaggccagttcacacagtctgtgcttgacacaatagcagcaacggtggctttcaattttgaagttccaactgtaggcccaatgtggaccctcacacaaccagcctaacctcatggatgagaaaactgaggatgagaaacttgcccaaatggtatgtttgtgtgcaaaaattagcaaataaaaatgaacacaggcagggcacg

SEQ ID NO: 232442 - DNA, 601 bp, Homo sapiens
gggtccctgttttctggcaatatgctatgcatatttgcaaatatgtaaactgcatggataattttgctgtaacgaggaatgtcactttaccagactacaactttaatcagcattcctctgaacaaacttgctcatgatactaagcaacgcaaacatgcagccaaacaactggtgttttaatattctagcttctatttcttccacgtcataatttcctgtaataatctcactcatgcctgaactccacagacattcttatttatgtttttcaggtcagtatgccaatagcagtagtattgttcttgaaaggttgagtttttcaaatgagtcctgaaagaattctaccacactgcctatttcccaagcagggatcatgggagaaaggaaattttgaagaaaatggttctaatgccattttgttaaaagtactgagagatttacaatgatcaagtaatatgccagttctttcaaaggatgccaacatctgatgccaacataattacaagttggaaaaatgtgtaatgaatcaggcggctcataatttcccttagaatatgtatgcacaacttattaaatgacataaaaagcaaagagtcacggc

SEQ ID NO: 232443 - DNA, 143 bp, Homo sapiens
tatgtcgtctgtctcctgctagaatttaagcaagaaagagcaaggatcactgtttttgttcactggtgtctctgaagtgcctataacagtgcctggtacgtggtagacattcaggacacatttacttgatgagtgaatgaatg

SEQ ID NO: 232444 - DNA, 435 bp, Homo sapiens
cagctatttccaataatgggaaaaaactcacctggagagttttaggtagtgcagaatattcaaaagaagtaaaggcatgaagaaacattttaagacccagcaaaatgatagatccaaaagggacagtaaaagcattttatggttgcatgaaagtcctagatattttattttggggaaagtacatggtataatggaacagctggccattggacttggaatcagaatcaagattcctatctggacttcactctgttgagcctgtgactttgggcaaatcacttagccttatcaaatatcatttttctcattttacaaaaactgataaaaagaatggttatgagatttaaatggcaggatgcatgtgaaaacacactgtgaagtacctggcaaatattaggtacttaataaagatgagttgaattggaatctaataaa

SEQ ID NO: 232445 - DNA, 460 bp, Homo sapiens
tgagagagttttaaaagcactggtatttgtcccacacaaggtcgcccgctccaagtcactgttccccgctccccgggtaggcttatagccaaagaggcttctaggcttcgagatcagcccaccgcgccccctcagcccttctccgcgggccgcagccccatcccggcctctgggtcccggccggggatcggaacccagccggcttctccgacagcgtttccgacgcccggcacctctcgcagccccgtcccccaggctcccccgtctccacccgccaccccccggcgctcccgtcaacgtccccttcctccctcaggacgccccttggggcgcctctcgcgccgggtcccgccgggtgctcggcacgctgttcctttcctctcccctcccgcggcccttcttctgtggggcccacctggcgcggcccccgcccccggccagtctcctcagtgagcggccg

SEQ ID NO: 232446 - DNA, 471 bp, Homo sapiens
tggagacaatgatgctgtcctcagagattgtcgtcaggggttaaatgaggtaatatacacaaagcacttcacccagtacctggtaattgcaagaattttccagaaggaaaactgagctctccttctgccacctgggagtagggcagttggtgcattccaacagcatattttatagtcaaagcttcatccgcagtagagtgaagaaacgacatggaaggcagaagctgggggcagaaaacatgttccctggctgggcatttccttcctgtcctcatggtgagacatcattgatcactgtggtcactgtgcctctcagatgaccccctggtgggagttgctgccaacctctgagggtccttctcagacagtgagttgggtgctgtacagaaacaaacttgggtggcgcctactccatttccaaatatctctgggctctgggagtttggcccagctcttcactatgcttatttc

SEQ ID NO: 232447 - DNA, 352 bp, Homo sapiens
gagattaaaacaacaaaaaaggaaagcctacttgaagtcatgcttgagggaaaaggatgacattatttattcatgactcaggaggaaagcccacgctttataaaaacagaaatgtcaatcatctttctcatgtaatctaatcttagcaaataacgagcattatattttgggttgacttagttttcagtgtctttaagcaaagcttataatgggctactattaaaagttccatttagtactggtttgcatcacagcttaattgtagtcgttataaacttgggcacttattttcatttcagcaaaatcacaaacatgaccttaaattggttaggggagtcattcattctgctgt

SEQ ID NO: 232448 - DNA, 388 bp, Homo sapiens
agttcactggagtctacctgggatccccctctgatatagtttggatgtctgtcccttccaaatctcatgttgaactgtaatccccaatgttggaggtggggcctagtgggaggtgtttggaccatgagggcagattcctcatgaatgtcttggtgtcatcctcacagtaatgagttatctgagttcacacaagatctgattgtttaagagtctggaacttcctccttgctctctcactctctcctgacatgtgacacgctggctccccttcaccttctgtcatgattggaagcttcttgaggcccttaccagaagcagagggcagcactatgcttcgtgtacagcctgcagaaccatgagtcaaataaacttcttttcttcataaatt

SEQ ID NO: 232449 - DNA, 320 bp, Homo sapiens
agagagtaatataattttaatatattactaatatattactcttaataatataataaatggttagagagtaatataatttggatatttgtcccctataaatctcatgttgaaatttgatgttcaatgttgagggcaggtctgggacctccctccctgcttttgctccccctctcgccatatggcacaaatgctcccttcaccttctgctatgaatggaagcttcctgaggccttcaccaaaagcggaggctggtaccatgcttcacgcacagcctgcagaatcatgagccaaataaactacttttctttataaatcatcca

SEQ ID NO: 232450 - DNA, 554 bp, Homo sapiens
ttgttaacattattattgagggcctgctgtaataaatatctaggaactatttaggtagtagaaaaagagtatatgtcctttctgtctgccttcttttggttttttgcttctcttctgccttaattaaacatgatttggaatagttatttttaccttattactcaagttaatactttttttaataagcagtatgtcacatcacctaaagatgactgctttttaaccagctcctatttttaatgtcagtatatttatatttaaggcatcattaaacagctttttgcaatgtacttttcagttacttgtgaagttggaatgctttgtgttcttgtatttttgttactaggttgcaagtacaggaattgaataacttcagtttaagaggaaaaaaagtcatgttgctttttacatgtcagagttcttaacagaaagcaaaggtttccaacagcacttgcatttttagtctaaaagcattctgggcattattcatacagatcgttttcaaactttttatcaagtgcattcttctaataaaattaagtgaaatactgcgt

SEQ ID NO: 232451 - DNA, 463 bp, Homo sapiens
agtcatggaagaagcctttctgatgagagaagctagagtcctggaaagctacaggcagatgagttaaggttaagacaaaaggggactgggagggtcttactgaccgtgtagttgttttaaggcagtttctagactttgtaatatgttataaagttaatttctgttaaaaaatttgaattctagacccaggcacggtggttcatgcctgtaatccctgcactttgggaggccaaggtgggcggatcacctgaggtcaggagtttgagaccagcctgaccaatatagtgaaaccccatctctactaaaaatacaaaaattaactgggcgtggtgatgggtgcctataatccagctattctggaggctgagacaggagaaatggttgaacccaggagtcggaggttgcagtgagccgataacggtcccactgcactccagactgggtgacagtgagactccattta

SEQ ID NO: 232452 - DNA, 534 bp, Homo sapiens
ctgggctggaaattgttttactgactttcttcattataaaatgaagtattttacattcagcctcataatgatgaatgttcacatcttgtatacgtggtcttcagcaagatattccaataggtcagcctcaggaacaccagattaagtgtctgtgaggagaaatggcatagggacctcatttaataattaggaatgctgctgcttttagtaggaaattcattttcatacttaagttcattcagacttcagggacacattgtggggctattgaaaatataaatgccatccacgacaatcatagacacttagtagacattaagtaatttctgtggtaaaaaaaaaaaaaaatgagctgatggcaacaagttcaattctaagtctacaaatgtgcaggttctctaagcaaacaggatgtttttttccaacattcccttggagcctgggttccaaaagaaatcctttgcactctgaccaatgggtccttttccctgcacatcttccttgggaattatggccttaaatactacagaaacc

SEQ ID NO: 232453 - DNA, 211 bp, Homo sapiens
ctgggctggaaattgttttactgactttcttcattataaaatgaagtattttacattcagcctcataatgatgaatgttcacatcttgtatacgtggtcttcagcaagatattccaataggtcagcctcaaaagaacactctgcagtttactgttaacgtgtctgagtttcttgtagttagacgctggcactggcgatttacgatatgaat

SEQ ID NO: 232454 - DNA, 447 bp, Homo sapiens
gttatggtagggaaaaatgctagcctgggagctgggtggtctgcctcagtttcctcatctgtacaaaaagaggaagcatggcaagagggtatctccaaagactttactgctacaatagagcatgactccacaggctcaggagagggccaattcagccaggccccaggctccgttcctcctctgctgtcttcaggccacccagaagggccactgcccacttgcaaagcctgggcaacaaagtgagactccatctcaacaacaacaacaacaaaaaaaaggcttaatgctaatggccacaaactcataatggcagtaaaggagcaaacggcattgccaggtggtgtggggcccagaccatgcccccacatggcctgaggcttgggtcctggctctgtcacctacaggttgtgtgatgctgggcaaactaataaacttctttgtacctta

SEQ ID NO: 232455 - DNA, 492 bp, Homo sapiens
ttaatcaaacctcccgattcagcatgacaaagtggccatggcatacagcataaatggagaggaagatacaggatagaaaaccaccagcaaacaggtaaagagggttcctatgttgattacaggaaggatactgtcaccaggagaatcacaaaactagcacttccagataacactgtgtttgcatttgctttctaccacattcatgtggtttcctgcacttcataatttaatatttgtaagagaaaaaaaaatgctgttatgaaaccccaataatgcatcacttgaaggcagaaagccagctgctaacaagagtgacatctgagcatcatttctgaagctctgcttcagaaaggggatgtttagtaagaaagaacaataataaatgctattcaacgtaaaacaaagtgtggggatccacagggttaacaggctggccggtaaccagtaacacaatgacggcaagcacagagaaggaaaaagtcagatccccta

SEQ ID NO: 232456 - DNA, 787 bp, Homo sapiens
tgcacttgtacccctcaaatttatgcaaaaaggatggaaatatatccatgcatatatacatacaaaatgaatcagaaatatatcataaaagtgataaatattgaggtataaactataacaaaaagatagaaaatggagagtgccaaattggctgcatgtttcagagaaggcattatggtagaaatgggattaaaattgggctttgaagagtgacgaggtagataggggagaggagaccatttcaagaagaagcaagacctgtaatctcagcactttgggaggccgaggcgggcggatcacaaggtcaggagtttgagaccaacctgaccaacatggtgaaaccctgtctctactaaaaatacaaaaattagctgggtgtggtggtgcatgcctgtaatctcagctactcaggtggctgaggcagaagaatcgcttgaacccaggaggcggagtttgcagtgagccgagatttccccactgcactccagcctgggtgacagagtgagactccctctccaaaaaaaaaaaaaagcaaagaagaagcaagaacctaaggttatatggctacaggggaatcagatttgagaaatttatgctatttgagacctgccatatattctattagattttggaagtcagaaagcttaatgtttaagcactttatctcatgttacattcttaaaagcatcccaacatgtgctgtgtattttaatgatattgtcgaatactagaatgcctgcttggttggtaagactcttgtatacgttaccttggaatcttgataaga

SEQ ID NO: 232457 - DNA, 508 bp, Homo sapiens
agcaagcactgcgggagtattttctgttgatccgttggttcaaaaagatgctctcacaggagaaggctcatacaggctggatgatgagctcattattaagacatgtgatggtcactggatcccacaatatttctgacatgtttattcctcttgctgattttctgactttttattgttgttttgtttatactgagagctgctgacatgtgaatatcccaatagctatcatccctgaaagatgtgctttttaagaatgaagactgcagtttttctggagtcagcctcttgtctctttctcctggctcacacttcacaaaatgagaattttttcttaagacaaacaaacaacaacaacaaaaaaaacgaagcagaactggatatagtggctcatgcctataatcctagcactttgagaggccaaggagggaggtttgcttgaggtcaggagttcaagacaagcatggacaagaaagtgagaccctgtctattacaaaaaaaaaaaatacaa

SEQ ID NO: 232458 - DNA, 525 bp, Homo sapiens
agatttctctggctccaggggcaggtctccaatgcaaacaaagtctctctcttcctcccactattttctcttcgcaggacatgagacttaacaacctgctaaaaatgagcttttgggacctacccatcaaggaataaactgtcctcgccatgagagatcaaatgaaacctgagaccagagactcattttcttgtaaaatgctttctccaacagatttttaaaaagaaaaggggggaaatgtgaaaggaaaatatctgtggtccccaaaatcacgaaggaaaactcaagccgggaactgcttagggcaaacctgcctcccattctattcaaagtcactcctttgcccaatcagatagatgcttatctgatttgcctcctttggaaaggctgatcagaaactcaaaagaatggaaccatttgtgtaacagccatctgtgacctggaagcttccttcccacttcagtcttcctgcctttgcttcaagttgtcctgtctttccagatgaagcaatgtacttcttaacat

SEQ ID NO: 232459 - DNA, 267 bp, Homo sapiens
taatcccagcattttgggaggccaaggcaggatgattgtttgaacccaggagttcaagaccagcctaggcaacacagtgagacttcatcactacagaaaattaaaaatttagctggacatggtggggcatgactgtagtcctatcaacctgtgagcctgaggtgggagatcgcctgatcccaggagtttgaagttgcagtgagctatgattgcatcactgcactccagccagttcagcctgggcaacaggatgagatctcattgcta

SEQ ID NO: 232460 - DNA, 482 bp, Homo sapiens
tcttcccccagatcatttatcactatggtaattaagacttagatgttcagactgtggaatgaaaatagaacagattctagcgcagatttttaaaaatatttttcttcctgcctccaaaaaagtacatgttcatttaagacaattttgaaaatacaaacaaatgcaaagaaaattaaaataattcttaatcctattacccagagacaacttcttctaatattttggtttatattcacccagtcttattcaaggaacacaacaaacacacactctttccctttatctttgaaaaatatgatatttgatacatacaaagaatatatgtaacattacaccccctgccccaaaaatcaaaacattataaatcatggcaataattgtcatttacctatgtgcaccccttggtcttgcacttcctctcatggagtgggagtatcatcctcttgccttattaaagtaattttaaaaattgtttgtgttta

SEQ ID NO: 232461 - DNA, 456 bp, Homo sapiens
tcagcattgcatgactcagaccctgtgagcacagcccatgttcagaatgtggaaatccatcccagacagtaggtagcagatttccagccaaagggctgcctttccaggagagcctgtgcagccgggttctgccctcgttcggggaactctgccaggtttcaggagccagctcaggcacttcgccccctcctcagaggctgcctcttgagccttcagtgcttcctgagtgcctcctgaaaccaggccgggtgctccccagacagtgactgtttaatgaccgccacactccagtcgtggctgagaatgaaggaactcttcccttaaaactgaggtgtctgggccaggtgcagtggctcacacctgtaatcccagcactttgggaggccaaggcaggcggatcatgaggtcaagagatcaagaccatcctggccaacatggtgaaaccccctctctatt

SEQ ID NO: 232462 - DNA, 617 bp, Homo sapiens
ggagaatcgcttgaacccaggaggcagaggttgtggtgagccaagatagcaccattgcactccagcgtgggcagcaagagcaaaactctgtctcagaaaaacaaaaacaaaaaacgaggtttccttagtatgttaatacctctcttaaatgctgttcccttttccccccgatatctaaccagtgacccaaagttgacatgcatccttcctatatccacgtgttgatacttaactacatacctttatcctatgaacattatatatatatagttttattttgattgtcttaagactatttaaatacagatatctttatttagcttgctttcttcacacaacttggccaagatttatctatgtttatttaggtagctctagtttatttacttttactgttaggtggtatgtgctctgttatataactatgtcaggtttctgttgatggtcatttttgttgtttccatttgtttgctattaaacagtactataaggaatattcctgtatatgttaggtatctgttgtgtaagacttctagagcagtggttcttgaccctacctacatcccatgttcatagaaaatattttacagtactttaaagaaagcattggccttaat

SEQ ID NO: 232463 - DNA, 353 bp, Homo sapiens
taatggcaaaagataatactttcccataagattgtgagcaaggacagatgtccactctcaccactcttatctaacatactgctgaaagttctacccagtgcagtgaagcaagaaaaggaaacagacataaagattgtaaaagaaaaaacaaaactgttcctgtttgcatgtaatataattatgaacatgcaaaatcgaaagaatctacaaataaactcctagaattaattaagttcagcagtgtccagtatacacaataagtatatttaaaaaatcaattgtatttctatataccatcaatgaacacatgtatactgaaagtaaaaatacaatatcatttacaattactcaaa

SEQ ID NO: 232464 - DNA, 410 bp, Homo sapiens
tgagaaatgaggctctgtcaccagggtcctgcctctgtcacagtcgtacgtcaaggtgagccgcataaagtcacaatccataagaagccaagactctggagggagctgaggttatgatgggggctttctccgaaaataagaggcaaagcaacacaactacctcttctaagatgagagctaaggtgggaaccagtgtgaattaatcaataataagttaattgtacatttaaagataactaagagtataattggattgtttgtaacacaaaagataaatgcttgaggggatggatatcccattctccacgatgtgattattaagcatcacatacctatattaaaacatcacataccccataaatatatacatctactatgtatccacaaaagttaaaaatattttttaaaaa

SEQ ID NO: 232465 - DNA, 506 bp, Homo sapiens
tgttagaatcaattaaaatgaagaccaggtctgaagaatccttgagcagacaaagccagttaggcctatatgcgaccttcaccttgtttgatttgcaaacataagtgaaacttaacttgagctatttcttataaatgtctatgttaaagagaaacagaacttaagctcaactagtcagaatcagccaaaaaacttctcattatataactaaggactttccagtgggatagaccaaataaggcaacttataattataaccaattaaatattttctcagcatctcttccacatttaccctaaaacatctgtgcctctgcgtcctcagtgcaaccctccaaccacctctggtttggagctgcctgattcgtgaatcactctttgctcaaataaactctttaacattttattgtcttggtttacttttttaacagattaaataaccgagtactattgtctagccaagttgacacctaaagctgaccatcgtggccaggtgccgtggctca

SEQ ID NO: 232466 - DNA, 461 bp, Homo sapiens
gatactgaatttgttttcaaactctaccagctactggcactgcaagcttaagcaagttactcaagcccttgaagcttggcctcttcgtctgcaaaatggggctgataaggcttctaaaagagagttgtgaaaattaaatatgatatagtatgtaaatatcgttacataaaatgtacacatttactaaattatagttgttattatggaacccaacactaaagaagcgggcagagaatatcacttgtttctgtagttaggaatagtagcagtaaatttgacatgtgccactatagtgaaattgctggcacttaagttatttgtcatatactataataatatgatttatgaatgttaattctcaaatcagttggaagccaactgtgtgttcttgttcagaattgaccaacctagaggttctgaattgagtgaaacctatatcattaaaagaatgtgacttggta

SEQ ID NO: 232467 - DNA, 376 bp, Homo sapiens
agagaatctgtgaacagaccatgcaaatatgcctgcctggtttttcacaacagtgcaaaagcaactcagccaacaaaagacagcttttggccaggcgcagtggctcactcctgtaatcccagcactttgggaggccgaggcgggtggatcacgaggtcaggagatcaagaccatcctggctaatatgataaaaccccgtctctactaaaaaaacacacacacaaaattgccaggtgtggtggcaggtgcctgtagtcccagctacttgggaggctgaggcaggagaatggcatgaacccgggaggcagagcttgccgtgagccgagattgtgccactgcactccagctcgggtgacagagcgagactgtctcaaaa

SEQ ID NO: 232468 - DNA, 392 bp, Homo sapiens
tagcttgagattggatgcacttaatttattcttaaattcatgtctcagtggtttccttaaaaaaaaaaggctaaaacattgaatggagttgtactttaaagtaaggggtacagctgggcacagtggctcacacctgtaacccagcacattgggaggctgaggcaggaggatcacttgcccaggaattcgaaaccagcctgggcaacatggtgaaaccctatctctacaaaatatacaaaaaatgagatcggtgaggtggtgcgtgcctctagtcccagctacacagagcgctgaggtggaagaatcacccgaacttgggaggtgaaggctgcagtgagctgtgatcacacactgcagtccagcctgggcatcagagtaagaccctgtctcca

SEQ ID NO: 232469 - DNA, 485 bp, Homo sapiens
ggctggattggtgataaatgagcagtgaccagggaaaaagacgaacctcaaataccctaatttgccattcttggtaatatatttaacttgagcagacaaataaggttaatcttttttttttttttttttttaaccaggctaatgagtatatagaatccctctccagctgatcttaaaatttgccacttgggattattgagtttcactttttccacagtgtctttggcttttgcttacacattcttcttctttgacccagtctcattacatcattaataacatttaattaagccctgcagcaaagtgagaccctcttctctaccagaagctacaccggcttataaactgactatactcaatgtaaccttgacttcccaaacagaaacagctctgtcttagaccttggatcaaagcagtctttccaataagtaactgttaaaacacatcacctagggtggttaatacactattccatttaaacaagt

SEQ ID NO: 232470 - DNA, 866 bp, Homo sapiens
agaaggggtgggtctcccacctgttcctggctcccactaactttgaggagttcacagccccagccactcctccccactgcagccagtgtctccgtagcaactgctccacatgggccactgctgccatcatagagcggtccttgcaggtgcctttcttgtacctcagcactcctgggggtcattagaagccctagcaacactgctcaccacactatagctccggaggccctagcagtcctgctcccacagatcccacttctgacaccatctattaaaagaaaatcttcagctgaattaaatttaaaggaacttaattgagcaatgaatgattcacgaatcaggcagcccccagaatcacagcagattcggtgagactccagcacagctacatggtggaagatttatagacaataaagggaacgtgatgtacagaaatctgaagtgaggagtgaggtccagaagcaactgggtccgttacagttctcagcagtgaggtccagaaacaactggactggttacagtgctcagcatttgccttatttgaacacagctgaacactcagcagtgtgtgagtggcagaagtttggctgttgggattggccaggactcagctatagttacaggtgcatactccaaagttaggttatcagtctttctacctattaagttaggttgcagtttgtccacagggactcaaatctagaagtacagagtccttcccaggccatatttagttcactgtaacagttcctattatgacctcactgacagttctttttctctgaattttcctttcttctcaacagcttgtccaaatgttccattggtccctgttcatcccgccctgcagctctccttgactgatt

SEQ ID NO: 232471 - DNA, 429 bp, Homo sapiens
caggcagctgagaggtctagttggtaggaactaaggtctcttgccaatggcaagggactgaggcctcctgaaaacagacatgtgaatgagaaaaccttagaagtgagtcttccagccccaatcaggccttcagatgactgcaacttcaggagagaaccaccagactaagccattcctgaattcccagccctcagaaactgtgtaagatcatgtttgttgtttcgagctgctaaaattttaggataatttgttgtaacagattgtgaatataattgctttaacatttattatccatcttcatcttctaccacattattttattggtcctttgtaaaactcctggggccattctttttctttctttttttttttaaagatggattctcgctccagcctgggtaagggagagagaaaaaccttatctcctta

SEQ ID NO: 232472 - DNA, 490 bp, Homo sapiens
cacattgctaaatgtgactgtgcttcatagaaatggtctgggctgccttccagaggagctccatgtcttcctcacaatgcggtggttggctgtcaccctgtagccttgtgttgcctcagtttactgtggtgggaagccagataactaggctgcacccgcccagagtccgggctagaggtggactcctgtgaaggaggggtctcctgtgtacatggtctccatggttttagccacatgctaggaccacagggagttgatcccttccttcctaccctgagtctgtggtctgtgatttgagatcactggctcagtgaagtgtagctccccacttacgaagtaagttataaaattggtggcagtgatttccatccaaagattttgttaatccacttaccaacaggtaactacttaaatgtactgaccgtgtgctcataaaagtaaaatactgtaattatagaaataaattcaacatgttgaagactttctcgta

SEQ ID NO: 232473 - DNA, 800 bp, Homo sapiens
ttaaaccagactgtagttgaactaaaataaataaggtctctttttgtcttttttgtgattccatgggtcgggtcaaattgacggcacggaacattgcttactcttgaaattccaaactcttgaaatttcaatttaaaatattgggttttccctgcccttcttaggatagccagtagaaaaatggggtttccctggatttccttggtctggtaggtgcagcaatatgacatgagtacctcataggagggactacagagaagcaaggattccagatggagggagagtttggaatgtgaaagaagggtgttattagctgatgctgactcattggggtttgaagtatgaacacgtgtttagtgagcaatattggagttttcatagtaagagcttgcagaggtggctgggagtgaggcatgagatctctcggtagaggcaaaatagagtgatgagagccagaagcactggatcaggtgctcccaaggggaagttgtaatgaagagtgaggcaggattgcgtaagtagaaaaagagaaaaagagagcaatgctcttgtgaaaagggagttgaagtgcaatacagactgcagctccatccgtcagagggttgaaatttcacacacgaaggctcattttgatatgttcacatttatgtggcaagcgctccaaaagggaggccctaaatacatcttgtcagaataactccagcaaagactgacatttacacatttctctggttaggaaatgtaatagaggcaggggcatatacaggttttatggggcctaaaccttatgtaatttgagg

SEQ ID NO: 232474 - DNA, 314 bp, Homo sapiens
tgcgcctggcccttaaaccactgttttatacagacaacagcaaccctgctttgtgagctagcttacggttttaccaagtaccgtttttttgtttgtttgtttgtttgtttgttttttgcgggggtggagggctaccagctttatcaatataattcagataccataacactcatttaaagtgtacacttctggctgggcacggtggctcacgcctgtactcccagcactttgggaggccaaggtgggaagattgcttgagccctggaggttgagacaagcctgggcaacatagcaataccccatttgtttctttt

SEQ ID NO: 232475 - DNA, 430 bp, Homo sapiens
gtgctgagattacaggcgtgagccactgcacctggcctgaaactgatattttagtgcaaattttgtatttgttttcttgagaggcaatggcgtactggagccatacggaccatgaataagctacctaacttccttacatctatttccccctccatctattgaatgggtataatagcacatattcgtacaggctggtggctctcaaaacttaatctgaggctgacctgagatgctagtcccagatcctacctcccagagatttcagttcagtagttctggggtgggaaacactgtcagaggactgtttgaattaaatgagacatgtacaaaatgtttaacacatgtctggacaaggtcagcaattataacccataaataatatttccatttactggacctaacatgaggagtaacttcttttgggaaagtt

SEQ ID NO: 232476 - DNA, 552 bp, Homo sapiens
aatgtctgggatttgtaataatgtgaaatgcataatgagaagatcatgtaagtcccttgtgcttgtgtcacaggtgcaggacatttagtatccatggcctttgcccatcctcaatcgtgtgaccatcaagaaatatctcctgggtgaaaaccattcctcttgagaaccactgagttagagaggatttagaggagctaaaattgaaggtttccacatgataagttatttaaaggatttagtgaaacttctctccccctgctatcacaatgaaaagatagtttcgtgacagaacataaattgtaacatactattgctttagtagtttattatctgaaatctctagttactgttgaaatctaatcccggttttcttcctctggatttagagtaagttaaaatgtttaccacaacttttaagagttgttattctgaaatagataatgataaacacaaaatgcatactttaataccacagtgaccagacttaacatccaagataaataaaatgggtaatattggacactttaaatgtattacaggttctagtactta

SEQ ID NO: 232477 - DNA, 516 bp, Homo sapiens
caaggaggcagttgccagatcacatagggcatttcgggaaaaaatcctttgaaagtcattttataaaatctttgttagtctatggttcattatagacattttcccttaattggtgggcaaggacttgaaaaggtgaggcttgttggtggctgaccaacctgcctgatttgaggacgcactgatgagtcttcaggtttctgcatctttagcacagtcatttatagctcatatacatatatatgtatatatgtgtacatatacatatatgtacatacatatgtatgtatatatatacacacacatatatattttatatttgaattcggtttcaaatagttttgtattttacattaggtatgtttggagaattatgctgcaacaaatatacataaattatttggaaacagaaatatctttaaattgggttttcttaatgaaggctccttaaaaagaataaaattattttctttatgtttccccattctatataataaacctttacctgtttcaatggta

SEQ ID NO: 232478 - DNA, 710 bp, Homo sapiens
cacttgtaccaatgtccacctgtacagatgtccacatgcaaatgcccatctgcactgatatccacctgcacagatgcctacctgcatgaatacccacttgcctgaaagcccacctgcacccatgtccactggcacaaatgcccacctgcacccgtgtccactggcacaaatgcccacctgcacagaagcccacccacacaaatgcccacctgcaaaaatgtccgcctgcacagatgtccacctgcatgaatgcccacctgtgtccacatgcacgaatacccacctgcacagatgcccacctgcacggatgcccacctgtacaaaggcctacctgcgtgaatgtccacctgcatggatgcccacccgcacggatgcccacctgcacagttatccatctgaacagccctctggtgcctccttttgcttgcacatgttcaaatcctcccagtcctacagtcgattgttcctagttggggtcattctgggcatgttattctaaaacttgttttttcccgtctccacatcaaaggagaaaggtctagcttgcttctttgctatagagcagggcctgagtgaggtcaggaccacagagcagaccctatgagtgttggtcaggacacagagcaggaccccttcagggtctggaagagggttccccaagctcctgttcaacctgagtgagaggctcaggctgcccccaacacactgca

SEQ ID NO: 232479 - DNA, 523 bp, Homo sapiens
gtagagattgggtctccctgtgttgcccaagctggtcttgaattcctgggctcaagcaatcctcctgcctcagccttcccaagtgctgggattatgggcacaaggcactacatctggccacctgcttgtgttttcacaagccctgcaggtgatggtgaagcactcctgagtttgagaaccactgctttagtggaatgctggctaaagtcacacaggtttatttcctgtataatttagtcccacctcacatgctaatgcttactgtgactcttcaggaaggaaatacaatatactagcattttctcccaaaagtgttgggcggtggaagcctattttcaggtagcattgctaggacatgcttctctggaccacacgggggaagtcagacagcatttctccagacagccgggggctagagagggctcagtcccagctcccagatattcataaggagtactcgacaggccctggagattaattttgagctcagactttttgacctgccaaggaacaccaagattta

SEQ ID NO: 232480 - DNA, 408 bp, Homo sapiens
ctccatggagtttaagctttatttgattgtcctaaaacaccaaagaaagataaaataagattactatggtgtcctggaaggagcaagcactggagtagagtcagaagtcttgagtccttgggctttgatatttattggcaatgtgattttggataagtcacttaatctaaagtggggatgaaagtgtctgctttgttaacctcacagggttttcattaagatcaaatgatatgatgtgtgaaagcactgacaactatatatgctaaacctgggcaaggtattatcaagctcttctccagcagactgcaagcttcataaggacaaaactatttaatttactataaattcatcactcactttagtgtcttgcacagagaaagcacacaataaaattatttgtggaataaa

SEQ ID NO: 232481 - DNA, 442 bp, Homo sapiens
cgttccccatgccccggtgtgggtgaactcgattgaggagggaggaggatgacacccgccgggggtgttaattagtaagcacagtggcctcaaagagctcaaatgaaaggaagaattgcatgtctctcacttgaagtccagagctagcaatgattaagcttagtgaagatgtaaaattttcatcgctagagagacgtccacacttggcttcaaaacttcaaaggatgggctgactgtctttgaggaccactgcagttggtgactttaagttacagctagtgctcattgaccactctgaaaatctcagggcctttagtaattatgcaaaatctattctttctgtgctctagaaatggaacatcacagtctgagtgacaacacatctgttaacagcatggtttactgaatactttaatcccactattgagacctactgctcaga

SEQ ID NO: 232482 - DNA, 276 bp, Homo sapiens
acacacaaagaaacaggttttcactgatgttgcacctctccctatagttgtaacccttcccctttcagctaaaatttctgggtattaaaaggctggtaccctttgccacctttattttttattgtttagcttcttggggagctaggcattaaagacaaaaatacttaaaaaaaaaagaaacaattgcatatatgaagaaattagaaagtgtatggacatgcccagggaaaggctcaaaaaaaaattacaaaagcaataacaataagaaaaacagaa

SEQ ID NO: 232483 - DNA, 421 bp, Homo sapiens
gattactattgggtgagtttcataagagaattaaaagaaaatcttagagctaaagtagctggaaggatgaatgggtagaaatactaattactgctagaaatactcgtgactgaataaaaatatatgctgccaggcacggtggcttatgcctgtaatcccagcactttgggaaggcgagacaggcagatcacgaggtcaggagatcgagaccatcctggctaacatagtgaaaccccgtctctactaaaaatacaaaaaaaaaataaatagccgggcgtggtggcaggcacctgtagtcctagctacttgggaggctgaggcaggagaatggcgtgaacccaagaggtggagcttgtagtgagccgagatcgcaccactgcactccagcttgggcaacagagcaagactccatctcaaaaaa

SEQ ID NO: 232484 - DNA, 246 bp, Homo sapiens
tgttgttaacaatatttagccacatcctaacctctctggctgctttttaggtaagaggaggcagactgatcatcggttaataatcagttttgaaaattaataaatgcaggaggagagaagttctgggtagggaaggaataccacttaacaaacttgtttggctacttgagagtagccatgactaaaggaattcatggattcgttagaggttttgaacattataagacagaacagtacatgacacca

SEQ ID NO: 232485 - DNA, 409 bp, Homo sapiens
agggcctagctagtgctgtaggacaagggaaagaagtgttaaaaataatagaataaaacaaatatttatttgttttgatatgattatagattactttttattgtctgtgtagtcaagcaactaatagaattatttaaaagaatttgacaaaggaaactagatacagcattttaaaaaggcgtttttaatgcaacagccaatgagcagacataagaaaagtggtctatgggatgcacaaaggcctatagaaataagggagggaagccgggcgtggtggcacatgcctgtagtcccagctactcgggaggtcgaagcaggagaattgcttgaacccgagaggcagaggttgtggtgagcggagatcacgccactgcacttcaccctgggcaacagagcgagattccgtctc

SEQ ID NO: 232486 - DNA, 842 bp, Homo sapiens
acttaaaaccaaactcaaatgtcactaaatgagggaatggacggaggttaagtattttgaggagaggtgttaggaaatgcaaaggaatgtttcctaaatgtttttacttgtttccatttccaatatggctaagtaagttctactggatccgaaattctcacagatatcaactataaagtaccaaaagaccaaaaacaaaaaaaaaaaaaagaaaagaaaaaagaaattacctggaagcattagagaataaaattaagcagacagattctggaggggagctgaaattcaaaacttggaagcacaggtcggtccagagtgagtttcccattttacaacttttagagtgagaacaggctaaaattaatgtcacttcgggtggccatcctccaatagaaaactcacagtgtttttggtttgaagacccaaagaacagggttcagggcaatcatagccacaggaaaatgaattcagaatcttggaaagaagagaggcagagaggggaagctcccaaatctgtatataaacactacccaaatttctggttgacccttgaatttattaatatgagacaaactaaactttcagacaaaaagagttaccagagatgaaggagaacatttcatgatagtaaatcattatattaagaagaagtaagaattgtagatgaatatgcacttgataaaattccaagtgagatcacgtcatgtaattctgaggtatatgtcatgtgtatattcttgatggagcagacacaaattatcacaaagataaaagaactgaactgagattcgagctgctacccaggggatagttttaaatttgagtataactaattgcctgct

SEQ ID NO: 232487 - DNA, 374 bp, Homo sapiens
gatgaggcaaacagtatgagagacaagatgtaccagagagtggtcctcaacaaaccagggtttcaaagactccagcctgagcaacatagaaacacagagaccccctaactctacaaaatataaaaatgattagccaagcgtagtggcatgcgcctgtggtcccggctactcggcaggctggaggatggcataagcccgggaggtcgaggctgtagtaaaccgtgatggcaccactgcactctagcctgggcaacggagtgagaccctgtcttaataaaaaacccaaaacaccaaacaactaaaacaaagactttacctctacttctgtcccccacagcccactcagcttatctttgaagaaaacaagaagtcag

SEQ ID NO: 232488 - DNA, 452 bp, Homo sapiens
ccaaatataagattatatcatcttcaaacaagggtaattttactttttcctttccaaatagatcccctttgtttctttctcttgtctcaatgctctagctaggacttcttgtttttttcatcatgtttaatttaatagtgtaaatcatagaacccaaagaaagtaccactagtgatgcataaagtgcttccaagaagcagagaaataacataacaatataagaaaaagctgatttgcttgatatgtaccacggtttgaggtctgtagctttgtctgcatttttagaaagatgattcatctcagaaacacatgaagtaaacttatggtattgataaattcagtacagtactgtaaatatactttatcttccttataattttcttaacatttccttttctctagcttacttttgtacaaatatggtatataatacataaaacatacaaaatatg

SEQ ID NO: 232489 - DNA, 1417 bp, Homo sapiens
tcaataatggccaacttgctatttaactgtgataaagggaaatgtttctgaagacattttaaagttttttatacatacgtaagatttttatatacatacgtaaggattagatactatgattactttttttgtattttgaaattgaaggcacttaagctcttgtgatattttgaattgactgatccatttaaaaaattgtttagctataggtgtttgtaacaatttcttataaaatgattttttttcttgattcatgatattaaactccagattgaaatgaggggctatgagctttgaccctgaggaaagaaggccaaaacatagatctgaggaaagatttgaacatggcaagacaatctcagggttaagatgttgctaagttgattctgagaatcaaaatcaggctttttttcctgtgatgggatcataaaaataatctttttatcaggacaaaggttatgggcgaaggatagacagaattttggcactgctgctttcctgagccaaattaagtagtttttctaaatcatgaaaaaagagcatgactatccatctggaacttcctagattgattttcaaatgatagttcctctttgaagtatttacaggtctgtttttgccagacatcttttcatactgggaacttttttttttgtaatatccactaaagttaatctgcctttatatagacttggatttttaaaaaaccaaaggatatattttccattcagatttatggtaactattttatgagtaaatagaagtttgaatatttttcttatggtttaatctgtttttttaaattatatttattggtgatataaatgtatcagatgtatcagtgcctgtgctcaccaagttcgtctcctaagaagcagtttgtgtgctacaacgtatgcgtatgagtaaataacacatgaacaatctgctggggctgccaggtacatcccagccaggacagccgctgggccagggggaagaggtactgctgagggaaggaagcagctcttcatgggcagctagccaggtgtaaccatcacagtaaaaacagccaaagagagaagaacaacagcagtccttgaggatattgttttccatgtttatttttagaggaaatcataggtttgtcagtttctgctttgtgactactgtgagaagctaaacaattagaagcattacttgtgatatttttagtgtatttatgttgttttcatttgatttgggggtgtattatagtactgatcacaattctaatccccatcaagcaatgtacagataactcttccaagaaatgtttccctcctttctttcctcccttcccttctctttctccctcacctcctgtctcctctcctcctccctttttaaaggcctttgaacagtttaaacgaccactcaataaaatggctctgccctt

SEQ ID NO: 232490 - DNA, 1514 bp, Homo sapiens
tcaataatggccaacttgctatttaactgtgataaagggaaatgtttctgaagacattttaaagttttttatacatacgtaagatttttatatacatacgtaaggattagatactatgattactttttttgtattttgaaattgaaggcacttaagctcttgtgatattttgaattgactgatccatttaaaaaattgtttagctataggtgtttgtaacaatttcttataaaatgattttttttcttgattcatgatattaaactccagattgaaatgaggggctatgagctttgaccctgaggaaagaaggccaaaacatagatctgaggaaagatttgaacatggcaagacaatctcagggttaagatgttgctaagttgattctgagaatcaaaatcaggctttttttcctgtgatgggatcataaaaataatctttttatcaggacaaaggttatgggcgaaggatagacagaattttggcactgctgctttcctgagccaaattaagtagtttttctaaatcatgaaaaaagagcatgactatccatctggaacttcctagattgattttcaaatgatagttcctctttgaagtatttacaggtctgtttttgccagacatcttttcatactgggaacttttttttttgtaatatccactaaagttaatctgcctttatatagacttggatttttaaaaaaccaaaggatatattttccattcagatttatggtaactattttatgagtaaatagaagtttgaatatttttcttatggtttaatctgtttttttaaattatatttattggtgatataaatgtatcagatgtatcagtgcctgtgctcaccaagttcgtctcctaagaagcagtttgtgtgctacaacgtatgcgtatgagtaaataacacatgaacaatctgctggggctgccaggtacatcccagccaggacagccgctgggccagggggaagaggtactgctgagggaaggaagcagctcttcatgggcagctagccaggtgtaaccatcacagtaaaaacagccaaagagagaagaacaacagcagtccttgaggatattgttttccatgtttatttttagaggaaatcataggtttgtcagtttctgctttgtgactactgtgagaagctaaacaattagaagcattacttgtgatatttttagtgtatttatgttgttttcatttgatttgggggtgtattatagtactgatcacaattctaatccccatcaagcaatgtacagataactcttccaagaaatgtttccctcctttctttcctcccttcccttctctttctccctcacctcctgtctcctctcctcctccctttttaaaggcctttgaacagtttaaacgaccactcaataaaatggctctgcccttcacaggtggttggaagttggctttgtgcctcacacaccataggtgtataattatggagcctaacagatccctttgttattttactgcttatgcttgg

SEQ ID NO: 232491 - DNA, 495 bp, Homo sapiens
tagagcaagagaggatatctaaaatcaaagatatatgacactgctggggctcagaaactgatatcccaaaatattgcactttgacatgctgaactgaagaagctacaaggtctctctgaccttctccccacccctcctgtctctcaatcctttccgtctcccaaagcacaggatgaagttgttttcagaagttccttatctgcctaaagtccaaacctgccaaagaatacaattatctttagtctctactctgagttttcattaaatgaactaatatcacagggagaaacacaagcctgtcaacaaacctagatagattttgtcacaaaccactgtctactctgcagccctaacagacattgtcccaggcccttgcatgttcttcaagcccattgaattcccctacaaatcatttattatatccctaaaaacacttctcaagctcccatttccctaggaagtagaataaacatctatgtccaattgcagtattgg

SEQ ID NO: 232492 - DNA, 344 bp, Homo sapiens
ttttgtagacacggggtcttgctactgtaacccagggctggtgttttgctgctttaaaaaaaaaagttttctggtcgggcatggtggctcatgcctgtaatcccagcactttgtggggctgaggcaggtggaccacgaggtcaagagataaataccatcctggccaacatggtggaaccccgtctctactaaaaatacaaaaattagctgggtgtggtggcacacacctgtagtcccagctacttgggaggctgaggcaggaaaatctcttgaacctgggacgtggaggttgcagtgagctgagattgtgccactccagcctggacacagcaagactccatctc

SEQ ID NO: 232493 - DNA, 1587 bp, Homo sapiens
ctgggccctgttctaagaactttgatgtatccttatttagtgcttaaaataaacctaagagggttaagtactattatgatttccattttacacgaaaggaaactgagctgcaaggtcacatagctagtaagggattgttctgggctgaagaaaaaggatgcatggaggggagtatcttgcccaaggtcacgttattagtaattagtggagtcagaattccaatgcaggttccttcactccagctcttcttacctcagaaaacacacttgcctggaccctcccctggagttggatttagttggcttgggcatggcgatttttaaaacttccccaggcgattttaatgcacagccagactgagaaccactgctttaccccatttttggagtaaaatgaattaccctccttaggaaatctggtcgctctatgtggccattcctttagttcctgcccctcctccacagaaacacaccattccaaatctggcagctaatttttcatggtctttgtttcttcaaaattattttcaggaagtcttggtgaatatatgttggggtataaacagaccacaaagaaagaccccataggggtattctgttgatggattttctgcacgatcttttctttttcattcttccattatacttcctggaggagggactacccctttgttcgtcatttagttccagctgggtaccaggttgggtatttggggaggtttacagattaataaaactagaccactaccctccaggagttttcaattttagaagggaagtatataaatgtaattctaggtttaatttttagagtgaggtggtgtggagtgtgagctctgcagtcactgccttggtttgagttcctgccccaccgcttcctacccacagaactctggccagtgcttgagccctcctggtctccaggactttgttggcacagtggacatgccaaattttttgatgagagacatgacgagttagtgctggtggagtgcacaccaccgggcccagtgtgagggtcagtcctggtgagctgctgtgctctgtgcgttgcctgaagctttccagcaggccttagctgatgctcatggatccaaaacatcaatagtaagttactaagccttatctgctgctccttaaattgacagagtcaagaattaggtaaccagggaggagccacagaggtgtgtgaatgggaaactagacccagtcctggaagatgagcaggaaatggagtgggagacattgataccccaagaccctagttaggcaaaaagaaaaaaaaaaaaagacatctaggctgggcacggtggctcatgcctgcaatcccagcactttaagaggctgaggctggcggatcacttgaggccaggagtttgagaccagcctggccaacatggtgaaaccctgtctctactaaaaatacaaaaattagctgtgtgtggtgatatgtgcctctaatttcagctactcaggaggctgaggcatgagaatcgcttcaacctgggagttgaaggttgcagtgagctgagatcatgccactgcactccagcctgggtgatggagtgagactctgtctcaaaaaaga

SEQ ID NO: 232494 - DNA, 1588 bp, Homo sapiens
ctgggccctgttctaagaactttgatgtatccttatttagtgcttaaaataaacctaagagggttaagtactattatgatttccattttacacgaaaggaaactgagctgcaaggtcacatagctagtaagggattgttctgggctgaagaaaaaggatgcatggaggggagtatcttgcccaaggtcacgttattagtaattagtggagtcagaattccaatgcaggttccttcactccagctcttcttacctcagaaaacacacttgcctggaccctcccctggagttggatttagttggcttgggcatggcgatttttaaaacttccccaggcgattttaatgcacagccagactgagaaccactgctttaccccatttttggagtaaaatgaattaccctccttaggaaatctggtcgctctatgtggccattcctttagttcctgcccctcctccacagaaacacaccattccaaatctggcagctaatttttcatggtctttgtttcttaaagaaagaccccataggggtattctgttgatggattttctgcacgatcttttctttttcattcttccattatacttcctggaggagggactacccctttgttcgtcatttagttccagctgggtaccaggttgggtatttggggaggtttacagattaataaaactagaccactaccctccaggagttttcaattttagaagggaagtatataaatgtaattctaggtttaatttttctaaaagtcacttcagaggaatacaaagtattagggaattcagaggcagcagaggcagagtgaggtggtgtggagtgtgagctctgcagtcactgccttggtttgagttcctgccccaccgcttcctacccacagaactctggccagtgcttgagccctcctggtctccaggactttgttggcacagtggacatgccaaattttttgatgagagacatgacgagttagtgctggtggagtgcacaccaccgggcccagtgtgagggtcagtcctggtgagctgctgtgctctgtgcgttgcctgaagctttccagcaggccttagctgatgctcatggatccaaaacatcaatagtaagttactaagccttatctgctgctccttaaattgacagagtcaagaattaggtaaccagggaggagccacagaggtgtgtgaatgggaaactagacccagtcctggaagatgagcaggaaatggagtgggagacattgataccccaagaccctagttaggcaaaaagaaaaaaaaaaaaagacatctaggctgggcacggtggctcatgcctgcaatcccagcactttaagaggctgaggctggcggatcacttgaggccaggagtttgagaccagcctggccaacatggtgaaaccctgtctctactaaaaatacaaaaattagctgtgtgtggtgatatgtgcctctaatttcagctactcaggaggctgaggcatgagaatcgcttcaacctgggagttgaaggttgcagtgagctgagatcatgccactgcactccagcctgggtgatggagtgagactctgtctcaaaaaaga

SEQ ID NO: 232495 - DNA, 1643 bp, Homo sapiens
ctgggccctgttctaagaactttgatgtatccttatttagtgcttaaaataaacctaagagggttaagtactattatgatttccattttacacgaaaggaaactgagctgcaaggtcacatagctagtaagggattgttctgggctgaagaaaaaggatgcatggaggggagtatcttgcccaaggtcacgttattagtaattagtggagtcagaattccaatgcaggttccttcactccagctcttcttacctcagaaaacacacttgcctggaccctcccctggagttggatttagttggcttgggcatggcgatttttaaaacttccccaggcgattttaatgcacagccagactgagaaccactgctttaccccatttttggagtaaaatgaattaccctccttaggaaatctggtcgctctatgtggccattcctttagttcctgcccctcctccacagaaacacaccattccaaatctggcagctaatttttcatggtctttgtttcttcaaaattattttcaggaagtcttggtgaatatatgttggggtataaacagaccacaaagaaagaccccataggggtattctgttgatggattttctgcacgatcttttctttttcattcttccattatacttcctggaggagggactacccctttgttcgtcatttagttccagctgggtaccaggttgggtatttggggaggtttacagattaataaaactagaccactaccctccaggagttttcaattttagaagggaagtatataaatgtaattctaggtttaatttttctaaaagtcacttcagaggaatacaaagtattagggaattcagaggcagcagaggcagagtgaggtggtgtggagtgtgagctctgcagtcactgccttggtttgagttcctgccccaccgcttcctacccacagaactctggccagtgcttgagccctcctggtctccaggactttgttggcacagtggacatgccaaattttttgatgagagacatgacgagttagtgctggtggagtgcacaccaccgggcccagtgtgagggtcagtcctggtgagctgctgtgctctgtgcgttgcctgaagctttccagcaggccttagctgatgctcatggatccaaaacatcaatagtaagttactaagccttatctgctgctccttaaattgacagagtcaagaattaggtaaccagggaggagccacagaggtgtgtgaatgggaaactagacccagtcctggaagatgagcaggaaatggagtgggagacattgataccccaagaccctagttaggcaaaaagaaaaaaaaaaaaagacatctaggctgggcacggtggctcatgcctgcaatcccagcactttaagaggctgaggctggcggatcacttgaggccaggagtttgagaccagcctggccaacatggtgaaaccctgtctctactaaaaatacaaaaattagctgtgtgtggtgatatgtgcctctaatttcagctactcaggaggctgaggcatgagaatcgcttcaacctgggagttgaaggttgcagtgagctgagatcatgccactgcactccagcctgggtgatggagtgagactctgtctcaaaaaaga

SEQ ID NO: 232496 - DNA, 528 bp, Homo sapiens
caaaatgtccctcaactggtgaggggtgctatggtctgaatgtttctgtccttccaaaatttgtaagttgaaacctaatccccaatgcatgggtatttggaagtggggactttagggtgggattaaattatgaagtcagaccgctcatgaacggggtcagtgcctgatatggttagaatatgtaactcttccaaatctcatgttgaaatatagtctccagtgctggaagtggggcctggtgtgaggtgtttggtcatggaggtggatccctcattaatggcttggcacatccccttggtgataagtgagctctcactctgagttcatgtgagatctggttgtttaaaagtatgtggcattcccccacacacaattttgccatgtgatgtgccttctcctgctttatcttccaccatgagtaaaagcttcctgaggtctccccagaagtcgaggagatgccagcaccatgcttcctgtacagtctgcagaattatgagccaataaaacctcttttctttataaatcaaa

SEQ ID NO: 232497 - DNA, 427 bp, Homo sapiens
agttttttggtctctctatttagccaaagaattatatttaaatatagagctgacctgctgattatcagtaattttctttcataagatatcaaatgaatactgagaatatcattctgtaccttctttaacgtctaattgtggttctcatctggaggatggcagtttgagaattaggactaagcccgtctcccctttgagtccatttaaaacaatgaaaatctggtcaaatatatccaaggaagatagagttgggcccactctgtcttcaatttaaaagcaggttggaagatgaaatataaatattaatatgaatagggtgatattatttaacatatctgtcttttgtttcatatgtccaaattaaaattttctatattgattgctttcaaagttaagcaattcacttgaattccctaagcattagaga

SEQ ID NO: 232498 - DNA, 605 bp, Homo sapiens
gaaccatgttaagccatgccagtgaggagagcaacagagcctgtctgtccccatgagggagtctgtctctgcttttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatccaaaccaataacccttttggggtttcttgtggcggttgaaatagtcccacatgtggtcatcagaaaataagccattcctcataccaatataggatcagctccttgacctttgaggggcaggagtgcttcctggtgtgtgtattaaaatcccttcctgccttgtttcatggcagtgaaatgccttttggtcctgtccaagtgtatctttcactgatttttgaatcatgttctagttgcttgaccctgccacatgggtccagtgttcatttgagcataactgtactaaatcctttttccatatcagtataataaaggagtgatgtgcaatagcaaaaaaaaaa

SEQ ID NO: 232499 - DNA, 534 bp, Homo sapiens
ctcagttggttgcatgatcttgtacaaatctccttttcagactcagcgcctttacaggtttataccccattccgctgaggggtgggtggcattgcttaacaggttggaaaacaaggccatgggataatttaagtcatctaaatggaagattgaggcagaaaatagttttctagtttcttaatccagttgctcatcagttcagttacgctgaatcttgatttttacttctggattttgtttagatatgagttattaaattacattttgacaaaatgttgaaagtttgttgcagctgttcagaaaactcaaattctgaaattaaaaacaactaagtaaagatttttgctaaggaaaaactaagagcacttgtaatttgggatgtatatggactatatataataatatgtagttaagattgaagaccatatgtttaaaaattagatttgctgttagtatatttttacattgtaaattattaatttgcttcattatgttttgctggaaagctaaaagattagtaatgtctgacttcac

SEQ ID NO: 232500 - DNA, 1056 bp, Homo sapiens
gtgtgtatgtgtgtgcacatgagagagagtgagggagtacccaagtgagagaatgtgtaaaacaaacaaatcagttgctcaaataacctgcttgaaaaggcttgttctaattctaagcagtattcctaaaacatgtagtttcctgatacttgaataatatatgatagcaattcacaattataaagctctttcacacgcattacctttcacttagtgtttaaatttgtagaaatttctggattttaaaggccacattttctaaaggaagctattgtgttccctgggcaatgtagacacagaactgggtgattgcacaattggacacagaaaatttttttctttaaattataggccagagaaacatgtctaaattgatgttttgaaactttctctatggctttcataagcttttcctttatggctaccaattatataaagtaagtagattctaacactttcaatatgatgatctctttcagtgtcaaagagaaatgaatccttgtatagcaattgttcttttactgtcctttgattgagaaaagtatacacaaaaactattaaattttgtgactttaaaattgcattttttggtgtgtgaagctcagtctgtactttattgtgggaaaagcatgtaaaatgatggacacatgatttttattttactataacattgaaaataacgattaaatattatttaattctgtgtcagagaaataattttgttgagaacattctcctttattaagagaaaaaaaaaaaaaaagcattccaggcatggtagctcattaatcccagcactttaagaggccgaggtgggcagattgcttgggctcaagagttcgagaccagcctgggcaacatggtgaaaccccatctctacgaaaaatataaaaatcagtctggtggcatgtgtctgtgtctgtgatctcaactacttgagaggctgaggtgggacaaattgcttgagcccagggaggcagaggtttcagtgaggcaagatcgtgccactacactgcagcctgggtgacagccagaccctgtcttaaaaaaaaaaaa

SEQ ID NO: 232501 - DNA, 407 bp, Homo sapiens
ctttgggagtcattgtatgtgctaaccttaatggtgttactctaataattatgtacgagcttgttaatgaactgggaaacattgattttagaagcttagaaactgtggaggaaggtgcttcatatggatctttctactttttgtatcttttgtgtttccatgaaaaaatcttttaatttgtgaaaagtaagcctcagaattcatgtctaagcatttcgtagaaggatgcacgtgagaaaaagcacctgcgctgtcatagcgatcctttggtgttttaagatgaaaaagttcaaagcattttagaatagtcataaagatgacattgtataagttaggagctgggttgtcctgtcactttgtggtgacaaaactggtgaaagtggtattaaaatcattgctggatatgt

SEQ ID NO: 232502 - DNA, 457 bp, Homo sapiens
gtcttcctaggcatcatctattctttatcctgcccttatttatcctgcctccacagtacatttcagccatgcagaccccacaaaattcactacttgtggctgcttgtttgtcacccacacacccatcagtgcttagagtctcttctctggaagtagggctgttttcacatgtccatttacagtctactgctttctagatttctctcctttaactctctacactgctacaattaaagtgaactacatattgctcttccctttttataaaaattctatttcccctccctttgttaattttgctcagaatgctttgttcttccagaaagtcttttcctattccatttctgtagccccccttttatctagaaaaaagtctctctgaacgtctgtagcacttaacataaacttccttgagatacacttcattttttactaacatgtggacctatctacatct

SEQ ID NO: 232503 - DNA, 487 bp, Homo sapiens
gacactctgaaatcagaaaatatcagagaaatagggcatttcagtaaataatatataaaattgatcaaatttcttggaatgggtgataaattttattttttccatgacacagccctcaggagatcctgaaaacacgtgcccctgtgatgagatttttaatcaaaatcataattcaagatcatgtaaaagctaaacccactgtactgacttgggtcaccctcaagtagaacttatatattctctcccgttttaacattctaaaacaaattaatgttaatcaatccaccttaatttgtcaagttcaagtccgtcttgccaaaactaattcaggtacatggtaaaatttaccagatttttaaagataaaataatgaattgcttttcctatttttgcctgttttatctataaatctcttacattataatttaatagctcatcctgccgcaaatagaaagcctataaaacctatccacaatagctatgtcca

SEQ ID NO: 232504 - DNA, 573 bp, Homo sapiens
cttagaacattttaattttttttaccaatgattttaaagacagtttatttattaaatattttacttgtcacgtgaacttgaaaagcattgattagtattttttgatcaagtatttaagtgcttttatttttacttaagctaattagagctcttttacatatttttagtagtgacacattgtgtacacaacacataaatgcatagcgtattaggcatggcaatagaagtacatcttatgtatttgtaagacctctttttcccttagacttttaaattcatgatagcctgtttcatcaccctgggcagttgtcagctaaatagtcctacatttgcatattaaaggaaacaactcttaggtgaaaaatcagatagcaaaatttacatctcaaagtaccaagagacagtctggtttgctagagggaaattaaaatggatttaatttgccatttaaacaaaattatagaagtctattataaaatccttttaaatacacacacacacacacacacagatcctatagcttttacttcagaactttagccatgagataaatacaaattccccagcttgcaa

SEQ ID NO: 232505 - DNA, 161 bp, Homo sapiens
aataacaaaaaagaacatcacctttataaatatacctagtagaaactaatttgataccaaattgatttaattaccgtcatccattttaagaatgtacaaactcacctagaatagtaagaaattgtacacaattctttgatacccattattagactagatac

SEQ ID NO: 232506 - DNA, 464 bp, Homo sapiens
ctcaaaacagcatgtattcaaaatgtaaataaggcggtttatagatgaatgggaagatttgtgtattttcactaaactcattaaaggtactgaatctgttacagtatttattttgtattttttcactttgtactcagaacagtgtaaataaaattactgtgttaactgaatcctgaatgaaaattagttgtccttaatagtaattggaatagtagttgtaattgtagttatctgttgagattgtggagctaataaaataagctagaaattcagtggaaaagttaagttaacatttgttgagcaaaataatttattgcattttaaaaacatctttcaaaccttgggggcagtgtagattgtccaaatgatagcccaaaattcaaagataatttctgaaatttgtattttcttttatttgacttaggatgttgacttttcttggctaaataaaattattttactta

SEQ ID NO: 232507 - DNA, 521 bp, Homo sapiens
attttgaattctctttttacttctttatattattaaaaattctaaaatgagcatttttacttttgaaacttaaaataattacaggtgtatttatttaaaaaacacatattggatctttactatgtgtcaggcattttcccaggttctgggaataaaacagtgaacaagagagacaacatcagacatcgagagtagaatgatggttacctgaggctgggaagggtagtgggcaagtggggaggaaatggggatcgttaatgggtacaaaaagtacagtaaataagatctagtattcaacagcacaacagagtgactatagacaataatgatttaattgtacattttaaaataaatgtataattggattgggtaacacaaaggacaaatgcttgaggtgatgaatattccatttaccctgatgtgattattatgcatcatatgcctgtatcaaaatatctctcatgtaacccagaaatatatacacctaccacctactatgtaataaaaaaataaaaaattaa

SEQ ID NO: 232508 - DNA, 613 bp, Homo sapiens
agaagaataggccgccactgaacggctcagccccctgaccaggagctgtccggatgttttttgtggcggcttgcaattcgctgtgacctttccaggaagtgttgcacacgggcgtgtggcaaacgagctggccgtttctcgcggtcctgctaaaacgctgtcaacctggcgctccaccagaggccccttggcttctcgggaggcgaccgaggagctctgggggcggggaggcttttacaagaagcgaaaagacggcctcaggggtggccgggaacagcctggaatcagctggaggacgtcagcaggactgaggaaagggctaccaccagcgtgaggaaaggggggaagagggcggaacgcggcgaacggccgcgctgggaggctgaggcggggtcccagcgagccggcggctgggaaacaatggcgcgagcgtgacgtgggccggaggcgtcgcggcggcgcggaggaaggggctgccgtggggcgggggccgcaccgagggagttgggaggcgtgcggcgtccgcgagcgcgctggcggggactcggcctaaggagaggggccttggggccatggtccctgggggccgggggcgggggcaggcggcggccgc

SEQ ID NO: 232509 - DNA, 505 bp, Homo sapiens
agaagaataggccgccactgaacggctcagccccctgaccaggagctgtccggatgttttttgtggcggcttgcaattcgctgtgacctttccaggaagtgttgcacacgggcgtgtggcaaacgagctggccgtttctcgcggtcctgctaaaacgctgtcaacctggcgctccaccagaggccccttggcttctcgggaggcgaccgaggagctctgggggcggggaggcttttacaagaagcgaaaagacggcctcaggggtggccgggaacagcctggaatcagctggaggacgtcagcaggactgaggaaagggctaccaccagcgtgaggaaaggggggaagagggcggaacgcggcgaacggccgcgctgggattgttgccgtgcgctggagccggtgagtgcggcgggccccgtgggcgggcggggaaggagcgggcgaacggggagctaggtggggaggtgcgcggccgaacacgcgaccccagggtagcggccgc

SEQ ID NO: 232510 - DNA, 189 bp, Homo sapiens
gggctacaactttctttctttctttctctttctttctttctttctttctttctttctttctttctttctttctttctttctttctttcttctttccttccttccttctttctctctttctttctttccttctttctttctttttctttctttccttccttccttctttcctttcttttccttcctccct

SEQ ID NO: 232511 - DNA, 376 bp, Homo sapiens
aaggaaaggagagctggggacgggggagcccagaacacaaggctgacagcacaaagagaaagccctctgtccccaacaaacctagaaatcaacatccccaagctcgcatggcccaaacacactaagaaatacgactcagaaaatcaacagggccagtggacccatggatccatctcagggagataaaaataacgagcaaacaggtacgcttaggctatgtttaaatatgtgcaggatccacagagacagcatggataaaatgttaggaaatacatttggcttctgtctaaggagtaaaatgaacaggcatctatttttaaaaattacaaatcctggatgtaaaaaatacaatcatttaagtggaaaaaaaacacta

SEQ ID NO: 232512 - DNA, 418 bp, Homo sapiens
attatttctaaaaattatgttatgtaaaactattttctaaagcctctgggattgctgagtctgaaagtaagcaactaaattagaaagaatttaagaataatattctcataacaaatactgagttaataccgaggtctagaatctcatatactgtgacaaagttagcattatttctcactgccctggggaaattactccctggacatgagtccctgaggcctgaggcaagtccactctgtaaggctaccacatgccagcagatatgggcattattcactattgaaaactttgccatttcagattttatctcaattataacataccacacacttacctttgtgtgtgtgcacatgcacacacacagttcttaaataggtcttctggaattttacacacctattgccaagatgtgacattt

SEQ ID NO: 232513 - DNA, 520 bp, Homo sapiens
agctatctaaagtgaaatcgcttttcctttgtgggctggtattgagaaagagacctcatcattggtaggaaagagatttgagctttgtcattcgcaaagtggatcaattttcatttattaataatatctcattatgtggtacttaagtggaggataaataattcttttttgtatcatgggtattctatgacactttaaagtgcttttgttaagtgctttctcatttagttagagaagagtaaagtagctgctgaagaatcctcattttaagacttgagtataaattattcttcccctgtagcttttctgggcatatgctcagagaaaagcgggtggttaaggaaaaatgcaattatgttttctttccttggctaggaagcaccagtatgaaaattttctcacagcctaatttttaaaaaacaaaaaggctttgtggcaaggtaattgattaagagggaaagtactgaggatgatgacctttctacagtgacagagagtgatgaaattggttcaaagtaaa

SEQ ID NO: 232514 - DNA, 582 bp, Homo sapiens
tgacattttttagtctctccctatctagtgagtgattcctactgacatgctcaaatctccatcctgtatcaagaaagcagaaatgggggacgggagtggggaaggggggaatatctcttccacaaccagactgctcaactcttccttttttttttttttttttttgagacagtcttgctctgttgcccaggctggagtgcagtggcgcgatctccttacaatattctagcccaggtgttggcaaactacagcatactagacaaatccaacctgttgccagtttttgcatggtcacttggctaagaagggtttctacgtttttaatgattgtgggtagaagggagaatcaaaagaataatgatattctgtgaagtgaaaatgacacaaaattcaattttagtgtccataaattaaattttattggaacacagccatgctcatttcttacggttttttctggctgcgtccatgctacaatagcagagttaagtagttgtggcagagactatatacccacaatgcctaaaatatttactgtgtagacctttacacaaagtttgctgactcctgctctatctagcc

SEQ ID NO: 232515 - DNA, 506 bp, Homo sapiens
ccaggcccaaggtgatcaggccacacactctgatgtgaaagttccagaaacaacttaaacatcagccctgacagcagacagctctgatgaggaggagtcactccctgagtggccagggaagctgccgattgctgtctggcaaatagaaaaaggcagtggctgagcttcccgggggcgagcagcgcaagcccaagacagcggcccagggacctcggcaagccggtgagatccagacttgcacggcccacaaaggcctgagtgaacctgagtgaacaggagccaggccatgagacacaggcacagaagaggctggccaagcccagaggaatcttctcctgtgtgttctgctgctgctgtgtgtttaaaccatttttaaggcctttaaatcaaaccggcgactttaatccgatgaaggcttagcctgctgcactgtgcccacgacacgtgtacccagtcgccgccacgtgctccaggacagggaccaggtggagtcaccgtgatcctca

SEQ ID NO: 232516 - DNA, 511 bp, Homo sapiens
agttgtgcctgtgctatttgttaaactctcttttctgttgaatggccttggcacccttgcaaaaattatttaaccctatgtgcaaaggtatttatttctgagctctctgttccattccattggtccccacgttctgtccttacgccagtaccacactgttttgatgattgtagctttgcagtgagttttgaaatcagaaagtatgagccctccaactttgttctttttcaagatcgttgtggctattcagggtcccttgggattccatatgaattctaggatagtttttctatttttgcaaaaaacagtaattctgataggattatactgactgcagatcgcagtgggttgtgtggacatcttaacaatattctcttcaatccatggacatgggatgtgtttccatttattgtgtctttttaaatttctttcactgatgtttcctttttttttttgtcgttgttattttttgtttgtgtactccagcttgggcaacaggagcaaaactgtc

SEQ ID NO: 232517 - DNA, 550 bp, Homo sapiens
cgacgcagtgtaggtcaaaagaatgcatgcacgcttctaaatgaatcttgtctgaatatgtcgtgcaggctgtggtgccgttttccttgtaacaaggatttattagtgaattatcccaagtactccatatatctgtctgtggttgtatgaaatgaaaaaaggggcagagtgcaaagacccacactcacgcacacgcgcttcttctcccacccccacccccttcaaactttattcggaaccttcctttgctgttctggggccgctattgtaaaagcctgggctccctctagtagcttgcgccaccccccctcgctcagttattctgcatgcggggttggctctctctattatcagctttgaaaacttatcctggttttgggaggggtgccgtttttattttcctgaacatttgcttgaaatattttgttagggcctcaaagacgatacctgtctttattttttatatattcttgataactatgatatatttattaataaccagtgtttctggatgagatttcaaataaaaaagaacctttaaatcgtggct

SEQ ID NO: 232518 - DNA, 558 bp, Homo sapiens
tagtgacacctggactcctgggaaggaaaagaaaattcgtttttagcaatgaggttgctaaaagaagcaactagaaaacaagctactccaacttcagatctttgcttggtaaagcctctactttcaggtgagtggggtgagttttctgatgagaatcaagaaggccggcctctctctctgggaagctcccagcttcatggtcctgtggcagaagaaacccaagtctggaagaatccagggcctcatctgagcctttctctccagcattagaaggaaatccacaattggctgacaagcccgcattccaaacacacacccagttaatgaaaaccacacacacacaaacgagagataggttctacctgcctgtgacaatctggagtaggaaaagcacatgaaaaatagccttgggactttattctgaatactctgcacctaaggaggaattgagtttctcaaaaataaaggctttctgtttacaaacatgctgtttttgccaaagagaattctttattttaggtgctttgggaaaactgcagagtcctcgggtttgtggcc

SEQ ID NO: 232519 - DNA, 467 bp, Homo sapiens
aaggcagcacgctcattactgagatcccttgctagtggcaggaagccttcgtatgagttaaggactctgttttgaagtacagaacttgtctaaataccactcacatgcagagttcactatcgcaccacacccatctctttacttaatacaagagatttcaaagtaagatgtcatcggtggttttatggtccctccagaggatgagcagaccataaatctctcttgaaactcagagctgggccaatttaactgtttgctcattattttgtaatgctgagattgaagggagaaaaaaaaaccttcagaaatttttgcaaaggaataagttgagttgttggctgaatcactgtggtgaatttcagtagtaactctacggctcacattttatgttagaaagaaagtgattctcaattccacgttaactgtgtgcagtaataaaaggcagtttgagattgcttctcagacac

SEQ ID NO: 232520 - DNA, 363 bp, Homo sapiens
ctaccaaatgccacctttacccaaggccatgaagatactgccctttgtcaccttctgaggcattgttttccctccctatttacacctgctgtccacctggaaatgatttcccctctgatttttattatgaaagttttcaagtctaccgaaacattaaaaatagcttaatgaacactaatatccttccactaaattcaccaatagttaatgttttgccacattttttcaaaatatagatgtaaataggtagacagatcgtacattgagctgtacaattttgttttattccgaaccatgtgaatgttttaaacattttgacatttccctcctaaatatttcagtgtgcttctcctaaggataaag

SEQ ID NO: 232521 - DNA, 199 bp, Homo sapiens
aatggacattcaaatctgtaaatactacactgctcttaagacctgatttgaaatttcacaggaaggcctaatcctatagtcacaaggtaaggacagttgagtagtgtaagaaccccaacctgcttgcagagaaccttggttttcatagaaaggaaaggctgaaggttttctagcattgttgcccttctttgtctgtcag

SEQ ID NO: 232522 - DNA, 502 bp, Homo sapiens
acataattatccacttcagctgttctgaacacaggtaagaaccaggaagtaagcattaaagagccctggacaggccaggtggatagccatacgctcacacccatgcatttaaaggagagctctttgatctttattcattgtctacttaatccttttagaaaagcaattccaacaaatttttatctagattccaacccaacagaaatttcacagtgcctgggtatttgaggggcttggggtgggggatggcggtgatgctgaatggagctgtccaacaatagcacttgatggctaagagcctcacagggaagaaagagtataaaagcagacacaagaactgaaatgtaacagcagtctggtttcacttattttaaaagcaaacagactcatacaatctcagtaatctctgactttattattgccatacagcataatttagtaaccagtgttcataatgataatgcagagtaatatatatgattaaattctctttattctgctt

SEQ ID NO: 232523 - DNA, 398 bp, Homo sapiens
gggcctcaaaaaaacactgatgggacaaacgcaatgaatgttggacaacctcctccctcccttgcctgagatatttcagctgccctccccgaacacccctccacccgcagcgattatttttaattagttgctaacatttaaactcaggagagctcacataatctggatttctgtctcctcattagaagagttagcagccctgagactagaacccacgactccagtgctcttcagacaacctcagtggagctgggggctgccctgggggctacacctgggctgtccagcttgcacagcccttgccaggcccacttacctcatccgcagaaccctccacatccctatagtcatttgagttttcccccacccttcgggtcatgacggcttccttttttatg

SEQ ID NO: 232524 - DNA, 449 bp, Homo sapiens
ttattcaacaaatatttatcaagtgcctcctgcatgccaggtgtactgttctaggccctggggatgcggcagggaacaaagtccattaaaaactctgccctcatggagctgatatccttggggagaggaaggaagatgataagcaagacacatagaaatgcaagtggccaggcacagtgacacacgcctgtaatcccagcactttgggaggctgaggcaagtggatgacttgaggccaggagttcgagaccagcctgcccgttatggtgaaaccccatctctactaaaaatacaaaaattagccaggcgtggtggtgggcacctgtagtcccagctatctgggaggcttgaggcatgagagttacttaaacccaggtggcagaggttgcagtgagcctagatcatgccactgtactccagcctagacaacagagtgagactctgtatca

SEQ ID NO: 232525 - DNA, 339 bp, Homo sapiens
gcgctgtgcagttggggttaagctcctctccttcagccttggagcggcaggaaaaggccccaaacactctgaggctgaggcttctctgcccaggaacccaggatcatacaaccgccaggcacagtggccacagagcagcctccaccttaagggaacaattccagacacgacctcattgaatacaccatggaagatgttatcttctttaaaagtaccctcatggcagggcgcagtggctcacgcctacaatcccagcactttgggaggccaaggcgggtggatcacgaggtcaggagatcgagaccatcctggctaacacggtgaaaccccgtctctact

SEQ ID NO: 232526 - DNA, 286 bp, Homo sapiens
aattttttaacaatagctaacaaaatgttttaatagaacagttcctcatttcttttttctgttaatatttactagcttctttaatactttaattggctacccacacatcctgtgtacctatagaaaaattaaaccgtaagataacatcataagtacacagacccggaaagaaataacagtaactcattctacttcctgcttcctgaaaacagcctcagtgaaactaattcttttacccagctaagtgagtgtcttttgaatagtcttccattcaggggagttcatc

SEQ ID NO: 232527 - DNA, 417 bp, Homo sapiens
tttctgtgttgtgggggaaggcagacagctactcagcatttatatcccataagaatggataacactaaaacaactgacatcatcaagtattggttagaaagtggaactgattctctcaaacattttcattgtagtttaagatgacacaaccacttaggaaaatgtctccccatttcatacaatgccaaatatatacttattttataacccagaaaatccactcttatgtacttaaactcaagaaaagtgaaaatattattacagaaaaacatgtatatctgatttgttcgtagcaggtttattcatgatagcctcaaatcagaaactgcttttgtgtctatcaatagcaaaggcctcaaacctgtggtatagtcataaaattgagtattacaaaataaaattaatgaataatagcaa

SEQ ID NO: 232528 - DNA, 417 bp, Homo sapiens
tatttaagagagtaggctagtggatatgattaggaattcaagtataattgtgcaaagtagtctggtttctggacaaatgccaagacccactctaatcctaaacagtacttcaaaccactcgtgcccctataaattatttggtattttttacttcttgagaatacttccaactttcgtcccagaacgtatctccatgtggctaactaaagccacatgaaaggcttatagtgaattctaaaaacctttattaacaactttttaaattgtctgtcctgtcaaaacagatcataaaagttcctttgcaactgttctacttttattaatagagctgatgtgaagcagtatagtaatacatgggaaattctacctttgaaattgctacatttgaattactacagttcaagcaatattacctaa

SEQ ID NO: 232529 - DNA, 475 bp, Homo sapiens
aacaaaagttgtgggaattcatcaccattatatcttccttacaggaaatactaaaggaaaatttttaagttgaaatgaaaggatgctaattagtaacatgaaaacatatgaaagtataaaaatcactggtaaaggtaagtatatagtcaaattcagaatactttaatactataatggtggttcataaatcacttttgactatagcataaaagttaaaagacaaaagtagtaaaaaaaattaagctacaataacattatagatatgcaatatgaagaggtataaattgggatgtcaataacataaaatgtgaggatgaaaggaagtaaaatatagatttttttttgtattgcagttaaattgttatcagcttataactataagatgttttatgtaagcctcatggtaaccacatagaaaaaatctctggtagatacacaaaagataaaaaggaaggaattacagcataccacaaca

SEQ ID NO: 232530 - DNA, 440 bp, Homo sapiens
aattaaatataaaatttattttttataaccattgtgtggggttgagattgtggataaagatgaagcaaactctgaaagataaaaacggaatgttggttgtgggattgtgggtatactactttggttgccattggataatttatttaaaacacacagattggccaggcatggtggctcatacctgtaatcccaccactttgggaggccgaggtgggtggatcacttgagttcaggagttggagaccagcctgaccaacatggtgaaaccccatctctactaaaaatataaaaaattagctgggcgtggcggtgggtgcctgaaatctcagctactcaggacgctgaggcaagagaattgcttgaacctgggagatggaggttgcaataggccataatcacaccactgcactccagccagggcaacagagtgagacttctca

SEQ ID NO: 232531 - DNA, 432 bp, Homo sapiens
gtagagatgtggttttgccatgttgcccaggccagccttgaactcctgagctcaggcaatccacctccctcaggctcccaaagtgctagaattacaggtgtgagtcactgtgcccggccaagatgtactttaggatgctagtccgctgtcttcttggtttactggatcttcaaataaactggcttttcctcccaccggctcttcctcttgagttttggctttggttacatttgtggatgaaaggaaaaaatgcaaaaatatgaaatagacgccatcaaaagggccaaaaaagaaaaaaagaagaaaaataaaacaattaaaatgaaagcttagaagttttaacaaaagtttatgcaggttatggaaggacagtccctctcttgccactgtagataaacctgagctttgcacatgaagatgctgttcacgcat

SEQ ID NO: 232532 - DNA, 360 bp, Homo sapiens
ctggtatcccttcctcttttaataagggcactaatcccaccaagggctccatcctcataatctcgctaaacctaattacttccccaaagcctcacctcctaataccatcacatgggggattagggcttctttaactttttaacttttaagttcagaagtacatgtgcaagtttcttatgtaggtaaacttgtgttgtggggtttgttgtacagattatttcattacacactcttaagcccagtacccattcgttattcttcctgatcctctttctctaccctccaataggccccagtgtctcttgttcccctctatgtgtccatgcgttctcatcatttagctcacacttgtaagtgaga

SEQ ID NO: 232533 - DNA, 486 bp, Homo sapiens
gggcccaggctacctggaacctccaaaaacacgtgcctcgcctccaacaaaggcactgaggcacaatccgaaggccagccatacaacttccacactcaaacggcacacaccaaggcccaaaatagcatcagcaccatcatcaacgagatgtaaacagagggaggacacgactcactcctcctcgtacagtgtgacctgcatctcccgggagcacacttttatctgtgcacaccggtggtacccacccaggagatgatgcttctgaaactcctaaggccccaaaaccagccagcccctgtgttttcattcatccttccctcccactgaggggttgcaaacagagctctgtctttagccagcatcttctagaaaccctcatccttcctctccctcccagacacgtgcacactgagatcgagacccagacagcctccgttctaggcactttcccagtcagtttatgtgatggccctattcaaatactca

SEQ ID NO: 232534 - DNA, 412 bp, Homo sapiens
tcctgtcaggtttcttcttcagaacactacagaggcctcgctgtgcacggatcataagggcttttattccataagcaaacccttcttaggacctcccagatgaagacataaaatattgctgtgccccaggatttctagaccatccaaatcaagtattcagagcactccaatatacagctataattctgtagataaacttaatatttcaactatgacatagctgtgtgtatccatgagattccacgcttctcagatataggaagcctgtcttctagtcctcttgtaatctcatcctgaagccctgcactcaggggccatcaaggatctgacagatcagcctttctcagtccctggccccagcagggggaaatgctgtgtaaaaaaagcacagcatcctggaatgtcagaccca

SEQ ID NO: 232535 - DNA, 988 bp, Homo sapiens
ggtttctgactctaaaatcagatgtttttcacatccagagctgctttaaatcctcctcaccactccaccccctaacaactgcttggttcccctctcagctcaatctgctgtcaccttcattacttaaagcattttttcttccatagcagtagctttaaatgttactgcctgcaacttcaggcttttccagcctcaggacaattacataaaggaacaaaaaataggctttgtgctagagcagaatagctaaggcaggagctgttggttccaatgtttatatttcaggctatattctttgtctctttgtttctctccttttaaaaaaatgtgatccactcattttcatacatatcaccgcagggcctgtttgcgcaggtctgagaacgcatcactcctggtacagtaatagtgactgtgcacacatcagcatgtgtgggatgggtagaccctgggtgtacattgtctatgcagaatcattaggactcatctcaaggatgctgaggaagtgccagtcatttcacatacagttcagttgtgagagacaattttttcctttgtaaatactaatcaccatcaaagcataagaatgctgatgagacacagccgatcactctgccatgatctctgagcattaggaggctataccatggcagtagaaagtaaaaatgtctcttcttgggaaaaacagaaacattttcaaagtgtaacctcaggagaatattaattaccttaactcaaactttgacgttggggaaagggttggcttcatgttgtgtaaatttcaatcatcatagaaattctttaccatatttgatatagttggggtaggttttttatttattttcacctctgaagatttagctgggtttaatatgctcacattccccagtgaagtctacatgaggaggctgggaagcatactggttaaggctatgggtcttaagcatacctttcccacttatgcagtgtgactctgggaagctattta

SEQ ID NO: 232536 - DNA, 464 bp, Homo sapiens
tacccaaaggtgtgaataccaggaggccatcttagactctgcctgccacagctgggttgcagccagacctgcctacctctgaaacccaatgcactgcaaatagttgcctggagatcctggtgagcaacccagcttcttacagaagtaagaattagtggataagtttgacacaaattgttaagaatgatccagagtcttttgctcttctagacttactcttcttgcaggaagtgagaacaaatggactgtcagctggaatagaatttcttgtatatcaagaccagcatcctacacagagccctcagtaaaactatttgcatgaacagattttgggctccatcagctcgattgccctacttttataacaaatgtttataatatccttaattctaagatgaaatccataaataaaatgtccctgcccacataatttcaaaatatcaatatgatgtaactgtaatata

SEQ ID NO: 232537 - DNA, 437 bp, Homo sapiens
caaggaatcatctgaatggatggctaaaacagactgcttgggccccactccagagttcctgtttcaggaggtctggggagggcctaagaacctgtattctaacaagttttgagggatgctgatgtctgaactagggagcacagtttgagaactcccgctctagattctgttgccacactgctttttatcaagtacctgactgttaagtcactgatattcagattttgaaagtgtatttgtcacatttagatgaatttgaattgctcctagtaacataaagatattgatgctatgtatgcttcatagcatccaaaagataaaaagcgaaaataatgcaaatctgaaacaaacaaacaaaaaaaccttccaggtctcactcttattcgtaataatgattaagacagtctgtaggtaagtgagggatttaaaaaaaaaaa

SEQ ID NO: 232538 - DNA, 346 bp, Homo sapiens
aggcacatctcagttcagactggtcacctttccactgtcaatggatgcatgtggctggagagtccttctttacttaaagaagtaggtaaaattagctttaagatatttaatcccatacatctaaaatatgatttcgacatgtgtttaataaaaaaaagtacgaatgagataattcactttcttttttttttttttttttttttcagttagttttgaaatctctttgttttttttcatttaaggcatatctcagttcagactgaccacctttccagtgtcaatggctgcatgtggctggagagtcctttattggaaagcatttgaaaaatacagaaaagtagatgga

SEQ ID NO: 232539 - DNA, 247 bp, Homo sapiens
cacagggcagtcttccagctctccacaaccactccctctgcaagcatggctcactgcctaggagtcttagttaccttgtcacaaagagagcctagctactctaattatattgtaagctcctggatttgtacaggtttcccttactgtaagacacaaaacttgcacatcatcggtgctctacaaattttgcttggtttgaggtgataagactcctcctttacatatacagaattgtaaatcagagcaa

SEQ ID NO: 232540 - DNA, 88 bp, Homo sapiens
tgtccctaaaattgttacgctacaaaatgttgctgctttcctattctaggatatctatggaacatgagcactatatatacacccataa

SEQ ID NO: 232541 - DNA, 541 bp, Homo sapiens
gctattggttaatagcttctctgcgcctctgtcctcacctgtaaaatgggcacagtggtagcgcctaccccacagggaggcactgaggacgcctggcctcacacagaggaagggcaataggactaaagcagttttcagggccaggtgggtttaaaagtcctgcattctagtccttggcctccaactccttgggcttctactgtgaggaccaaatgacccagcactaagatccttccctgactcagataagtcagtgcccaatatggccaggcaccgaggtagccactggcagagacaatctctgctctcaaggaaagtctgccatgtggctgcagcagagctccttcccacttacccaaagctttgagctccaataaatcatctcaggaatacctggaaaatggaagagatgaggcgctctccctgtagaggggaagaaatggaagcacagaaaggacttggctcagagcctctttctaggaaaacatcaacttccttttgattttccaggcatcaaagaaaggtctatgcatatgagaga

SEQ ID NO: 232542 - DNA, 456 bp, Homo sapiens
agactgttgcttaataagctcttctcccgaggctgtcgtgttgtcagtgatagtgtcattcttaaatggtttgtttactcagaaggcccagtcattagaagccagaatgggcttcttatttgctttgccattttatctcacttaataaaactatattctatgttctataactgtagtgttctataactgtattctattgactatattgtattatggaataacaaggtccaaatttacccttctaccttaaaaaacaaaagacaaaatatatgaaatgaaggctttcagacttgagacaacaggcagcataggacagtgatctctgagtgaagggaaacaaatgaggtattcctggagagttccagtctgcagaacaagaagaacctggacagcccagcagtctacctgaattgaggagatagagttcaaaatatggggaaccaaggcagagtccca

SEQ ID NO: 232543 - DNA, 248 bp, Homo sapiens
cagagctctttggtttcctcattctttccagctagaacttttttcttccctacagcaggtcctgcagtttccaacattcaccaagtatagtacactaacgtctctttgcaacttctatcatttcttcagcactttgtcttagttatcaaccaccatcccaaaactccttaaatgaagttggaaaaagacattattttaatttcaaaacagagctacctataaataaccaaaagaaccaaataaatatt

SEQ ID NO: 232544 - DNA, 987 bp, Homo sapiens
aaacttttattatccatgcttatgaaatgagatttcaaatggagtcactttgatgcatcatacaaatgtatcaaattattgaaattttgcatcagcaggcacctcagagattaaatatatccttcaggaaatctagccttataacagtatcactagccttataataatcaggtagttgtagtatcctgtccttttagacttagtattggactgacagtcaggcatggcaattcctgagcatgttggtggtagattggtggagatggtgctggaagtcacctccagagcatggtgaatttgataggcaggtgggtagaatagcctcagaacatttgactttcactctatataaatcttgtggcacatagccctttatattgggtttattaataataatgataaaaatagtcattgtgactaatagtaattggcactatgcttaacactttagatatattgtcttatttaattctaacaaccccccctaaagtagtagtaatattcccattttgctgatgaaaaaactgaacccaagtatatagagcttgaaagtggtggaacaaagagcttttcaccctagccagtctaacatgcagttttggtatctagattcccccagttagagatgatgagcataataatcaatttttatctagaagattcagatgaatacttgtacattttacagcaatgataaatatgtgctttaagtaccttttaaatatatgagttgtggtgatgtttacagttgatctaacaccaaagctaataaagtatctaactgtaagtcttacaggagaaatcatgggttaaaagtcatttggaattgagggcactctcagtgcttaagaggatgtttctatagaagaatacaagtatcctgttttatacttgatcttagtaaaaagaccaagaagagatgtaatagcctttgttaatgtttggaaatatattaaaattaaaaagatattataaaagatatatttt

SEQ ID NO: 232545 - DNA, 456 bp, Homo sapiens
tacagggggactctgtgaagagtccagttccctatttttaatcaggttcatttttcacctgcttagaaagtggaacatctcctgaaaggtgacaagtcgtgatcaaaggcaagtctccaggcagagagttggcaggtttccgaagcaaaggttacttagaagtggaggctccactgccagcttccccccgctgcaaaatctgacactcctcaccctcagggttcagcaagattctcggaaaggccttttctgattctaggaggtgctgcagcaggagctgactcggccatttcctggcctctttagttggaagatgacagaaaggcggaagcagggactgctattgtgaggcccatggcagccttcctgtaaaacaaattggcaaattgtcaccttcagatggaccacagctggccctctgaacagccctccttggcctttccagagtaaaaaaga

SEQ ID NO: 232546 - DNA, 878 bp, Homo sapiens
ggagatacgatcttttcacccagtgttttgagcatgtctcaatctcaattgatcaaatctacaagaagctctgcagaaacaacagcgcccaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcctggtgcaccctttaagagaaaccttagtcgttctagccaaagaggctgtggctcactttagttgagtgttcagacctcattctagtagggaaagttttcagtgagagctggtgttaaatgagtttttaaaaaacaaacaaaaggtacaattttgtactataattctaacttctattttgaaataagctagtttggttggaaaaattttgaattcagcttcatcttcactctgatcttgccttacacccaagtaatcttgaagggaacttctcttggtttttaaacatactagttataagattgttaataaactgttgaacctggcttttgggaaattgtttcagagaaactatgttagtattgaaaatatcaataaaaaatgttctaatttcacaaaaaataaaaaaaatggccttgttggcctcaccggtggacttctgcggccctttcctttagggaggggtaattcatgatc

SEQ ID NO: 232547 - DNA, 826 bp, Homo sapiens
tgaagtggatgcagccctagacaatactaacataggcaaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcctggtgcaccctttaagagaaaccttagtcgttctagccaaagaggctgtggctcactttagttgagtgttcagacctcattctagtagggaaagttttcagtgagagctggtgttaaatgagtttttaaaaaacaaacaaaaggtacaattttgtactataattctaacttctattttgaaataagctagtttggttggaaaaattttgaattcagcttcatcttcactctgatcttgccttacacccaagtaatcttgaagggaacttctcttggtttttaaacatactagttataagattgttaataaactgttgaacctggcttttgggaaattgtttcagagaaactatgttagtattgaaaatatcaataaaaaatgttctaatttcacaaaaaataaaaaaaatggccttgttggcctcaccggtggacttctgcggccctttcctttagggaggggtaattcatgatc

SEQ ID NO: 232548 - DNA, 851 bp, Homo sapiens
tggccgtctcgacagtcacccagatgtaataaaggcaccacgcgagccaacgtttgagtggcacagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcctggtgcaccctttaagagaaaccttagtcgttctagccaaagaggctgtggctcactttagttgagtgttcagacctcattctagtagggaaagttttcagtgagagctggtgttaaatgagtttttaaaaaacaaacaaaaggtacaattttgtactataattctaacttctattttgaaataagctagtttggttggaaaaattttgaattcagcttcatcttcactctgatcttgccttacacccaagtaatcttgaagggaacttctcttggtttttaaacatactagttataagattgttaataaactgttgaacctggcttttgggaaattgtttcagagaaactatgttagtattgaaaatatcaataaaaaatgttctaatttcacaaaaaataaaaaaaatggccttgttggcctcaccggtggacttctgcggccctttcctttagggaggggtaattcatgatc

SEQ ID NO: 232549 - DNA, 419 bp, Homo sapiens
agtcctcagcccaggacttgaagttaggagatctttttttgccttggctctgccataaatacaccctgtaaccttggatgtgttgcaacatctgcaaggataggaatttgatcactgctaaggttccttcaaacttgatcagttcgctgttctgtcttttgaatgttaattcacattcatctcctatattaagactttggctaagtcttgtgatttcttgccttattggagcttttcttctaatctgaattcttgcttctctctccttttcctttacacacccacacaagtcctaacctctccaggaagtgttttgaaatgatgttacctgggtttgagttcttggcattagcctgtatcatctatttggtattattatactattatagctgtttaaaaaaatcttttattactgtttg

SEQ ID NO: 232550 - DNA, 658 bp, Homo sapiens
taatcccagctacttgggaggctgaggtgggagaatggcttgaacccaggagatggaggttgcagtgacctgagatcgtgccactgcactccagccttgctgactggggttttgctatgtcgcccaggctggtttcgaactcctaggctcaagcagtcctccctcctcggcctcccaaagggctgggattacaggcgtgggccaccgcacctggcctacagtatgcttcatagaaatatgaaaagaatgagagcaaggttgagatagaaagtaacagggcatccctcctgagtaaaacaatcctgccccctcacgctctcgtctaccctcccgtgggtctccctgcttctgtcgtctgccagaaactggctgagccaagtgcacttgcagacgccatctgttctccctgggagtggggccggtgccagcgccagcatctggactcttggcaaggagccctggagccctggagcgagggaactccggccccacaaaggccagggaatcctccagtctggtgagacggagggcttctgggaagggaggcctatacaaggctccatgaaggaggtggaagcttgcaagacgatgatagtcttgtaatcagtccgatggagatggatgtaaataataatattaataaaccccatcaaatgtg

SEQ ID NO: 232551 - DNA, 940 bp, Homo sapiens
taatcccagctacttgggaggctgaggtgggagaatggcttgaacccaggagatggaggttgcagtgacctgagatcgtgccactgcactccagccttgctgactggggttttgctatgtcgcccaggctggtttcgaactcctaggctcaagcagtcctccctcctcggcctcccaaagggctgggattacaggcgtgggccaccgcacctggcctacagtatgcttcatagaaatatgaaaagaatgagagcaaggttgagatagaaagtaacagggcatccctcctgagtaaaacaatcctgccccctcacgctctcgtctaccctcccgtgggtctccctgcttctgtcgtctgccagaaactggctgagccaagtgcacttgcagacgccatctgttctccctgggagtggggccggtgccagcgccagcatctggactcttggcaaggagccctggagccctggagcgagggaactccggccccacaaaggccagggaatcctccagtctggtgagacggagggcttctgggaagggaggcctatacaaggctccatgaaggaggtggaagcttgcaagacgatgatagtcttgtaatcagtccgatggagatggatgtaaataataatattaataaaccccatcaaatgtgttcagagtgctttctttgccaggctttggataaatgttggatatctgttctttttattttttatttttctatttcctaggcagcacctaaaccaaaataggttcagagaggctcccaatgttggacatttgttgttgcagcaactctaagtactctacatatgttatcacataagaggcaaggagcattatccccattttgtaggtgaagaaataggggttcagagaggtgaaggcattgtctagaggccacacactcagtgacttaaagagcctggaaagg

SEQ ID NO: 232552 - DNA, 533 bp, Homo sapiens
ctttcatcaatgttttgtagttttcattgtagagatcttttgcctacttggttaaaacttcctagggtttttgttttgttttttgtagcaattgtgaatgggattgctgttttctttttcagatagttcactattggcatatagaaatgctactgatttttgtatgttgcttttgtatcctgcaactttactgaatttattacttctagcagttttttggtggaatctttagggttttgtgtgtataaattcatgtcatctgcagacaggaagtttgacttctttctttccaatttagatgccctttgtttctttctcttgcataattactgtggctaggacttccagtactatgttgactagaagtagtgaaagtggctatccttgtcttgttccagattttagagaaaaagctttcaacgtgtcctcattcagtatgttagctgtgtgtctgtcatacatggtctttatttacaaactatgcatctgacaaggggttaatgtccagagtatataagaaactcaacaccaaa

SEQ ID NO: 232553 - DNA, 277 bp, Homo sapiens
cgtgatgttaacatgtatgtaagtaaaatgaatgacaacaataatataaaggtcagaaggggagaaatggaagtatcctgttgtaagtttcttatgctatacgcgaactggtataatatcatttgaaggtaggctataataagttaaagatgtgttctgttaatcctaagaaatatgaaaataacacaataacaaagagttacagcaaataacacaacaaaagagataaagttggatcataaaaataatcaatttgaaaaaagtcagggaaaaacag

SEQ ID NO: 232554 - DNA, 1175 bp, Homo sapiens
gagaggcatttcatgataaagggattaattcataaaaaagacaaaacattcctaaatgtgtatgtaccaatcacgaagtctcaaaatacatgaagcagaaactgatataactgaaaggacaaatagaaaatctataatgataggtagagatttcaatacttgtctctcagtaattaatagaacaagcaaacaaaacaaaataaaaccagtaataattggtaagaatggaactctcttccgttgctgataggagtgtaaaatggtacaatcgttttagaaaatggtttggtaacctctaataaagttaaacatatgctttcaacataacccagcaatcccaatcatagatatttaccccccaaaaaatgaaaacatatatccatatgaaaagctaatttctttattcataattgtgccaaatagaaacaacccaaatgtcatcaacaggtgagtagataagtaaattgtggtctatatatacaatggaatactattgagcaatgaaaaggagtgaacaaattagacatgtaacaacatgagcagatcaacctcagaaacatgctgaatgaaagccaggcaaataaagaggaattctgtatgaagctccagaaggcaggaatctaatctgtagtgacaaaaattagacctgtgatttcctaaggccaggggtaggggttggcgattatttgggaaagagcacgaaggagccttttggtaggatggatatgttttatatcatcactgtccaacactgcagaactttctgcaatggtagaaatgtcttccatttgcactgtctaatatgctgaataacagtcacatatggctactgaggatttgaaacatacctagtacaactgaggacgtttttcattttaattttagctcattagacttgaaatagccacatgtgtttagtggctactctactggacagcacggtatctatatcttgattgttgcagtaattgtgtgcatggataaatttgtcaaaacttattataaaatacactaaaaataggtgcattttattgtatataagccttacctgaataaagttgattttaaaaagaggcaaagcatttcccaactaactctaatgctccaatttttcaagtcaatattatcagcagttcacagaaacattggcggttccatagaaagagaacaaaccg

SEQ ID NO: 232555 - DNA, 218 bp, Homo sapiens
ccaagatcccaccactgtactccagcctgggcgacaaagcaagactccgtctcaaaaaaaaaaaacaagaaagaaagaaaaataaataaataaataaataaataaataagctgaataacagatgagtaacaaaatactctgcagaaaggaggacttgacattttcaccagtaactggagatgtaaaatttattaaaattcccatatttcattttataa

SEQ ID NO: 232556 - DNA, 442 bp, Homo sapiens
acatgcaacacagaactcattgtcgtcctctccccaaatgtgccctttccgaagcttggctaatgacaggttgcttgagccagaaacaaaggaatggtcttagacttcccttctgtccgcattcccccagttccatctcacacatgtctcctgagagcttctgccctctgcttctgtccgccgggctggtgctcagccagtgcacgctgcgtggccctcctgactgtagaagagcctctcttgttatggggagaggacttctctgtcttccgaggacttaggccgagcattactgcctgtgtgtacttccctgaccgctctgccctggcagaatttgatgctcaacaactgtggctctgagggcacagccccgattgctctggggtagagctttttcatcgttgctctaagtttcttaaatggggaagctctttaccaagtg

SEQ ID NO: 232557 - DNA, 143 bp, Homo sapiens
gaatgtggcatttaaaagtacctttttacagtgggaaagaattctgtcaagaataaacagtctgaccttgttaaatgggccaaagtctgtctgtaacctagttccagaaaactagcttttactagtttagaaaaagcagatta

SEQ ID NO: 232558 - DNA, 257 bp, Homo sapiens
taagcaagcacatatagaaaataaacaaaatatttctcgaaaggagagggaaaacagacacatagaagaaaatgataataatagctgccatttactgagtgtatactacacattgtgaactttctcggacctcttcagtatattagatatagttaatgggtgcagcacaccagcatggcacatgtatacgtatgtaactaacctgcacattgtgcacatgtaccctaaaacttgaagtataataaaataataatata

SEQ ID NO: 232559 - DNA, 509 bp, Homo sapiens
tccttgtttcggtatttttagatggagtttcattgctgagacacggtggattcaatcatcggccgttggtgattgagctcaacctgtagtgtttcttcccttcagggaggatggggctggggtgaaagttctaaccctctaatcaggggcacatgcttgttcgtctggtgatcagcccccttcctgaagccctccaaggccccctcacagtgcgtcaccacattagcctaaactcatgtatgttagagggggttctctgtgaataaccaaagtcactcctaccattcagaaaattcaaagcgcttaagagcgccatgccaggaaccagggacgaagaccaaatatatttctattgtgtcacaggagggccaggataaaggaaacagagattgtcgactagatttctgactcagagccctggtctaagtttggctggaggcagcaaataaagtttagagaatacctgagccagtgattgggggatgaaaacaaccatttggagcttaaaa

SEQ ID NO: 232560 - DNA, 98 bp, Homo sapiens
gcaattctagacccttgtgtcagaaagagcaaatcctctagccctttgatcttcacaatccttcaattatctttctggtttccttctgttgtcattta

SEQ ID NO: 232561 - DNA, 249 bp, Homo sapiens
gggcttgaactgagctttgaagaaagtgtagacttggggacaggcagaggaagagggggcatcataggcagcagaaaccacatggacaaactctctgccggagaatgggcatggccgggctgaggggtccctggacaggaaccagccttccctatgcacctgcacccgtgagtctcacaacagccccaacaggcaagtgttattttcctcaattctaccaattaaaaactgaccttgggcaactgctta

SEQ ID NO: 232562 - DNA, 383 bp, Homo sapiens
ggaaatgatacaaatattcatcaaaaaaagattggtcgactaaaccagaatacaatcatactatagaatatcggaatagaatgcagctctctaaacgttaggtagaattctatatctctgtatccaagaaatacccatgatgaattgttaaatgacgtgtaggagagagaaccacaggcctctgtggtccgtatgtgcacggtgagcgtgcaggaggctgcatgccaatgctgtcaatggggtggggatgaactgtggcaggatgagtcatttattgctgtttcctttatacatgttctttctttgacttattacaatgagcacgtactactttcgtcatttcataaaatccagtaacagcttctctgcaaagccctccaaat

SEQ ID NO: 232563 - DNA, 223 bp, Homo sapiens
cagttaaactaaataaaatgttgaagtaaagagatacacacagccctcaaaacattgtggcattataactccatcactgagatttgtagggtgctgagcagaatgtaagcactctgacataaggtctcaggcacaagtacacatctcttcagtagaagtgtgaaagcagacaaggactatatgtaaacaaacatggccatgttccaataaaatcatagacact

SEQ ID NO: 232564 - DNA, 319 bp, Homo sapiens
gtgaaaatagccacttattagttcctgcctcaactgatgacattccaccattgtgacttgttcctgccccaccctaactgatcaattgactttgtgacattccttctcctggacaatgaatctcaggagctccccaccagcaccttgtgacccccgcccctgcccgcaagagaacaccccctttcactgtaattttccacgacctgcccgaatcctataaaactgcctcaccccgatctccctttgctgactccttttacggactcagtctgcctgcatccaggtgattaaaagctttattgctcacacgaagcctgtt

SEQ ID NO: 232565 - DNA, 343 bp, Homo sapiens
ctttatcctccattcctgctgcttctccataacacttattactagctgaccttctatgtaatgtatctatcctttatctctagtcccacagaatgtaaactccagggcagcagagatttttgtttcgtttatgtacatctgtatattcagtagttaaaacagtacttgggacctagttgccactcaataaacatttgttgaataaattaaataataaactacattagttcttcaattaattttttaaaatatggtggttaatagtgagtaacattcaaaaaataagttgaaaatttatacctattgcctcttacccacaataaaaaagggtaaattcaaggaa

SEQ ID NO: 232566 - DNA, 437 bp, Homo sapiens
ctggtccctgagggcatcccagcttccaagcacagtgctttcgataggaatgttattgatgataagagaacccgctactcagaaaactgtcgtttgatatttgtgcctctcaactccagcctccttcagcctctgcatcagtcattctttgttttgttttgcttttctagaggcagaatctctcagtcaccaaggctggagtgcagtgacacaatcatagctcactgcagcctcaaactcctaggcccaggagaatcgcttggacccaggagacggaggttgcagcgagctgagatcgcgccatagaaacaccatggaactccaacctgggcaacaagagtgaaacttcgactcaaaaaaaaaagagaaaaaacacattaggtaacagtttctttttagcatttgtgtaacctttaataaaataaagtgataatcaa

SEQ ID NO: 232567 - DNA, 407 bp, Homo sapiens
ggaaactcctattgtgatcttaagggctgtaacccagagaatctggttcttcctggagtatttcagcagggatcagcttaaataggtctacttgaagttcacaactgccaaaaccgcgtgttcagactgaaaggctgggagcatttcagacgcatttatgaacttccaccaagatgatccggcaggctgaaatcgcagggagagcgtctgttcaacaaaccctttcttcttgattgaattagtgttacccactaacaggatgaggaattcccactccacaagctgactttttttcctctttccacctcccgcctccctccattaaaatgtaaacttgattcctgtgtcctttgccggagcctggcttccctgtaagcccatcataaacatcttggtagaaatgcaac

SEQ ID NO: 232568 - DNA, 397 bp, Homo sapiens
acagtttaagctgtttattccaattgaacgctgtgtgtttccatcagatcctcagtgagattcagtccaatgagtcaattgcaaaataaagtttttgtcaagggaatggcagaaaatgacaaaaccacaattctgaatgatcattcaaaagtaaaaagtactttctactactgtgtggagattttcttatctctacttttactcgaattgaatcttttcttctaatgttcttttgaacagtttgtctttggtgtcctgaaaatgtgcacgctgatagcagtaccacatgctgtccctggcacagagtgagctaacagttgaaccacctctgggtaactgcggactgcagctagtgtaagtgcaagagaaggcaccctggccaccaattcgtttcaca

SEQ ID NO: 232569 - DNA, 712 bp, Homo sapiens
gttatctatacttttggcaatttgttcaaacgttctgctggtatgtgagagggaaggaaaaattgtttattgaccacagatccacaatattatacttctcctatacttaagcaataagggacagcatttaaaactcttttaaaaatgttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccagg

SEQ ID NO: 232570 - DNA, 612 bp, Homo sapiens
atttatcttccacccacaccccagctgtcttcttgagcaggatttaaaggggctccaggatcgttctcttctgtgtgtcccacatttggtccatagggacactcaacacctattttgctctaataaactcaaagtgcagaccaatcctaccaaccgtgcagcctcttcactcgccaaagaggctcaccaatccctctctcctgatctgtaggtttccagggctggagtcagacaacaatcccctatgctcccaacttacaggttctctgagtggcccacatggagaggaaaaaatagtatgagaaatattacttttcaagactttccatgactaaaacaagaaaatactcctgttttagtcatggttctccagagaaatagaaccaatggattatatatctgtaactatgtctatatctgtatctataaaaggagacttattatgaggaattggctcccacaattatggaagctgagaagtcctaccatatgccatctgcaagatggaaacccaagaaagcggtgtaattcagtctgaatccaaaagcctgaaaactaaggaagctgctaaaaatcccaatccaagagcagaagacgagatgtccccatgct

SEQ ID NO: 232571 - DNA, 238 bp, Homo sapiens
atagaacatgcaagttcaagagacagaagcaaaacaggagttgacaaaaaatagtaacagctagacccggtgtgagagtgtttttatacaacagtgaatgagaaaatgattttcactatttcttgcctcttaacaaatagagctgtgtgtatatggcagaaccataacaatttcagctgttatacatttgcattttgaatatttagacattaaacatttaaatctcattcaaaagatt

SEQ ID NO: 232572 - DNA, 211 bp, Homo sapiens
tgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaa

SEQ ID NO: 232573 - DNA, 743 bp, Homo sapiens
gttcttcgggccatggtttatttgaatctcctccagacttgttagagtaactggacaaggggtcaatgcctacttcttgttcttctggctgcagaggatgtctagtttcagataaggaatgatacattgtgggaactggacagcgtcacctaaagtaactacctgcgcgctccctcccgtgaggggtggaaggcagacagcccattccagcacttgtgcactccagtttccacctcgtttgctcgcaggctccctccttaatagagaatctggatagtagcatttttgaaacaagcaacaacagaaaaaaaaaatcctctccttatgttgcatttattcaatttgtgggctcctgctgcaggtggtccctgagacaatatcatagaagatttaccaggttctcaggtcttttaatacatcaacatataatgggattctcttatgggaaacaaagtattcagtgctttccggatttatgtgaccatgggatctttacactccaagcatctcagattttctttcaggctttgagaatttttctcccattccaaacttttatcttgatactgatatcactgtggcgcagaagggctccccagctcctattccctgaatcctcctcctcctcccctcctctttctctctctctccctcagtctgcagggcgctcgcggaagcggccgggcccggcccgacctgaaagagaacagggcgggagggggtggcggcggtgaccagcggcc

SEQ ID NO: 232574 - DNA, 467 bp, Homo sapiens
cgccagggagctgaagggtccacccctcccgccatccacccccgacgccgactccgaggcgcacaaacggggggcggtgcggcaacccgtccgccgtggcggcggcaccctcaggccctcccgtgagaaggcggcggcggctgcggctgcagcagcggcgcgaaggggggcgaaacctgtcctgaggctgagtgggaggccggggcgggaacgactgcatgtggggctgcactggaggaaggcggaggcgttcagagggcttgggcttttttacgatcatcatcattattttattttacctgtggcgcagaagggctccccagctcctattccctgaatcctcctcctcctcccctcctctttctctctctctccctcagtctgcagggcgctcgcggaagcggccgggcccggcccgacctgaaagagaacagggcgggagggggtggcggcggtgaccagcggcc

SEQ ID NO: 232575 - DNA, 511 bp, Homo sapiens
ttctcattcacttggtagtcagagccacaggcacggaggctcaagccactccacaagcagttaatattgcaaaccatacataatagtatacttaatatagaaatgttataggttaaacattccacaaccaacaaagtgacatttaacatcaagagaaaaaagagataggagaaagagttaaggaaccagttcagaggcagcgaagaagacaaaaggcatcctggtctgggccaggcggtgggtgggtggtctgtgaggtcggtggtctgccatcctgcaaggaagtctttgaggtggcagagcctttggccacagaggctgagttatcatgagtgactgcaaaacagtgtcagttaaaacagccattttgagctcctgaaggcctaattttctttttcttttattattattttttaagacaagagttttgctctgtcacccgagattgctccattgcactccagttttccagcgttgggtgacagagcgagactccgtccccccaccccca

SEQ ID NO: 232576 - DNA, 516 bp, Homo sapiens
tgggaaagccccgccccaggcctgcctcagaacacaggaacatgctgccagtgttttcctttatcatttaaagtttgtttgtgtgctgggcaaggagacgcttgcaagcaggttcttgaactgggtgtaatgaaagctgtagggatcgcatggcgccctagacccactgccaaggccaaggggagagacaaaggcttaatggaagaaagtggctgcagctgctctccaaagctgtcattactttcttgctggaaactttgaaatattatttgtttcctgtttcgaacttctggagatataccatcccagtaccatgattaagggcaatagtgtcacagggaggtgggctggcctctgcgtttttcatgtgggcttttccatctttaatactatattgctttataaatgtctttttgtctgtagatatcttctgatccctgcccccgccactcccaactcctggcttctgatgtgaaatgagagacttaaagttgatcaagttcatgccgatgttta

SEQ ID NO: 232577 - DNA, 385 bp, Homo sapiens
gaattatatgggaggccaggagcagctcccaagaagaccctgcgtgcgccgctaatgtctgatttgggcagatcagcgagcaaatgcgacaacagcccacagggatgtgttacaaattagtgctttttcatcttatttaacaccaaagccagggaatgcgagaggaaagtggccaaggcctgtcttcccggcaacttggagcacaaaagggatcctgccccagccgtccgaggtcggggaggggaatgtgtcagcccccaggaatctcatccagcgcctgcctttcagaaagtgaaggatcatgaattagagcaaataaatcaagcgcacacaggcatgagagggtttcttttatacacaaataccttctggaccctacactttg

SEQ ID NO: 232578 - DNA, 223 bp, Homo sapiens
acccggcaaagttctgcttggccatcatagctttacaggtgtcaaccagccatgtgacctgcatgacctccatgtctacctgtgaagtctgggctacaggcgcaccctccagggacttccagaacccaaacccagtgatgtaagaggcaaaataatttcaagtctcctttcatctatttttataaagtagaaataaaatggccttttggtcaaccaatctgtc

SEQ ID NO: 232579 - DNA, 535 bp, Homo sapiens
atttatccaaagtcattgtgattttatgaaacattgtgattttaagtgctgaaccatgttgtttttcaatgtaaaatgagtgtaacttttagtaattattgaaatttaagcgttactgtgattttccataattctatttcggtagtcacaaaaaaacaaaaatttggcttcttattggcccttctagtgccaacactggcattgttgaaatacatttctaaggaagatggtgagtgtttcacttcattagtagctgcatgacaagccaccccaaagtttaatggcttaaaacaacagtaattcattatttctcataattttgagagttgactgagtgagtcttctgctttgtgtggtcttggctggggtgctaggaaagagggcagtccacagtggcctcacttacatagctggcagtggatgcaggctgctggcgtggagcacagttgggggtggcctgggtgcctcagctctccttaagtgtgcctctctgtgaagttagttgggcttgcttacaacatggtagctggattcc

SEQ ID NO: 232580 - DNA, 471 bp, Homo sapiens
ctactgcttctcaaaaggcaggagaatttctggaatttctatcaagtgtttgtataatttgccgtcactacaacctctgctaacatatgcttcgaagtacagttttcattaaaatgaatgcatttaaaatattctcaatattcgtgtaatttcattcaatccttgttaacaagcatactcccttattcattttgccaatcccttcacctccttgattcctttctagttgtcaatcaaaactgccacactgtagtagaatacagtaagtggacttaggaatttgatagctggaaatgctacacataagtccctgagaagtgactgactagagtgaccagctcaattagtgacagcgccatgaagactactctgggatatgagatttgattcagcactcatcgtagcacttacaacactgcatcataatttcctattaatctgtctcaataaactatccttgagatcacagac

SEQ ID NO: 232581 - DNA, 804 bp, Homo sapiens
ctgtacaaaaccaaatgtttgttactataacttctgcatcacaattaaaatccaaagagttatttaaaaacagtcaactcaatcaaaacccactacttcagaatccatattttctttgaagccacagtaacacttatatatggttaagactcgaatgcagaaatttggttgattggaaagctaattaaacttccaacttgctcaaatagaattacaaaaaggcaaaattgccaacagccctttttagagagtgctgagaagatagtatgggaactcttctccatcctgttctcccagctgtttggatctggctctgtatctgagttaggctgggtcaaacagactctgcctcctaagaatttagagtcagaacattgagagactgggtcactctgacagaagcattgaatttataaggacatgtgaatttcagatccaaggccaccatttaggggcagccattttggggccagtaatacaataagggacaagcagaactagttgatctcaagagaagctggtgaatgcagctaatgaagaaacagagagaattggaggcagtagaccatgtggtctcctagagaaagagagtcagtagctaccttgggtctgaccactttcaggacccttgtctaatctaacgtctggctgccactttttgttcttgatttccctgcacttcctctgagtcataataaatccatctcaacctaaggggattcatttttctccttagacaacagtgttatgtgcctaattatgttctccccttcttaatgttttttgtcctaataaaaccatgta

SEQ ID NO: 232582 - DNA, 748 bp, Homo sapiens
ctttctctttcagggttataagaaacgcacctgacttaaataacatgtattgtggatatataaatagactatatgttcaatattatcactgcacttataaacaaagaatgatatgtgagaagatggccaatccagtgcagcttggttctacatattttagggaggcatgaggcatcaatcaaatacattgaaggagtgtagggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaagttacgaga

SEQ ID NO: 232583 - DNA, 408 bp, Homo sapiens
tattgcttacttctagttgatctcaaagcccatatagctaaaagtcatgtagccaaacaatatacatctaatctgtcactagcttccttatagacaacgtctctggcatgtatgtcactatggtaatagttgcttaaagtttttgtttttgtttttgttttcaggaactaggtgttcttacccaagttaaactacttgaaagagaccaccaaccctctttctaccttgcccattgactcctgggccttattactatggagtaaggataataggagaatgagaaagcagatagaagaaggaaagaagagagttgcaggcccttcaactgggcctgcacaaatgcccaagaagtgactttctgataccagaaggccaaaaacctcaccttcacagcatgctaatgccacc

SEQ ID NO: 232584 - DNA, 398 bp, Homo sapiens
gaggccggcgtgtctggaatgagaacgagccgcgcacgcagtttgagggttccggggagccgcgtcctcccctttccaggcgacagccctaactacaggaattggccaaaattcagcatttccagactttccttgggaaaaggggccgaagaagtgccggcaacaagaagggccacaacggagcgcgccacagactcaccgcggctggggtcgggaccggcgcagccccctcccctcccgcccgtgcgcgccccgagccgggcgccccgacccggcctccacccgctcaggcgctcagggtcaggccgggccgggctgcggcgcccccatccccgcccgggcagcgaggccgggccaagcggggcgctccgggcctcgggcctacacgcggcggccgc

SEQ ID NO: 232585 - DNA, 375 bp, Homo sapiens
tattaactctttaaagctatcggctcttttaattggagatgttgaggtttcctcatttaacaaataggcagttgttggtggttttttcctatgacttacagtggtttcactgttttgacactttaaaaacggaagaacctaaaattcagactagagtgtactagtttgtggtcctgctactttgtagcattagaagcttgccaagtttgattgcttctttgaattagtttcttcatctgaagaggaagggtcagaactatcattaaggttaacctctaattgccagtgattgtatttggctcttaagaacaaatgcttttggtacacaaatgcatagcacataaagtaacatgacgaaaccccatctctaccaaa

SEQ ID NO: 232586 - DNA, 493 bp, Homo sapiens
tgcagactgccaacttctagctgcattttcatgtggcaaaaggagattgagctagctctctggtctcttcttataaggacactaatcccattcatgaaggcttcaccttcatcatctaattactctccaaagaccccacctccaaatactatcacattgggaattagatttcaaatacaaattttgcggggacacaaatattcagtccataatagtaatgattactcattatacatagggctctaaatgtgctagcttctgatagtttttacactcacttctctttattagcttgtcaagcataattagggcagtggccttactgaaaattattgaatttagtttcctaaggacagatattgaggagttttttcttcactaaaaattcacgttccgatacagctttcatctgttactactttgtgagatggaaaatcttttattttatttttatgtttggattgacccttcttaataaagtcggcatgtaata

SEQ ID NO: 232587 - DNA, 406 bp, Homo sapiens
cagcatatggaaggaatttctctggcatggttcagctttgagtctagcaggaatatactagtttaaaaattccagaacttcctcagaacgaactgttaagtgatcagttaaaaaaaaaaaaaagttggttgggtgcagtggctcacacctgtaatcccagcacttcgggaggttgaggcgggcagatcacttgaggtcagaggttcgagaccagcctggccaatatggtgaaaccccgtctcaactaaaaatacaaaaattagccaggcatggtgcaggtgcctgtaatcccagctactcgggaggctgaggcaggataatcgcttgacccaggaggcagaggttgcagtgagccaagatgtgccactgcactccaccctgggcaacagagtgagactctgtctca

SEQ ID NO: 232588 - DNA, 342 bp, Homo sapiens
gtaataatccctgcaaataaaatctctctttactgtgtccaaatttgttttttatttgacactacacactggaaacaaacacaatatttctcaataaggacaatacaatgaggtttactccagcttaaagagtttaatgttttctaacttgttcaacagataaaacatttacttggcaatgtggcaccaaaaaatacgtggcttcaaatgctacaatcacagagcaaaatgttcacatcatgtgagccctgagagtaactgagattgaagttacagcaatgacctatcctctatcccaacctcatgccaaaatatatgccccttgagtagagtggctggtta

SEQ ID NO: 232589 - DNA, 147 bp, Homo sapiens
agtgagttgcataatatgactagaatgtaaactctctttgaggccagggactttgttttattccctgctataacccccgtgcctggcacacagtaggccttcaaaaatgggattaaaagaataaactttggcaaatgacttcacatt

SEQ ID NO: 232590 - DNA, 564 bp, Homo sapiens
gctcttagctcatatttgtcctatcacattcttcaacaactttgcactcttcctcaaacctggtataaaaacgttcaggtttaactgtttatttgggttttcatttccttatgaaggtttctttgtcacataaaacttatattaaataaattcataagtttttctcttgttaatctgtcttttgttagagacccaatcaaggaccaaaaagagtagaaggaaaaagatatttttcctctcctacaaaccaaagtcacagtaaaaaactgtaacaaaaatctatttcatgtcgtctgtatctttctgtactaactaaaatcactggttcctactgcctggagtcaactttctaaaaagctttagagaaatcacttgggatcccagaggcttcctaatctgtgctctgttgtaacctatttacaagaaggtcttgtttcaacatctctcactatacaattaagccagcattccaagtccataataatacctttgagcaatggctttgatataatgggtcttttaaatgaattataataaaattgttctttttaaaattttaatttg

SEQ ID NO: 232591 - DNA, 441 bp, Homo sapiens
caggaagaggcgcctcataggaaccacatttttcaggaccttggccttagacttcttgccagcacatctttaagaaaattaatttttatttaagccaccaagcttgtggtattttgttatggcaggtggagaagactgagaaagtccctcactttgattcctgtccctcacgcaggtatggctcctaacaactggggccttcctaggctgcagggatggggatgcctttagggcagttatccagagctgaattaccctatagaatgtcccagtctcctgagctgccttcagttgttttcactaatttgccataaattcagtcaagaataataaataaagtttaaatttttttctagcatttctggtgttcagtggccagacagatttctctgtacagaaatggcatgttatacaagtacatggtgattttatcatattctc

SEQ ID NO: 232592 - DNA, 527 bp, Homo sapiens
cgtgtcacttggataacttccaccacaaacacatctggtgaaggggctgcgccatcgcgggtcgcccccagattagaaatcaatcacagtcaatcttgcagtgagtctttagccaggagtaagctctggcctcaaagtaacccgcctgctggggaaggaattctggagatgcctggttcgtcccaggatctggcccccaaagcttctaggaaatagatgaccagacaggtgagcatggtgtgcactcagcaagcatccagataaacaaatgtgcacagggcccgggagctgcaggtgggagagggaaggcagtaggctcacagcttgctcccaggctggatttcaagatgaaaggaagcacatctgtagtttgctcaaagccatgtcttgagactggggagaaaggaggaaagaaaggccgtgttaaaacacagttcgaagctgagctgctcggtgacataacgaggcctgtgcgaccacccaggaggaggtttttcaggcttctctggggtggacatggccaagcg

SEQ ID NO: 232593 - DNA, 518 bp, Homo sapiens
catggaagactatttttccacgaatggggaccaggggatgctttggggatgaaattgttccacctcagatcatcaggcattagttagattctcataaggagcgtacaactagatctctcacatgcacagttcacaatagggttcttgctcctatgagaatgtaatgccactgctgatctgagaggaggcagagctcaggcaataatgctcacctcctgctatgaggaccagtttctgttaacaggccgtggaccaatagtggtccatggctgggggggttgagggcccctgctgtagaacacatagatagtaggctgcactctgaagattctactccaatacacatggagtatagcctgggaatcgtttgttgttgttttatataaggtcagtgggacatttagcgatccaggaggagtactttagattactctggtagtctattatagactctagtagtctatatattggagcactaaataattaatctagaagaagcaaagggacatgtcaggatt

SEQ ID NO: 232594 - DNA, 161 bp, Homo sapiens
gctctcaaattcctcccatgggctaaatatacttatgtatggaaaagaccatagcaagaattctgactaatggaccactcacagaaatcttctgtcctactcctacagaaagttcttccacttttttcctctactttaactcttatcctctgggcatgtgt

SEQ ID NO: 232595 - DNA, 405 bp, Homo sapiens
agacatggaaagtgggggcatgggtaaggaaggaggaggtgagagaaggtgggggtgggagaatcaggcatggcagagtggtggaacccaatggaggggtggagatgcggaaaggggaaggataaggagggagacaaagacattaagattagtgataggtagaggagactaagtctccagcatacctcagaggagctgcatcccttccccactaatttaggaatgggaatactgagtctctggtcctccagtagagaatgagtcagccagtgcaggggctcacacctgtaatcccaacactttgggaggctgaggcgggtagatcacctgaggccaggagttcgagaccagcctggccaacatggtgaaaccccatctctactaaaaatacaaaagttagccagg

SEQ ID NO: 232596 - DNA, 122 bp, Homo sapiens
aggaatccaaagaggattaacgaattttcacagttctggatttcacttttactgaaaacaaatatttgtaagtgctggggatatattttagaataaagtatgtagatatagattcatataca

SEQ ID NO: 232597 - DNA, 403 bp, Homo sapiens
aagtatatgatggatatgtccatactaaagactcattaaagtccatactaaagtatatgatggatgtggggaaggaagggcagcaatggaaaattgactcgccttttgaagaagagctgcctccctaccttattcctcctgcaaaatagactccaaatgaatttaaaaattttcaacattaaaaagactccataaaattagtagaagaaaacattaataaatatgttctgtatagccttgggtctttctaacttcttattaaaaattacataaattataaagtctgtacagactttaaacttctgtatagtataaacaaaacaaaacaaaaatcagtaacaactcagaaacaaggatgaagaaaaaacagaaaaatttcaactattttactgaaaaaaataaa

SEQ ID NO: 232598 - DNA, 536 bp, Homo sapiens
caaattaggaaggaaaagacaagatatgtaaattatgatgcaagttagaataatagcaaaataattatggatatatttttcaaatatgaagatcatagtatatttgacagcattttgcatagtatttttatacaacattatgtatattatattgtataatgtgatgtagagcatttcctctactgctgtatctcatgaattaaaatatagatttttagaactttagacgaatttgtcatacattcacttacatttttatcacttgttcctgttaggcagttgtcatgttctattattaaatggaatataattttattactattgctattattattttatagtcagggcctctctctgtcatccaggctggagtgaagtggtgcaatcatagctcactgcagcctctaagtcctgggctcaagcagtcttcttgcctcagctactcgggtagctgaggcaggagaatagcttgaacccgggaggcagaggttgcagtgagcggagatcgcgccattgcaaattagcttgggtgccag

SEQ ID NO: 232599 - DNA, 225 bp, Homo sapiens
ctgggaagtaatcatagtttaatgagagcccggaaaacagtaaatggcctgaaagactttcgttgttaccataattttagtatagcttattaaataacaataccagtggtatagcttgggagtgtgaaacttgattacaacttaacgattgtgaagtttaggttattaaggtgatttttggatgtgactttatgtgaaacacccttttcttcggagagtagggga

SEQ ID NO: 232600 - DNA, 1028 bp, Homo sapiens
aatatcagctcggtaccgattacgctcctagacgggaatgaacacctgggccatgccatcctgaaatgaatgaacacattggccatgctgtcctgaggtggatgaacacctggtccatgccatcctgagatgaatgaacacatcagccatgccgtcccgagatgaatgaacacatcggccatgctgtcctgagatgaatgaacacctgggccttgccgtcctgagatggatggacacctggtccatgccgtcatgagatgaataaacacatcagccaagctatcctgagatgaatgaacacatcagccatgctgtcctgagatgagtgaacacctgggccatgccgttctgagatgaatgaacacatcggccatgctgtcttgagatgaatgaacacatcagccatgccgttctgagatgaatgaacacatcggccacgccgtcttgagatgaatgaacacatcggccatgccatcctgagatgaatgaacacattggccatgctgtcttgagatgaatgaacacctgggccatgctgtcttgagatgaatgaacacctgggccatgctgtcctgagacgaatgaacacctgggccatgctgtcttgagatgaatgaacacatcagccatgctctcctgagagggatgaacacctgggccttgccgtcctgagatgaatgaacacattgaccatgctgtcctgagatgattgtcctggttatgcagacatttctttatattatttgcttaactttaatgccctcctaggaagatttcccatactttcctcccttcaatcaaaatatcccaagttcaacaggtctggctcactcctctctattcatctaaggtctactttgttcaggaatttctgtctaggactcaggcaggaccaaggaaatcttttcagtgacattttaaatatcactgtttatggaatgtgtatagataactgaataaccaaataagtgttgttttgaaagtatctttattaaaagaatataaagaacagaaactctaggcttata

SEQ ID NO: 232601 - DNA, 504 bp, Homo sapiens
ttctcatctctttatctataggtaagcttgcttaaaagaactttgggtggcctggtaacttcaggacgcttcgccaattaccagaggaagtaaggcttgcccaaaaccgagcaaaccagaaccagtggcccctgtcacctttagatcattagcatatcattataatgctaaagtccccactcatagaagagaatcatagaagagaatcgttgccactttctgcacacgtgtcgtatgaagagcctgttcatgatctgcacctgcgtgtctgaagttcctccccacataagcttacatagctcctgccccacatctaaccctgttacattccccagctccccaccgctctggaagaagctgtctttagagcaagtgctctctccttctccatgcctggccgggaataaaacctgcttttccttttccccaatctggtgatctttctttgtagctgatgcagagtagagaaagaactcagtgaactggtgacgaagccaattccag

SEQ ID NO: 232602 - DNA, 710 bp, Homo sapiens
ccacagtcaccatatggagagaagcctggtcgctcatccctgtgagcactcgaacccccactcctcaacaagcagagccagtagaacaactgtctcacctcctggctgaattttcccagtagcagtggctctacatttttctgaggtagagctcctgaagtcaaccaaaaggccctctgctactgccactgcagtggtagtgaccttgctgtccttgaattggagaagcagcgaagaccctgagtgctttaaccacacctccagcaagctgctcttgcactagggagaagaggccagtctgtctccctgttacctgtccctgacaccctctcatcaccaggcgggccttcctagcttgagcccaaagcacaggtgccccatccagggccaattgcactgattaataatgggtccacatctctctgggttggaaccccaagaggcaagtgaaaggctctctgccataaccactgctaagatcccttccccttctgcccaagagtcccaagccaagatttgcagtcagcactcaagtgggagaggaacccatactttcaaagcactgagaagaagcatggctgcaatcatgaggaaataaagaggagccacactgttgattaagtggctgcctacaggccactatgtgtaagtgccacctactggatcacagcccaaaattcaataccaaaaatactttactaatatttgaa

SEQ ID NO: 232603 - DNA, 619 bp, Homo sapiens
ccacagtcaccatatggagagaagcctggtcgctcatccctgtgagcactcgaacccccactcctcaacaagcagagccagtagaacaactgtctcacctcctggctgaattttcccagtagcagtggctctacatttttctgaggtagagctcctgaagtcaaccaaaaggccctctgctactgccactgcagtggtagtgaccttgctgtccttgaattggagaagcagcgaagaccctgagtgctttaaccacacctccagcaagctgctcttgcactagggagaagaggccagtctgtctccctgttacctgtccctgacaccctctcatcaccaggcgggccttcctagcttgagcccaaagcacaggtgccccatccagggccaattgcactgattaataatggacacacatactatatgaatacacacaccaaagaaacaatcacatagtactaaaaaagaatagaaaacgaaagaatcatagagagaccggcataaacacaataagagaagaaataacaaaaaacaaggaacgagtaaaacaacaacagaaaactctcacaaaaggaattggaagaagaaacagtgtcatgaggaaataaagaggagccac

SEQ ID NO: 232604 - DNA, 361 bp, Homo sapiens
gtggtgcattcatgctcctctaggggggaagcggggtcggaggggagtgctcagagccaccttagcgcaaagtgctaacttttgaattgaggcagtgccaggggacgcagtatccgcatcgcatctacattttacctcgctgtgaaatgagaacgcaaagacgatttaggttttattgtttccgacttatatttttccgaggtctttgatttacgggaaattgttacgtactaaatctcatatagcaagagatttagaggaagctacagaatctaggctaatgtatctaatagcatttcctgcttttgctctttttctttgcctttttcccctactctaagaagttcatattcctggcctg

SEQ ID NO: 232605 - DNA, 144 bp, Homo sapiens
gaaaatgcgggactaaaatattaatatacatgaagaaaattaggcaaatgaaaaccgaggtaattactaattccaggaaaaaaaaaggataagaaaatacaactacagacaccattaaatgggaaaataaacactgatttggtc

SEQ ID NO: 232606 - DNA, 173 bp, Homo sapiens
tagttacttgtataatcagaaaaatcacattaatgaatatacaccttcatctttgaatgggtgtgactagtggacacttaagccccccaaagtcatattttctcgttttgtaatccactttacacatggagattaatcacaaagtgttcctcttaacaacaaggaccttggga

SEQ ID NO: 232607 - DNA, 387 bp, Homo sapiens
gcatcgcccacgcccgaaacgcagccgctgggggccgagaaattatccccacctggcccgagggccagggacgcaggagcgcagcagcgtggaggggctccgcgctggcccggcgctgcccgcggtcctgccctcgttccaagggcacggcgccggtacgaggacaccgacgctgtggcgcaactgccgtcccccgcagcaatcccggagcccggctcccggccgcccctcggccctgcgcaggctgcctctccccgacgcggagtcccaccccgctacccgccgcccagacgacctcataaacaagtcctcgaagtgcggaggcaggaggcggggcgcagcgcgggggcaggaggcgggccagggtcagggcagaggctgcggccg

SEQ ID NO: 232608 - DNA, 967 bp, Homo sapiens
gattaaggtctttatacatattctacagaagaaaataaactttatgtggattaggaagaaaggaaaggactggtagttgatgtggaatcctgaaatcattgtgaaaactcttttttcctttaattattggtcatataaataataagccttagggcaaaattgggttaaagtgacacaagaactgtttgggattctgttagagatgccagaagttgttccagcagttctgtttggacaggaaaaatggaaacagaatggaccattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcatggctgaaattactttttttttaaaagagtttcaatacttttgtcacaggactttgaataaagaaaaatatttcttggtttccactggacaaaagccagtaagaagctggggaaatagatgtgatgcctgccaactccacatgggagaaaaagatgggtagatggttgggtcgatgcagatgagatgggcactttggaaatcttttctcagtgatgagaaatggtgttcatttaggggagctgagacattgagttctgctcagaaacctgctcttgaatttccgcagtatctctcctgtcctggcaacgtgaatattactgggatgaagcctaaatctatgattacaaaacaaacaaacctagttttatcctgacagaagtaatgccagaattattgtaacacttttcacactggttattccctaaactgagtccataaactatgtaaatagatt

SEQ ID NO: 232609 - DNA, 493 bp, Homo sapiens
cgcatgtgccgctccatagatgccagctttgggtttgaaatggaaatgtttgagtttctaaacatctgtcaagcacatggctttcctaaaattctgggagttctcacccacctcgactccttcaagcataacaagcaactgaagaagacaaagaagtgattaaaacacaggttctggacagaagtttaccaggttgccaaactgttctacctttctggaatggtgcatggagaatatcaaaaccaagaaatccacaatctgggccattttattacagttatgaagtttaggcctctcatggcaaacttttcacccttatatcctggcagacagttaaaaggatggaagatttgacaaacccggaggatatccaaacaaacatcaaatgtgacctgcaggtgtcactttatggttatttaagaggagcggcacatgcgggggatcctcagagtcggagtgcatccataagcatccctattaataagctgatccc

SEQ ID NO: 232610 - DNA, 702 bp, Homo sapiens
  misc_feature (622)..(622): n is a, c, g, or t
  misc_feature (644)..(644): n is a, c, g, or t
  misc_feature (656)..(656): n is a, c, g, or t
  misc_feature (676)..(676): n is a, c, g, or t
cgcatgtgccgctccatagatgccagctttgggtttgaaatggaaatgtttgagtttctaaacatctgtcaagcacatggctttcctaaaattctgggagttctcacccacctcgactccttcaagcataacaagcaactgaagaagacaaagaagtgattaaaacacaggttctggacagaagtttaccaggttgccaaactgttctacctttctggaatggtgcatggagaatatcaaaaccaagaaatccacaatctgggccattttattacagttatgaagtttaggcctctcatggcaaacttttcacccttatatcctggcagacagttaaaaggatggaagatttgacaaacccggaggatatccaaacaaacatcaaatgtgacctgcaggtgtcactttatggttatttaagaggagcacacttgaaaaataaaagccaaattcacatgccaggacaaggtggggctcacccatgagctggtccagagtctcatctccacctactccaccattgatgccaagatggcttcaagtcgagtgatgctgctttccaattccaaaccacttgggtcagaggctatagataatcaaggctgagctgaaaggcagagcntaggaaaattcttatgctctgntataagcgtacncctagaggattgcccaggcngcaagggtttactagtaaggaactag

SEQ ID NO: 232611 - DNA, 812 bp, Homo sapiens
cgcatgtgccgctccatagatgccagctttgggtttgaaatggaaatgtttgagtttctaaacatctgtcaagcacatggctttcctaaaattctgggagttctcacccacctcgactccttcaagcataacaagcaactgaagaagacaaagaagtgattaaaacacaggttctggacagaagtttaccaggttgccaaactgttctacctttctggaatggtgcatggagaatatcaaaaccaagaaatccacaatctgggccattttattacagttatgaagtttaggcctctcatggcaaacttttcacccttatatcctggcagacagttaaaaggatggaagatttgacaaacccggaggatatccaaacaaacatcaaatgtgacctgcaggtgtcactttatggttatttaagaggagcacacttgaaaaataaaagccaaattcacatgccaggacaaggtggggctcacccatgagctggtccagagtctcatctccacctactccaccattgatgccaagatggcttcaagtcgagtgatgctgctttccaattccaaaccacttgggtcagaggctatagataatcaaggagatggctttggattccctgttctgtgtgctcctgtctggctcctgaacccagctggagaggtgtgtcaatcccaactggtgaagtactgagaggaagctacacaaaaggcagcaaggtgttaataagtgtacctctgacattttaaccacctctgacttttccatggaatggacaagtagtagtctctgtcagagcaatgttttaaagg

SEQ ID NO: 232612 - DNA, 433 bp, Homo sapiens
gaaaaataaaagccaaattcacatgccaggtattctcttgctgtagaacatacgagaattgcacataggattcttgggatggcttcatttctcaggaaaagtgaaaaatgaccaaacaagggaagatggccttgctggaggttttaaaagtaagccagctatgtgtaggcctgcaaaggtgttaccgaatccctcttctctgacctcttgtagctagagggtcactgttccagtgtggcacaatgcccttctttagggtcatgggttaagcccttggactgtggatcgtttttaaccccccagtcaacagtagatacttactgacttcttgtcagttgaagctggctttttgggtcctgtcttccaggggtagaacattttgccatgagtgacatcagtttcctcccagacccttgtgttcttcctgaataac

SEQ ID NO: 232613 - DNA, 739 bp, Homo sapiens
ttttttttaaatcaagagacagggtgttactctgtcatgcaggctggaatgcagtcacatgatcattgcacactgcagccttgaactcttggggtgcaaaggattctccaaccttggttcccaagtagctggcactacaggggcacatcaccatatatggctaattctttttattttttgtagagatggggtctcattgcccaggctggtcccaaactcctatcctcaagctatccaccccccatcagcctcccaaagtgttgggattacaggggtgagctaccatgcttggtccaaattttttgtttatacaagggaaaatctccagtaaaatatgtataggtgccaataccataactgttcaaacacccttatgactaaataggcacaaaatttcatctttttaatgactgccacctgaagttcagaaacatcctagggaaaaaaggataaacaacttcatcaataaagaggctactattatttcactactgtctgggagatccatcgtgggcttacaggaatccaaatggatactgccgttacgtgtagaagtgtttatcctccagcccttccaccctaccttccccaagaaaaggaactcaagggggccatggaaagggaaggagtcttcccaaaaagaccagactgtttttcctcctctgtcatagtccctatagagtcaggcagcttaggggttgcagggggtgggtagcataagtgtgatgtactaccgagg

SEQ ID NO: 232614 - DNA, 712 bp, Homo sapiens
cctggactcaagcaatccacccacatcaccctcccaaagtgctaagattacacacatgagccaccacacccggcatatacatgccttttgttgggtaaagagagagctggtactggaaaaggtaaaagagaaaagaatatttaatgattttctgataactcttattgtaaacttaacagtaattaaggaaatcatcaagaaaaattttgataaaatgacctagatgaaaaagatttatttctttagaaacttaaaagtgactgggcatcgtggcttacacctgtaatcctagcactttgggagaccagggcaggggagtatttgagtctgggggttcaagaccaacctggacaacatagcaaaaccttgtgtctgtatttaaagagaagaaggggaaaaaaaaaaccttaaaaacatttaattgagtcaatataaactgaagataatatttgtagcaaatataattaattaatctggtaaatatataaagagtactacttaatgacttttaaaacagaccccacctgacctgtactgctatacaaagaaataactgaatacaagggaaaaatttggtgtaaggggtttgttatattttaattaatgtttaacatgataccaggttatatacacattgttttcacaggtaagataacttttaagaatgtgaatggcatgggaaaaaaggaattgaaggaaataatattaaaac

SEQ ID NO: 232615 - DNA, 390 bp, Homo sapiens
tgtagcaggcccctctgtcttcagccagcctggacagggctctggccacaggcattccctccgttgttgcagctggcatgcctcttctctgctccttttggttgcggggaccaggtggcatctgcttctttctgtctcatgacacctggcctccccgccactaattccttcctactgttttgagcgacaccctatgcttcttccccactgaggatatagaaaaaaacaaagtgtgattttcctaccacactctcgtaacatagaatccttctgtgacctcgtaaccaaaatgtgtgggaattgcttcccaccagcaaccaagctagtagttctgcagtggacactagataggcaccgtccaattccattcaattctggcattccccacct

SEQ ID NO: 232616 - DNA, 432 bp, Homo sapiens
ggaagcaaggaagcctgctccgcccctccaagccttaggtgttagatggacaggctctgcccgtggggaggaggccggccccagcgcctgtctcattctgaggctgtgttcaccccattctctaacagccacattcctctttcaccttctttctcaagtggttcagaatgtagggaatggaagagatgctcatctccaggtgctgccaaccccagcaaaaagatgaagtgatagaatgaaaggcaaaggaagatacccacagcattccgcagggaaaagagcataacccaagaataccacaccagccaggcggtcacaggggtacaaagccaccctttcctagcatgaaagggctcagcaactaaagcacccacaagctcttcttgaaagtcatgttcagcgacaaaatcctgccaatcaagagatgattca

SEQ ID NO: 232617 - DNA, 449 bp, Homo sapiens
tttcatgtgcttattgaccatgtatatatcttctttggagaaacacctcttcaaatcttttatccctttttcaattaggttatcttctgatggggttgtggatgttccttttgtattcttgataaaagtcttttgtcagatatatgatttgcgaatattttctccagttccagggagtatcttttcactttctttatggtgttgtttgaaacacaaaagttttaaaatttttaatttatgtatttacttacttataaattgtgactaaatgtacacaatatgaaatttaccactttaactattttaaagcatatagttcaacggcattaagtacattcacattgctgtgcaatcacccatctccagaaattttatcatcttccaaaatttaaacttatatacccattaaataacttcttaatttccactcttgccagtccctggcaact

SEQ ID NO: 232618 - DNA, 163 bp, Homo sapiens
cttgatgaatagccgttaagcaaataaacgaatttgaaggcaaatttgtggaatcccagccagtgcctctgcctccaccctgcagaggccacccttctaaggttcagagggctcagcagcatctgcttagagtagagctggcaagaagggggaggtgttgtcg

SEQ ID NO: 232619 - DNA, 93 bp, Homo sapiens
cttaaaggaacaatatgctatgatctttcacactttccaccaacttctcttctccaggcttttcctacttatcctgtaaaacttaatttacag

SEQ ID NO: 232620 - DNA, 387 bp, Homo sapiens
atagtaacaaatgccatccaaagcaaattgaacaggatatttttaagctttcaaattctactaaggtttgactttttcccccaaaataggaagggtagaatatcagaagtttatgctaatcctcagatcccagctaaatacctttccttgctgaaaggcagaattctgtaacgagaacacacattagctcagggctcctttcagtcctggttttgatagtttgtaagtccctctgccctgaaatgagacaccattctttatttaatgtcccatttcagtttccagaatgaaataccagtggaaagggaagaccagctttagcacaataactcctccttaattaccagtcttatctctccactgcaaggtcatcattttctgtgtggt

SEQ ID NO: 232621 - DNA, 369 bp, Homo sapiens
gtctggctcttttttctaatctttgatcacattctctgtttgtctatgctcatctcccttccaccttcttcttcatttctgccttttcagctcattaattgactttttgtagccattaaagagagacatgtgaatctcctggaagaaattaagctgtctgctgggggcatggaggatgagttggcaggtctcccatgctaattgatttcatcttgattcagtgagtctcccaagccaggtgacaactcagcagtgcccagaagttccaggcctagaaagaaagcaaatacttgaagctgcctcttgctaaggatgagtcacagggggctctgccatagggacctcataggccttggattgtccatgagc

SEQ ID NO: 232622 - DNA, 1356 bp, Homo sapiens
  misc_feature (955)..(955): n is a, c, g, or t
tttccttgctggatcctgcttgcaggaagcattataatctatctgcatccatcacccaagtaatgtgactctctttctaccaggttgctgcttacagaaagaattgttacctatcactgggccagcacctagctgttgtgatgcttctttttctacctacattcagctcacaatgtagattttgacatactgctgggctaaacaccaaaaatgaagttacgtttttcctcagcactttcctcatcaggcattgtgacatattgtttggcccagaactaaggtaatgtgagcctcctgcctgaaccctgcccatagtgggcatagtgacatatttgtgaacccatcatccatataatgtgactttcttacttggcttttccctataggagagattgtgacatatatttgagcccagaaaccaaataatttgacccttctttcctgctatggccatgctcccataaaagagagtgacttattgctgcgattagcacacaggctatgtgattcttctgcctggttcctctccacaggagttactttgacatatctctgggcccattacttagatgatgtgactcctcttattcctgggatgtgttcacagtttggactgtaacatatcgcttagtcaagcacttatgtgatgtgactcttctctcatgttttggccttgtccactggggtgcttgtgatatgtagctgggcccagctcttaggttatgtgatctcttttttttttttttttttttgggccggatctcggaaactttggtttggggatttttttggcggggcccacccctgggttttttgggtccccggaaaggggcccggtcacgaaggcggtttttttgactcttctccttttgtttctccatccccttaattggtggtggactctcctttttggactagaccctgtcacaagcggttattggtggaattttctggnacccagcccctaggtgatgttgactctccttttcggcgggtcccccataatgggggttcggggctctttgggtgagaccccctcgggggggggacgtccttttttgaccttaacccaaggagtctgggggaattttcccggctcccgtgacctaaactctgcgactcggcggtcccgggcggccccgtctaacgaaaaagttccgtcacaaaaacgaaacagcacaacaacaaagggggggccatagaactccgagggccattcgccacccctttggaaagggcccaagggggcttaaacagcacgggcagctaacgcggaacagtccggttgtagaccgctggtgtatggaccaccagtacggataatgtagtaacgtgccagtgtactctaagactgct

SEQ ID NO: 232623 - DNA, 343 bp, Homo sapiens
ctctgcctcctgggttcatgccattctcctgcctcagcctcccgagtagctgggactacaggcacctgccaccacgcctgacttattttttgtatttttagtagagacggggtttcgctgtgctagccaggatggtgtcgatctcctgaccttgtgatctgcccgcctcggcctcccaaagtgctgggattacaggcgtgagccaccgcgcctggccaaatgccactttgaatgtcaaaatatgactgttcttcagatgaaaaaatagcctttttagacaccaggcaccaaaataactttcagaaaaagtagtgttcttctagagttctcatagatagaaaag

SEQ ID NO: 232624 - DNA, 423 bp, Homo sapiens
gtatagttgtaatatctgagttttctgaaataaagaaaatagttaatatgtaggatgtttaaaactatgtaaaaacaaacttatgaacatcgttcatttagtgtatgataatcaagtcctagatattgaaatcacaatgaggtatgtaagtgtatataaatatctgtaacactgatttaagaaaagttggtgtgggttgactgttatagcagcaaacagaaatttctttcaaattatgccaattttagtaatttaaagtattgggggcctttaccagggctaaactattaatttcagagatgaaatatctgtagtctctctgatttaagctaattctagcagtttttcatggaacacctagctattcaaaattttcctgctgtttttaatcttaacaattaaaaagcaaattaaacatgcatc

SEQ ID NO: 232625 - DNA, 550 bp, Homo sapiens
gggttaattcccttcttcaagagcctaatttttatttaagtgcaatttggtggaaggttatcagcctacacactggagcattatcagaaagaagtctattgcatttgctttggagatgttactaaacattcgtttctttgtatggtcatgtcactcgtatgatcaattataaggtaaatttttctctggtcattttaccaagtaaagttatatttcccttgagaaaaacgtgcttttttttttttgttatagacactatgaatcatacacaaatcagttttcactcttttgttttgaattttaatgaatatagaggtggctttgcattatgtttttatcatacatatagaatgttctggcattcatcttgcatactaacttcactgctgatttattatattttctgaccttcattttcctttctccatgctttcttcaattacaaattcttataatggctatatttcttcaaataaaagaaattattttgttttggaatgaggcaaggttagaagcaaacatataaataaatgcgactttgaacaattaa

SEQ ID NO: 232626 - DNA, 274 bp, Homo sapiens
ctgagtcatgaacttccatgagctccattcttctcacctttaaaatgaagatcacaactcctaccttcttggcttgttaccagaattaaatgagtttttatgtgtggagggctcatgagagtggctgtcccaaataagcattctctaaatgttagatatgactgtcatccccttaaaactgcaagagttagttgaaaccatagcaagccgagccatgaatgccatgttaatgcatgttaatgccattattataaaggtaccaaaaagctgctga

SEQ ID NO: 232627 - DNA, 305 bp, Homo sapiens
caaacctacttgttttcctaaacccttttttcttctcaagctatgattctcgcctttagagacagaacaatgatgatttacctcttatatgactaacggaaactgctttcttcccctgcaaagagtttaggtccaattttagtctgcacagtcaggcctggggaaggggacctaagccattagtttagcatcagagcacaagacattgatttctaacaccagaatttcataatggtcttgatactccctaacggtaagaccttgggaacggcacttacatgcagactgtcagcctcctcttctat

SEQ ID NO: 232628 - DNA, 301 bp, Homo sapiens
aatgtctgccagggacatgagaagggcaggttgtgcacatatgacagatacttgccacacctgaccaaatggttaacactgtgaaaaatgcccagctagaaatagatgcaaagcaataacagactgatcgtcctgaggcgacatgtcactatgaaaacagaccaaggttggccaggcgtggtggctcacacctgtaatcccaacactttgggagtccgaggcagtggatcatgaggtcaggagatcgagatcatcctggctaacatggtgaaaccccgtctctactaaaaacaaaaacaaa

SEQ ID NO: 232629 - DNA, 451 bp, Homo sapiens
tccacaggccccaaacgtaggcagactggcttccaaaacccgaatattgtcatgaaatgaacccagtcccaggacaacattaaagctgcatctcaacaaccaaaacaattcagcctagctccctccacaacctctgagttctgtctgcaacagccgggctggctgagcagcagacacgcgggcctgtgatggagccacctgccttcacaaaggcccagagcagctgagaccatgtggtcccggcccgctggggccagcggcagctgttactgaccagggtgataccgagccagctgtgatgtgcaacaggatcgtggctgatggcctctagaggcacacacagggcacgacagcagacaaggcagcctcaacgtgggcaagtgcgaggggcacccgtgccctgctatgcctggtctatgggagacgctcacagtgcctgctgggggattca

SEQ ID NO: 232630 - DNA, 358 bp, Homo sapiens
cgagtgtaacttaatcttatttgatggagctttgttcacaaagcaagtggcctgaaaactagttctttgcattctaatgagagtctttggttttcagtcagaagcgatttgacatctttatgctcctctccctttgttgtggaaaaaaaacatcctttcccaagcatgtgatacatctcgaatttaacctggagtcacttaagtctggacatggcttgtaggatgttttattgttcttcattttccccttttaggtgaatcgtgactacagttttagtcattctatctctaataactgattgaaagacaccatttttttaagaattcagaagaaatctacattaaaaaatctacatta

SEQ ID NO: 232631 - DNA, 370 bp, Homo sapiens
gtaattgatttttttgtgaattccatatgccatctgctggatgacacgattttcttgttcagcatgaagtttgttcttgcagacaatatgtgttttctttacacatatcagtaaagacgtgttcattagttagagtaggcaaatgaataacatgtaaagccatattttctaataactgtcatttaattggatattttgtttcatctttcttctcttagatgcataataaacatatatacgataactcaatatagaaattagatttagtatccttctaggtaactgaaattaccctgccatccttataaaacagtattttttattgttcttacactgtaaataaatgtactggcaataaagaattaacagc

SEQ ID NO: 232632 - DNA, 455 bp, Homo sapiens
ggatcagcattttggtgggttttaactccacaagatattagacttctccctgaagacttcatggggaatgaagacattaaacaaagtctctctgggtcatatctccattgcccctgaagattccctctgacttcagtcagacactttgcctcccctttctcagatataacacccaaacaacacaccaaatgactttttgcagtaaacagttttaaaggattggtataatattgcttttgaaattattttgctagaagtgacttataataaaattacatttggctctgattgtactgcattaatcataacttatggattcttgcaaagtgagaaaatataacctaaaattgttctcatgcatcatgacattttttatgaattcaaattttaacaattaatgaagttgacataggttatgcatttgtaggcatttaattaaaatttaattaaatatt

SEQ ID NO: 232633 - DNA, 690 bp, Homo sapiens
gatgacaatgtgccccaaacagatctacacattctatgcaatccatatcaaaattcaaactgtcttttatgcagaattggacaagccgatcctaaaattcatatgaaattgcaaaggatccagaaacaaaacaaacttgaaaaagaggagcaaatggtgaataactaccacttcctgagtttaaaacttatcacaaagctataataatcagaacagtgtggtactggcacatatacaccaatggaacaggagagagagctcagaaataaacccttacatatattgccaattgattttggacaaaagtgccaagaccattcagtggagaaaaagcagtcttttaaacaaatggtgctgggaaaactggaaatccacatgcaaaagaataaagtggaccctcacctaataacatatacaaaaattaactcaaaatggatcaaagacctaaatttaacagctaaaactacagaactcttagaagaaaacataggtgaaaatcctcataactatggatgaggtggtttcttaaacctgatgacaaaaacataggcaataaagaaacaataaattgcactgcatcaaaatttaaaatgtttgtgcatcaaaggacactatatcaagtgaaaagacaacccaaacaatgggagcaaatatctgcaaactatatacttcataagggatgatatccag

SEQ ID NO: 232634 - DNA, 467 bp, Homo sapiens
agctgctaagtctgtgtggaactgttcaccacgacagtggctgaagaggtagactgaggggatttgaagtgatttgcaagtgctgttcaatattggcccttggccagaataagtggtttgcaactggctggtgaaggagatagatgtccagatggcagagtgccaccttggtcatgtgaccatgcagtgaggtttgcagagtaacaagcacggtatgtttctccatgcagacctcattgttctctctcttccatgagaaaggagaaagctgtcattttgttcctcttatgtcgtaaatggtgtacttaatgcctaatgatgagcccttttaactgggaaatacttaccaccacatttgtcctcagctttcggtcttaattaccatttttaaagtttaaggaaaaaatcaactatgatactgttaataagtataagcatctgggtcattcacatggtcaccacattac

SEQ ID NO: 232635 - DNA, 283 bp, Homo sapiens
taaaacagggtctggctctgtcacccaggccagagcgtgattctcctgcctcagcttcctgagtagctgaggcagaaggatcgcttaagcccaggagctggaggctgcagcgagctatgatcgcgccactgcactccagcctgggcacagcgagacctccgtctctaaattagaggattaaaagcacacacacataaaaccccagatcactatcaagacgggcctataaatcttagaagcttgtcttatagggccatatcctcaaaagcctaggataactcca

SEQ ID NO: 232636 - DNA, 126 bp, Homo sapiens
tttttgtcctagcccatatattaagaaggcccatcgttgttgtggcagatacaatgttaagagactcaggtggagaaggtaagttcctcaaagagatgtgttgtattcatgacacagaaagcatag

SEQ ID NO: 232637 - DNA, 477 bp, Homo sapiens
aaatttgtcttgtttaaaccacccagtccatggcattttattgtggtgccaggcagactaatacacttccttacctatttgtcaagcactgtgttagacagtagggatacaaaatcgagtaaagcagagcccttatttgctcagaattaatggcggtgaggaagatagagaagaggaggtgtgatcagtggaactactgattgtaagtaaagtgctacgatggcctcgagaagaaaagattaattctacctaaaaacgttagataagtcttaacaatagaggtaaattttatgttgggtcttctagaaaaaaatagtagtttgggagaggaagaaataaggtagtttagactgggaaaaggaataatatgagaaaaggtaaagatatgggtattgcatttgtgtttagaaactgacaatctgtttcaattaattagaatatgggtggtgatgggagatgaaggaatctgcattgaaa

SEQ ID NO: 232638 - DNA, 184 bp, Homo sapiens
gatgacagtgaagtgccaaatttttgttttaagagctcaatcagcaaatctttaatatgaattgcttgatttgagatatggaaccatttaaaaatattaacttccaagtacattcttacagtactacttttatgagaaacctccaacacattttactagtctcactttcctcatcttctctgga

SEQ ID NO: 232639 - DNA, 421 bp, Homo sapiens
aagtacatcgtgatttgttgattgataaatcttggaattaaagctcattttaaggatcctgagcaagtaagaggcttagggaatattcagtctcctcagtgccctctcccaaccctggtctcagtgtggcccggggcgggagaggttcgaaagtcaggcagtgccaggaaatgtgtgtttgcaggttctgcttaacgttccctggctcgctcctctcagttctgtgaagcccaaatgtgaatgcaatgaaaatctccactggggatgcactcatctcccctgccacataggcccacagcctggagcatggtggcagcggcagccaactcatttcctgaagaagcccagaggaaaccgagaatgtattgcccacaccacttgcctgactcaacaacaatgagcatcaggttcaatgaaaata

SEQ ID NO: 232640 - DNA, 112 bp, Homo sapiens
agtacattatgatagcactgtataaagtatatgacaaatcatcaattttactgatcgttgaaaactcatcttaactatgcaaatcctaaaataattcagtacatatgtttga

SEQ ID NO: 232641 - DNA, 358 bp, Homo sapiens
tatagtatcacgcggaatagtttgactgccctgaaaatccttagtgctcctgttcatccctttcttccgacaacacctggcaaccgctgatctttccactgactgcatggttttgacttttccagaatggcatataatgggaatcttggagtggctagccttttcagattggcttctttccttatagtaatatgcatttaagctttctccatgtcttgtcttgagagttcatttctttttagtgctgaataatattccattgtcaggctgtaacagtgtttattcattccccaactaaagggcattctggttgtttctgtgtttgggcaattatcaataaagctcctacaaacatctg

SEQ ID NO: 232642 - DNA, 605 bp, Homo sapiens
atcttagtttcaattgctttgacaaatgctatattcagtttgtaaaaatcatttatggaagtaaaactgcatttttttggtcaaaataggtggcaaaagaggtactttgacaatttaaagaacatcagaaaatgtagaactattttttaaaatcggcaaataagtggtttttaggatttatgtttcttttgcttatttgccatgagaaactgttagctaaacttaaagaagattttattgtgcacctactgtggaagggtgtggaccgtgtcttgagaagtgtgatgcctctgaacagagcattttcattctgggctttgctgctcctctggtgctcagggcagatggggatacttctctggcttcgtgctgcctactctctacatgtactgtaactgacaccacacactctgtggagctatcctttccacctttgccctgatgcaggtaacaatgacaaagaataaaaaggcttgaggcagggcatggtggctcatacctgtaatcccagcactttgggaggccgcagcgggtggatcacaggtcaggagatcaacaccatccctgctaacacagtgaaactccgtctctactaaaaatacaaa

SEQ ID NO: 232643 - DNA, 152 bp, Homo sapiens
tgcattaacctgaagaagctgtgaaaatagcagattgcttatccaagcacaacattatgaggcgtggcgtgtctaatcacgaacccactagaacatgagaaagaagaaattgaacaagactgtaatgagttgtttggaatggaagcccataa

SEQ ID NO: 232644 - DNA, 318 bp, Homo sapiens
agtaaaattttgtaaagctgctcctcatgagattctttgaaattcatttataacaacgagactggatacttaacatctgctgcaaatgttttctaggagacttagttactcctgttccctactttctgtagtttatttccattctatgattgtttatcttttgaaataatttcaacaattgactctgtttaatttgtctggttctgagaaaacattagctagatgacaaatttaacagtttaatccaacaggccttgagtggtatatatcggcatgtgttaccaaaggagtcaagaaattaactccagctcttaaaca

SEQ ID NO: 232645 - DNA, 468 bp, Homo sapiens
aacagctagtgcttcagtcctaggaattatgtctctgctgtgggcagttgtcataaactcttctcacaatccgagctgctctttgtcctctgtgaatgaaggtacttttgcttccatttcatccaaggatgaatgaaaatgtatagcatctgcccaaacctaaaaagtacagtgtgtttatcacgagagctttgtaaggtacttcacttccactttaaaattctttagtgctcaaaaccaactattgtgggtttttgtcaataaatactaatttttcaagatgaagtatggtgatttctattcatattgtggtcaattttctcaattttgtttcccatagatagcgtgatggaacttaaattttattttttacacttaaataactgtgctttttgtgatgcgtaatcatgattttctcttttccttgagattttaacagaccttatattagtgcatatgtcaaaataa

SEQ ID NO: 232646 - DNA, 398 bp, Homo sapiens
ctatgaaaattggctacagggggtaggaagcaagggtgaaacattctaagcgtttcaggaggaagaactggatcaaaactgcaagaatcaatattaagaagttctatgtacaccatgtatttgtgttctacgtacaccatgcaaacacaaaatacaaagccaatcttttattctaagaaaatctataaacatgtttatatagcaatctagacttgatcacctcaagaactagggcataaaaatctttgaactgcctaaaatatttagcctacgacaacttttgtagtctaagactctaaagaaaatttgatacacaaaccacattccaaaaatatacttgagacttagaatttttctactctggttttaaagttaaatactgtattataagagtattg

SEQ ID NO: 232647 - DNA, 412 bp, Homo sapiens
aaaccagaaaatgtgtgtggaatcagttggcaccatgcccaacactggtcaacactcagtaaatgttctctcattcctcctctgggtgtctattgtctttaaagaaacttcatgaaagattccaacttacaccataaaataaggcttcccagcaccaaaagagcagaagcccaaggataaccatcataacagagttcctgtgagtttcatggtcgttataaactataatcctacttaactcttcctaagaccttccagaatccagagctctcacattggaatttttgtcactaaatatttctctaattatttcagacatgttggactctccttcccaaccagatttaagttctagaccatgaagcttaatactgtaagctgaaacaagcttaatactgcagagaatacagga

SEQ ID NO: 232648 - DNA, 466 bp, Homo sapiens
aaaccagaaaatgtgtgtggaatcagttggcaccatgcccaacactggtcaacactcagtaaatgttctctcattcctcctctgggtgtctattgtctttaaagaaacttcatgaaagattccaacttacaccataaaataaggcttcccagcaccaaaagagcagaagcccaagaccttctggataaagcttctgctctttccatttggttcccggctcaagattttggataaccatcataacagagttcctgtgagtttcatggtcgttataaactataatcctacttaactcttcctaagaccttccagaatccagagctctcacattggaatttttgtcactaaatatttctctaattatttcagacatgttggactctccttcccaaccagatttaagttctagaccatgaagcttaatactgtaagctgaaacaagcttaatactgcagagaatacagga

SEQ ID NO: 232649 - DNA, 476 bp, Homo sapiens
tccatgccccccatctggacctgtgccagcccctcctcgggctcctcctgctccccccactctctcctccacccacgatggcccagctcctgtcagcagctacaggaggtttgaaaatcctaaatcagacctcccctgtcccagacctccctgcatctaccgtgaccctcagaataaaaccctctctcgggctaggcgtggtggcttacgcctgtaaccccaacactttgggaggctgaggcaggcgggtcacttgacgtcaggagttcgagaccgtcctggccaacgtggcgaaaccctgtctctactaaaaatacaaaaattagctgggcgtggtggcacatgactgtaatcccagctactcgggaggctgaggcaggagaatcgcttgaacccagaggcggaggttgcagtgagctgagatcccgccactgcactccagcctggatgatacagcaagactccctctcaaaaaa

SEQ ID NO: 232650 - DNA, 451 bp, Homo sapiens
cgtggtgtctggggcaccaccctcccaggtgcattgatgtgttcgccaaccaggaagcctggacatcattgttcaagtttttattgaagtttcattatataggcaccatcgattaagtcatcggccactggtgactgggctgagtcttcgatccctctcccctccctggaggcgatgggggagtaaaagctctaaccctctaatgacgtggttggttctttcgatagcccccaattgccccaattgtgaagctgtctatctaggggcctgccaggagtctcctcattagcataaactcaggtatgattgaaaggggcgtattttgaataatttcttgaatgattcaagaaattccaagaattttaggaattctcaccaggaactggagacaaagacaaaatatctatttactgttataccatagtctgtgattgacttcatctcctaatta

SEQ ID NO: 232651 - DNA, 389 bp, Homo sapiens
ctactgctagaagtttgagaaaaggtgtttgaaacaatacaagtgaactcattcaataaattaataaatggacctctaaattacaaaggatcactcttccagtgagactgctgattaattattaatttccattattttatagatacattattggttttgttcatccttttaaaatatcttcttgatttttttaatagtaaatgtaggtaatatatctagttaaattaggtgaaatgagcttcaaatgtgctttaaaatatattgtactgtacatatttaaagaaattcaaatgatgtcatgttctctctcgagtttttgtataatgctgctagtggcatattttgctttaaaataaattttcagttctaaaatctctgaagtacttctc

SEQ ID NO: 232652 - DNA, 582 bp, Homo sapiens
actatgttttagttatttaagatagaaattatgacttatgctaccctcacattcccccatactaatagatacacagagataacttatcatggatccattttttaaaatgaaatagatcaacatgtactgacctgttcagctatatatgatacattaaatggaaacaaagcaagttgcacaaagaaaattgagtgcttaagaataaattttaaaagaaatgtataaaacacatctgaggaaaactttaaagcattcttaaaaagacacaaatgaagagtttaaccacagacatctcttatattcagatagaacaagttaacataaaaatgtcagttcatcataaatttagaaatttaatgtaatcctcataaataaaccaagtttttttaatggagacatacaattgatactgagccttgtattgaaaaataaatgtgcagtaacagccaggaaaacactaacacactagagggaaggccgagttcttccagacattaaatcacagtctaaagcctccatgatgaaaagtgtcttactgacacatgaatagacagacaaaccaacagaataatacagaaagtt

SEQ ID NO: 232653 - DNA, 178 bp, Homo sapiens
aaatgtgtatttgaggatttgatcagcaaatggaacattctcagcagagggaaaatgaacacaaagatagggaagtgagaaatttaatggcatgattagaggctaacacatattttacagaggatgaaggacatgggagacgggactggctctgtaatttgcagggcctcgtgcaaga

SEQ ID NO: 232654 - DNA, 483 bp, Homo sapiens
cggctagtgcgcgccgagggctcaggggccggcgccgcgaggggctgcaggccgcgctcggccgctgtccgggccgcaggtgggagccgctgtctgggtcccagggctggatggcagccggcggcggggactgaacgcgggagggctgcagggtgcgcgccggcgaggggcttctcgttggaagctgagggacagacgtggggacccgtggctgctcggccccaccgtccagccgcagggcgagtgctgctccgtggaggtgacacggcgccaagagcggcgcgaggctttctgctggaggagggtaacggggaattcgaaggcgactgttctatgctggaggacaaggggcactgttctctcggggcttcgcgtcggcgccgaggaggggttcgctcgctgcctctgcgtcctgagctcggcctctggctcctggggccggggacgcagagaggggctggagccggtcgacccacggcccag

SEQ ID NO: 232655 - DNA, 958 bp, Homo sapiens
gtgagaccctatctcttatttaaaaaaaaaatagtaattttaaaaaaaagtatatgggaagagcagtgcaggttttatgcaaatactacaccatttttatataagggatttgtgcatctgcagagtttggtatctgggtaactaatccccagcagattcagagggacgactgtacttaagggaatgatggaagccagcctagcagagctagagaatcaaacaccagatgaggaggaactggaatcccaaggcagtttcactgtcttcatacatagttccctgggcccaatccagaagcccccaagccagcaaagctcctatgcctgctaaaccctagcacctgagagccaaagaggttttgtagagaacctggtctcttagtgatggggacatggtaccttaggagtccagtgagcaaaagaatgaacctctgattgtgcttctcatgtgtcccccaaacccaacaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232656 - DNA, 4603 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatatgaagaaacagaaactcagagcaactaaacatttgcccaaatgactccaactgtaggtgtcagacaaaagaaaagaaaaggacttttaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggcaaaaggaaaggaaatggcagagagaaagctatgattctgatgagtatgtatacgtgtgtaatcccagagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232657 - DNA, 1873 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtgagtggggttgccgtttggggtaccttcccacaaagcctcccctgacctccccagttgcgtcaggtgccctctctgtgcccacagccctctgtgcctccctctggtagcactcccctttctgtgatgaaacattgtgttgatatgtctgttgcctgccctggactgtgaactccacagggacacaggctatgccatctttctctgatcttccacgcctcgcccagggccttgctaacacagaataaaaataactaggtgaatgagagagaaaatgaatcggtccagaacccgtgcttattgtaacccagttttcatgctgatttcctttgtgtctcagatcacaataaggtttttaattaatgtctcctatcctaggctgacacttccgtaggagactccccaggttggacccccaacccctactgggtctagcttccaaccccaaagctgcttcccccaccagcctactctgggacccccgtgggagtgctgttatcc

SEQ ID NO: 232658 - DNA, 4265 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232659 - DNA, 4326 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatggcagaagaggaaagaaactaacgggtattgagcacctactttgtgccaggcccaggccaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232660 - DNA, 3175 bp, Homo sapiens
aacgggtattgagcacctacttgtccaggcccaggccaggtccccccgcctccagccagcctgtgcagacttgctgcctgctgtgtcaccgggaacgcaaaggctgggaagaaggcgggggggacatgcacaattccagagattctactagaaggctgtcaagagccatgccttctggctgcaccagcctcccagagtcccctgctgcccgatgcagtgtcggcagaagaggaaagaaactaacgggtattgagcacctactttgtgccaggcccaggccaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232661 - DNA, 4372 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagagcactttgggaggccgaggcgggtggatcacctgagatcaggagttcaagaccagcctggccaagttggtgaaaccccgtctctactaaaaatagaaaaataaggcaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232662 - DNA, 4588 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacagagttggcatgttggtgatttgtgggtctgggcggggagggagttgagggtgtgctcagaagcatgggctctcccttagtcactaaccctagcatgcaccatgcatcagcagtttggtgctattgtcccattttacaggtgaggaaactaaagccgataggaaagtgactcagctcaacttagtctggctgattagcattgagcgcagactggtatgattatggcatctgtgcccttttctccttttgggaggtctctggtatgtgagcctggggcagccccttccccactctttcctgtttccctctttgcaagatgggtgagt

SEQ ID NO: 232663 - DNA, 537 bp, Homo sapiens
tgtaatttcagcactttgggaggccaaggcaggcggatcacttgaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232664 - DNA, 3596 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggatgagactgaccgagaggtggagtactttaagtggccctgtttggactctggggtaccgagct

SEQ ID NO: 232665 - DNA, 1926 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtgagtggggttgccgtttggggtaccttcccacaaagcctcccctgacctccccagttgcgtcaggtgccctctctgtgcccacagccctctgtgcctccctctggtagcactcccctttctgtgatgaaacattgtgttgatatgtctgttgcctgccctggactgtgaactccacagggacacaggctatgccatctttctctgatcttccacgcctcgcccagggccttgctaacacagaataaaaataactaggtgaatgagagagaaaatgaatcggtccagaacccgtgcttattgtaacccagttttcatgctgatttcctttgtgtctcagatcacaataaggtttttaattaatgaaaatgtcagcacttactgagtgtcagaagctccaccttcatccgcatccccatctcctatcctaggctgacacttccgtaggagactccccaggttggacccccaacccctactgggtctagcttccaaccccaaagctgcttcccccaccagcctactctgggacccccgtgggagtgctgttatcc

SEQ ID NO: 232666 - DNA, 1785 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatggcagaagaggaaagaaactaacgggtattgagcacctactttgtgccaggcccaggccaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatgtcgcccttctcaaaccttcttgatgcattcctgctttcctgtagctgcgtgtgcacgtccaaagaagcaagagcagagagacaatgattctctactatcctccccg

SEQ ID NO: 232667 - DNA, 433 bp, Homo sapiens
gaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttgggtgagtgcaccaggaactgagcggctgaccccctaccccagccagtccacggggtggaggggcagcctttgtgtgtagacagcgctgcccccagagcataaccccaaaggcctggccatgggcactgagccctcctggctgtgtcttcctagacgatgtgttcctgcccaaggacatggacggggtggagatggatgagactgaccgagaggtggagtactttaagaggtaggtgtgggctgcctgctctcccacttgtggaggactcc

SEQ ID NO: 232668 - DNA, 4444 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232669 - DNA, 4413 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagagtatttttggccaagcgcggtggctcatgcttctcatcctagcactttgggaggccgaggcgggtggatcacctgagatcaggagttcaagaccagcctggccaagttggtgaaaccccgtctctactaaaaatagaaaaataaggcaggttctgtttggattctgcaaagcagactcgtcagaaagttgctgtgaactggaccaacttcagcctcaagaaaaccactcctagcacagctcagtgaggccctgcccaggctgagctgcttcagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232670 - DNA, 4211 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagggcatcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacaga

SEQ ID NO: 232671 - DNA, 4229 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagcccccaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagagtgctggcccaacactgctctctttgtgtttggtttttttgtttttgtttttattttgtttttttccaattctttacttttgatactgtgaagatctttcgtgccgaaagataaagcaacatttggacacagagttggcatgttggtgatttgtgggtctgggcggggagggagttgagggtgtgctcagaagcatgggctctcccttagtcactaaccctagcatgcaccatgcatcagcagtttggtgctattgtcccattttacaggtgaggaaactaaagccgataggaaagtgactcagctcaacttagtctggctgattagcattgagcgcagactggtatgattatggcatctgtgcccttttctccttttgggaggtctctggtatgtgagcctggggcagccccttccccactctttcctgtttccctctttgcaagatgggtgagt

SEQ ID NO: 232672 - DNA, 2091 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagctcgcccctgagttagcagctcgcccctgagttagcagctcgcccctgagttagcagctcgcccctgagttgcctgcagctcgcccctgagttgcctgcagctcgcccctgagttacctgcagctcgcccctgagttacctgcagctccccctgagtt

SEQ ID NO: 232673 - DNA, 2437 bp, Homo sapiens
  misc_feature (29)..(29): n is a, c, g, or t
gcggtagcggcggcggcggcggcggcggnggcggcggcggcggcgcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatatgaagaaacagaaactcagagcaactaaacatttgcccaaatgactccaactgtaggtgtcagacaaaagaaaagaaaaggacttttaggtactttgggggattttcaacaaggcatttttttttaaactatagccccaaagaagggaaacaaactggtaaattcggttctagttatgccccactttgaccgggggtggggtctggaagcaggcttttgtgccctggtgcaaagcacctagtgtaagggtagggttcagtcattgctctgcctacaagcgtgtttttggtgaggaactctggctcccattgccactcataaccctgtcttacatctacagagtggataaggaagatgaaactcagtgtcatataccaaactgaatccaaaggtggcaaataagaccacttccagtccacaggcttgttgtaatgccccagctcacatattgttttgtttctgtttttattttcatttgagccaatattttaaagatcaaaaggtttcccacacatttggatttggggctcttttttaaactaaagatatggtgatgctgggtccacttttccacaaggcagtaatcagtagtctctgagtagcatttggcccttttagacagcgtatgctccttaggcatctttggttctttccaggccccttcactcattggcataacctgtacacatttaaagcaggaccttgagtttaattgggatcccaaatggctttcaattgtttcaggccactaaaccacattgatctgtttcctaacaacccaaatcctcgtttatagcacaagaaggctgaaacagttactaccttattagcaaaggaaaacaaaacaaacaaaaaaaaaataaagaacaactgaaaaagcaattgtaggaggcagtggggaatagtgtttagagacttggattgaattcccagcttagcctcctagctttgtgactccgcaagttgcttctctctgaccccatcaggaacttcacaagaggccttggtcgcacgcctgtaatcccggcactttgggaggctgaggcaggaggatctcttgaggc

SEQ ID NO: 232674 - DNA, 471 bp, Homo sapiens
ccaaaatgaggtaatttaaaaaattatatcaaagttactcaggaaatgggttttcagttccgtatctttatatatgttcacttccaaatcttttgatgttgacatttgccattgtagtttaattttctttaaaaagttcgaaagaaaaccacacatgaaatgtaaaagtccaaatttctcttcttcagtataatatagcttattctttatttattattttacttagatccttgaagtatatgcatcattgatccaggtctatgcacaagatttataatgtaaataaagaatgaactaaataatactgtttgagatgaatatttgaattgagatgaataaacgttgcatctaatgcacaatgaaacttcattgacatctgatgaaattacagtacaagtgattttgttaacattctatggtgactaatactattaatcctttttaatcataccaataaaatatttctgcctt

SEQ ID NO: 232675 - DNA, 999 bp, Homo sapiens
ctgaaagatgaatatgagggcagaaaatgaatctaaatctttggtttaaatgataaagtctttacacattgtagagaattaaataagcagttggtcatacttttatttatcttcaggatcttttgctctctgataaaagtagaaagctttagggaatagattgtgtagaaagtaaatccgacttcaagattcagttcctttttgataatttattgttttaaatcctaaatatctgaagcagtaatgccatgactcaccaaacatatctttgtgaaatgatttccagagattgggagaaaaaaatactaatagttgattttgctttaagtgttttttatttctcacaacattccaaatgtttgttttaggagatacaagagtttatcattttttcttttaattgctaagaagacttgttacaactttcaaaaaaagtcctcatggaacctgataaataagaagttcaatgtcttatttcattacgagctatctaaatatttttgtcagattcagaatatgtaactgaatgtatgtaattcttttttgtagcagccaagaataatttaagtttcacaactaatactgatatgcctttatcatatttttgctaaccagccaaatctgtattcccatgatcatccttaatgtttgtactagtagaggactatagtggtgcaaactgaaccaaaatagcaactaataagaaggaataaatgaggccgggcacagtggctcaagcctgtaattccagcactttgggaaactgaggtgggaggatcacttgaggccaggagtttgagaccagcctgcccaacatgttgaaaccccgtctacactaaaaatacaataattaggcaggcatggtgttgcacacctgtaatcccagctgcttaagaggctgaggcaggagaatcacttgaacccgggaggtgtaggttgcagtgagcagagattgcaccaccacattccagcctgggcaacagagcaagactctgtcta

SEQ ID NO: 232676 - DNA, 194 bp, Homo sapiens
ctgattttgagccatcagattacatgcgttggtacagttttcctcatgtttcttgtacatagaactggttaagcttctaaaatcagtgggtttatagttctcatcaattttgaaatgtttctgccattaagtttccaaatatttttctcaactcccctcctttagaaacaccaactacatcactgataccctgt

SEQ ID NO: 232677 - DNA, 400 bp, Homo sapiens
gagtgcttaggacactcttagagccagatgagctcaagggtctgctttgtcatttttagagaacctcatggttgtgaaagctcactcagctttgctcagaggtttatatcctcctcattacttcacagacacctaggactctgttttattacagggttgaataaatattagctttgcaattaaagataacagtgtccattacatgtcagacacgagggccaagcgttgcatatattacctaatttgtttttcattgcagaactattattctctttttaaaaatcaggaaaccgggctttgaaaggtaattttacccagcttacccagcaaatacagtgtagacctggacttccgactcaggtctcattggctctgaggcccctgggctcgccactgctct

SEQ ID NO: 232678 - DNA, 773 bp, Homo sapiens
aggaaagggattagaagtgagactttgaattttcattttattttatttatatatttttttcgagacagggtctggctctgtcacccaggctagagtgagggcagtggcacagtctctgcagcatctgcctcctggcctcaagccatcctcctacttcagcctcccaagtagctaggactacaggtgcacaccaccacgcctggctaatttttgtagagatggggttttgccatgttgtccaggctggtctcaaactcctggactcaagaaatccaccctcctcagtctcccaaagtgctgggattataggtgtgagacaccatacccagacagaatatgtttttaaaatatttttgactttggaatcatccacatatttagcccttcaaagaaaagtaagtcaaaaacgtgaaaagcatattgagattttttaacttactagctgggaaaagaaaaaaaaattggctccttttggttctttagtttttttatttatttattttttattttgttatactttaagttctagggtacatgtgcacaatttgcaggtttgttaaataggtatgcatgtgccatgttggtttgctgcacccatcaactcctcatttacattaggtatttctcctaatgctatccctccccccaccccctactccccggtgtatatgtgccacaatttcttaatacagtctatcattgatggacatttgggttggttccaagtctgctattgtgaatagtgccacaataaacatacgtgtgcatgtgtc

SEQ ID NO: 232679 - DNA, 746 bp, Homo sapiens
tagaactctaaccaaaagtaataattgaccaagtgtgaaaaaaatattcagttatatagttcatatgtattagtctgttctcatgctgctatgaggacatacccgagactgggtaattctaaaggaaagaggtttaattgactcagttccacatggctagggaggcctcagggaacttacagccatggtgaaaggggaagcaaacatatccttctttgcaaggcggcaggagagagaagaatgagagctgagcgaaggaggatgcccgttataaaaccatcagatctcgtgagaacttaccatcacaagaatagtatgggggaaaccaccaccatgattcagttacctccgacggggtccttctcacgatgtggggattgtgggaactacaattcaagatgagatttgggtagggacgcagccaaaccgtattatcataatagcaaaaaaaaaaaaaaaggaaaaggagcaacgtaaatttccagtagagaagtagttaattaaatattggtaaatttacacagtagaatactgtgtatcatcaaaaatgttgctgtgtaaatctatatgtattaccatggaagaatattttgccatattacagtgaataatagacaatgttatggaacatataaaatacaaatgcatgaggaaaagtctggaattatggaccccaaaatgttcatggtcattatctttggttaatgagatcatggaattctttaatttgcctctttctatattct

SEQ ID NO: 232680 - DNA, 1418 bp, Homo sapiens
  misc_feature (206)..(206): n is a, c, g, or t
ttttccagaaggattttaagtggcagagtccctggtgatggttcagctgtgggagagaaggcctggaaagaaaaccaaccaggatcagttactcagtggaggtaggaaacaggccaacacttggcctaaaaagtagagcttccaatttgaaatattaactggtctagcccccaaatccaagcaatgttaacatgtgtcaacaatanacacaagcaaaggcccaactactaacagtgtaaaagacatcaggcagtggaacaaatgtaaagcaggcaactgatttaaggaaaaaagtgtaatatctaaatcatgcagctagtaaatggaatgtctgtatgactacagatctaccatgctgcctttctagacaaaatgaaaatagctcctgggcccctacattcttcaaattccagcactcctaagtcaccgtggacacagtacaaatttcttccacctacgtcattcattcctaaaagaattggatgtggggaggagttaaaagttttggtgacccagagaagggtctctacacagatgctaaccctactaagggcagagaccagctttcaaagtcagttcattcttttgaacagcaaaagtcacttggttatactgtaaatagagtttcagaaggtataagggactactaaatctatgaatctgaagtaaaggtctcaaggttgcttttcaatcactcctcctaatcctaacttatttgccttgtttcatagacatataaactgttagaactgaaagcccccttaaaagtcggaaaatctaaccctctaaacagatagaaaaaaacagctgaggctcagcaatggaagggactggacaattgaattattttgatttgagatagaaggaatgggagctacctgtagagtatggcatcaatatctgtgataagatttttgtgatatttgtttctctctacctgatttctccagaatttgtaaactatttgtgagtattcttatggtaatatagttatttgcataagtgcaataagaatctgttttcatttgtaacaggatacaattggagaaacagattattttaccaagctttgactggaatagtgtgctttcttttaagaaatcaaacttgacttatagagccaataaaagccccttgggcctgggcatggtggctcatgcctgtaatcctaggactttgggaggccaaggtcggtggattacctgaggtcagcagttcaagaccagcctgtacaaagtggtgaaaccccatctctaccgaaaatacaaaattagctgagcatggtggtgcaagcctataatcccagctacttgggaggctgaggcaggagaatcacttgaacctgggaagtggaggctgcagtgaagtgagaccacaccattgcactccatcctgggcaacaagcatgaaactatctc

SEQ ID NO: 232681 - DNA, 496 bp, Homo sapiens
gggaccctgcaggtcacccaggtggggacactcagagtaagctaccacttattgagcacctagtatgtgctggtcactctgccagatgcgtcatatgcaccttttcatttaatcttgataatagcacttcaaggtagaggctcttactatccccatgtacagttgaggaaagaaaagcttagagggactttgaaacctgtctaaagatctcagggctggaactggaacccaggcagattctaaagcacctgttcctagccacaaccgtggcaaacaagagtatagcaggtcgttgtttggctcaattgagaaaaatccatgtaaagtgcttaacattgtgtctaggtatgtaaaagaggctcattacatggtgatgctgattatctgtattttcaacatcattactttggaagcataaatcatgtaagagattaaaaatactaaagagttgtaagaaaattaaagtgtgaaatctcctaggatgaggtttaattta

SEQ ID NO: 232682 - DNA, 694 bp, Homo sapiens
tggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaa

SEQ ID NO: 232683 - DNA, 468 bp, Homo sapiens
aagactggtcgttaaaggctggttcgttgagtctttcatcgttgagtgataccacctctgcagatggctcagtgggcagccccgtaccacagcctgcccttgaggttgtgtagtttagataggtcacagagttgctgggcctaccgcaggtctcctgaccctggtgcagttttacttcaattacaaccaccaaaatagctacagtcaaaaattccaaagttcctacaccatcaacctccaccccacttccgtccaaagtccacttagaggctctcagttttggaccttagaaacacttagggagctttttaaaaagatcgattctgtatttttagtagagatggggtttcacccagctactcaggaggctgaggcaggagaatcacttgaaccggggagttggaggttgcagtgagccgagattatgtcactccagcctgggcaacagagtgcagactccgtcttagg

SEQ ID NO: 232684 - DNA, 336 bp, Homo sapiens
tttcaacccccaaccccacccccaggaagatgaaagcaaggcaaactcccgagccacaactacctcatctacaaagtgggctaccttcctctcgcagggcagcagctcaccagggcctgggctcggaggccagaccagcttcccttgctgcgaagctgggagcatcctactgtgatgggggtgtggctgaccctctctgggcacatatcctacccttcctcctccttcacagcctgcttaaggaggactgggatcattaggcagatccaaactgtggtttggagctttcgggaaaacaagccccatcaatgcaatttccttgttaataccgtgcca

SEQ ID NO: 232685 - DNA, 348 bp, Homo sapiens
  misc_feature (150)..(150): n is a, c, g, or t
  misc_feature (160)..(160): n is a, c, g, or t
ctgaactgtcactcccctccttaaaaccccttcaaagtttctcatggccttggaataaagcccacacaggctcacctgttcacaaagtccttaggatacagcctcactttcagcctaagctccagacacaccaaattcctggcacctccntcccaccctngccttgtcactggctttttctgtgcctttgagcacggtgtcctgtctgcctgggaagtctccatcccttccccctttcacctttgagctcctactcatcattcaagatgcaacacaaaagtatttcctctccgaagctctccctcatgcttggggcagttagtcatcccttcctgcgctcccacagca

SEQ ID NO: 232686 - DNA, 335 bp, Homo sapiens
agctgaaatcatatgaagtgttcaattttataccctgctttttttaaacggaagattatgacacagcttttttacaatgttattagaagcttttcagaaacattccttttaacggctgcaaaatgctataataatattgtcatatcccaattccctactgtgaaacactcaggcgttattccctgttgaaaacaaagctgggctaaacatctttatgcacatttttttctgtatttcggactggacatgatatatgtggctttttgggctgtcggcacataacaattaaaatccaaaaagagaaaacattaattgctgagcaaaactttgcattt

SEQ ID NO: 232687 - DNA, 379 bp, Homo sapiens
acagacatcaaaggtacaggcagcaaaagcaaaaaataaacaaacaaaaatgagactacatcaaacaaaaaaaagcttcttcactgcaaaagaaacaaaaatgaggctgggtgtcatggccccagcactttgggaggccaagggcagtgaatcacttgaggccaagagtatgagatcagcctggccaacatggtgaaaccccgtctctattaaaaatacaaaaattagctgggcatggtggcacatgcctgtaatcccagctactcgggaggctgaggcaggagaatagcttggagctgggaggcagaggttgcagtgagctgagatcatgccattgcactccagcctgagtgacagagtgagtgagactctgtctcca

SEQ ID NO: 232688 - DNA, 1064 bp, Homo sapiens
tcatgggctgggagaaagcatgaccacctaagggttgcagggctaagtatcttgctgacacataatactgacatcacaatgctaggtggtgcctctctggttttggctggaaggctgacttagcatcaacagtacagagctatgtgggtacccggctgtatttgccaaagtgattgacacactgaagtgcttaaattaaaatctgggctagaggtgtatttctatgggacaaagtctaaatttagccttgaatgcgttgtttttaggtgtgtaacatctgaatatatttttagatggactaattttcaataaacatatatagggtttgtgctggctgtagaacactgattttgggtgcagcatgattaagatgagtcatacatcttggctccagtctcatagaggaacggtctccaaactttttggcaccggggaccagtttcgtggaagacaatttttccatgggctgggggtggaagttggagagatggtttcaggatgaaactgtttcacctcagatcatcaggaattagattctcataaggagggtgcaacctagatttctcagatgtgcagttcacaataggatttgcactcctatgataatctaatgcggccgctgacctgacaggaggcagagctcaggtggcaatgcttgctcttggctggctgcacatctcctgctgtgtggccccattcctaacaggccacagactgctaccggtccacagcttgggggctggggacacctgtcacagaggatatcagttcagtgattactaagtagtttagtaagcataagacagtttactactaatataacctgtaaagtagaagactctccctagaaatagattatcatctagatttcttctaaaggagaaaactctgggactaatcctcagaactgggtatggaaagttctaggagaagaaaagggtagtaagtagcaggaagggtgagtaaattgtgcacctaaaagggccagtctgtccacattggagggtaaattactggctgaagagctttcgatgctggtcagagttgctattttatatatttag

SEQ ID NO: 232689 - DNA, 942 bp, Homo sapiens
ccaagtctgtgggcttggtcctgcttgacacatgggtgggagtggcctctggttgtcccacagccagttgttcttcggggacacccctcctgcagctccgtggctgctccagggctgaggagccaggactcacaggagtgtgggcgtggccatccagaaagctttggtctttgggggttgctggaaaagcaaaaccaggttggtggggcagaaggcaccctggccacgcacaggcatcaccacctctggggtccgcagagtctgtgtaacaacctggttcctcaatctagcagtgcttttgaatgaacgtgtgacagcttaatgaagcagccgagtaccttgatttgaatgttggagccggggttcacagggggctgtattagtcagtacaggctgggttatgccactgtgacaaagagccccagatctcaaaccccgtccttgtgggtcagctgaggtctctgttccaggccatccccacttggaaccaggtctgtttccacaactaagaaagcagaggccgggtatggtggtggctgacgcttgtattcccagcatttggggaggccaagttagattatttgaagccaggggtttaggaccagcctggaaagcaaggcaagaccccatctctacaaaaaatgaaaaaattagctggacctggtggcacatgcctgtaatgccagctgcttgggaggctgaggtgggaggatcacttgagtccaggaggtggaggctgcagtgagctgtgattgccactgcactccagcctggattacagagcaagaccctgtcttaaaaactaagaataatggccgggcgcggtggctcacgcctgtaatcccagcactttgggaggccgaggcgggcggatcacgaggtcaggagatcgagaccatcccggctaaaacggtgaaaccccgtctctactaaaaatacaaa

SEQ ID NO: 232690 - DNA, 431 bp, Homo sapiens
gggctggcgccagtcgcctggtccctcgctcgccgcagcctagacggcggacgctccctgtcaaggcctaattcctgcaactcgccggcccccggtaaccgttttccttccccgcctaagaaaaacagttttttcctctagaccacttcggcggcctcttctgacagttttgcttctcctatgccagcgggtctccgcgcctttagggggtgctcgtcatcctttgccccccaaccccccgccacatcctcgtaactgatgtacagtccgtcagttcggcttcagttcttttgacggatgaaaatggcatatttgtgcattctctggatgcgttataatgaggacactcagtacgtccgttgtttcatctttctgaaaaagtaaatcacattaaatcctcaggcttgtaaaacctcatagctaattttcaa

SEQ ID NO: 232691 - DNA, 444 bp, Homo sapiens
aaccaaatatcccgcaagaaaagctggaagcaagctatctgtgaaaatgctttatgatgcatgctttcatctcagagagttatactgttctttcatttcagccagtgagaagcactctttttgtagaatctataaggggacagtgcggagcccattgaagtccatagtgaaagactgaatatcccatgataaaaattagaaacaagctgtctgtgaaaacatgttgcaatgtgtggattcatctcaaagaatgaaactttcttttgattaaacaagttggaaacactctttttttagaatccacaatgggacattttggagtccattggggcctattttgaaaatccaaatataccgcaataaaaactagaaagaaactatctgtaaaaatgctttgtgatgtgtgaattcatttaacataaataaaactttttgttattcagc

SEQ ID NO: 232692 - DNA, 176 bp, Homo sapiens
cgcccccgtcctcgcccgcgctggctccgccagccccggggcgcgcgctcctcgaccccgaccccgaacccgctgaacggcgcgcgcgcctgagcgcccctcccggcccgctcccctccaccgggcgagagaaccggggcgcgcccctctccagctctccccggtacgagcggccg

SEQ ID NO: 232693 - DNA, 406 bp, Homo sapiens
gtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaa

SEQ ID NO: 232694 - DNA, 521 bp, Homo sapiens
atggaatgtgagcctaattacatgttcctttggaataagatctcaccagcccaggagtgtcagaaaccctctatcatatatacgtatcttgtttccaaaatgatcttcccaagccaccctaacaggcccccttcagaatgcttcctgctgacaagtgaatctgctttttgcctttcacccaatctcagctcatgctttctctgtgaaaatatcacagaccacatctgacagtggtccagctaattaatgtactccaatgtctagcaagcatttgacaggaaaaataatctatacagtatttattgcaaaatcttcaccaatgtgacaaagatgaatgtaaactttacataatcatttttcatttgttatccaaagttgaaagtgattttcaaatgctaactttaaaattatgatgaggaagataacagctctgctttaaaactgcttggcaatggaatttctatagtataatggtttagcaatgagctagaaaaataaactctcttgctaatgtagtaaat

SEQ ID NO: 232695 - DNA, 428 bp, Homo sapiens
tgcagttccactagaatgcttttcagaaccttggtcgtaccttctcacattcacatagatctctcactgaaacacctcctcctttttcccctgcttaatcctcactctttccttggagctttttagacaaagccttcgaagcccagattaagttagttttgcctgtcataccttcttatattaggctgttctctccttcttagcaaccgttatggctgctgactttattcaccaccggaagatatttgccttattcactactgcatgcccagggcctacaacagtacatggccccaggtaacttctcaattgttttctcccccgtttctaaataatgagtaaatgtatgcccaacttctgacccaaggactgggcacttaggaaatacaattttaggagcagccctgcaaaatcttttctctcacccc

SEQ ID NO: 232696 - DNA, 743 bp, Homo sapiens
gtgggttccaagatagatggcagaaagtgggaaatgtgatttttcttgattgggtaactaagaaccacacagcatgcgggagccattttgggccaaagagctgttcatttaaagtgtttattgacacctggaaatagggtttaaacttcaaatgctattttcacatcaagtttatgctatataatttcataatggtgataaaatccaggcagctaccaaaaggagagctcccaagtgatcttactactgggtttccgtagtacagacattcaggatcctggacccgctgaagccaggggaggaagcaccctggcgggtcactggctgatggaaggacaggcgccgtgatggttaagtgtgtccatgttggctacctgatttcttttcagccagtctcagctttggttggtttgtttgactgcctcaaatcctcggtggtcacccttattttttatctggaatgtgttccccactctgtagaggactgagcagggagattgctgtgcatccttgaagggttccattttgaccctgatcatcctcagtagacatggaagctactccaagcgtggccttggaggtttggggaccctggacagcatacaaatggaggggtgaggggcagccgagggaaagaaattactcagaatatgcagtaagaaccatgtctggtttctggtttctgtgtttggcaacacagtaatgggattccttgcatttctcccagaaaagcattggagggg

SEQ ID NO: 232697 - DNA, 322 bp, Homo sapiens
gtccccagatcccaatttggtattcacatgtttgggaagagtggggggaaagtaaaatatttgtgtcttactaaatttgagcaaaggaaataaaatctttgtccattttttttcagtggtaacttatgttagtacttagcactgtgatttcataattataagtatctcatttgattgctcaaccaatcagttctcccatcttacagatgaagaaagttaagtacagggcacaggatcctacccaaactcacgtaactcagaatcatggaatctctggattttgaagtcctaatgtgtgccaccacctgtactgggcactgcc

SEQ ID NO: 232698 - DNA, 327 bp, Homo sapiens
taagttggttttatacaaagacatctggcacaaaatacaatgatatttcaatatagaatcacagcaggggatgagggtggagaaggaagagattaccagttctaagaggggagacaacagaagtatttttttaatgtcttattttaagagtaaaacacctgctttttttttgagatggagttttaggcgggagtgcagtggaacgatctcggctcactgcaatctctgcctccaggagaatcacttgaacccgggaggcggaggttgcagtgagctgagatcacgccactgcattccagcccggtgacagtgtgagactccatctca

SEQ ID NO: 232699 - DNA, 358 bp, Homo sapiens
tctcgaaagaaaaagaaaaaaaattttcatggtaattgccttattcaagtttccagctctagttgtacatagcattctcatttttaatctgtgttaagtaattatttcatattcttaattctaactttgatggcttttttcctttaaaaaaactttattgaagtataatttacatataataaaatgcacctattaagttgtacagtttgatgagctttcacaaatgccaccaccataaacaagatatagaacacttccatcactcagagaagtacactcatgcccctttgcagacaatcacttctacctctgcccaaggcaaccactgatatactttgtcaatttagatgaagatctc

SEQ ID NO: 232700 - DNA, 1696 bp, Homo sapiens
gacttgcctgatggtcactgccaggctgccttgcctgccttcagagctctagacagaggcccctttaaacttcctcctcggccgggccaagacgctgcaacagctcagcgcggctcccagcgaaccccgagtgaaccctcggggctttattttcatttcttcttggcaggacgtaacttcctgcttctaagaaaaacatctttaaacagagccacgaacggttccagggtgtcccgcacatcccccgctagacggaacaatagcgcaatgagctgcgtggagtggattggaagcacatggagcctgtttcctttcaaaatcccccaggggctcagcctggaggagccagggtgtttgataaatcatgctggaacttttatcaggtccagtgtgtgtgagcaaaagccagaaggggagggagggggtcccctagggcccccagaatccgggccaactggaggcctagacaagaggagggatctgagtcttgagcacctactgcatgcgcctgaggtgctgactcatccagggccagcgggagaagtgccccaggacctgccctgagccctgtggaggcagagacacagctgtcatagaccaggcgccactggggaatgtggtaaccaggaggaagggtcactgggtaagggggcttcactgttacctgtgcactctcctagtacgtgcctcttcagaccaagcagaggggaatttgtgcaagcccaggaggagccttctggattcttttcctttcttttcctgcagtaccggtatatcagggcctggcctcagcccaaagcgtcagggagctcagagcgaagtctggccttgggtcctggggaaaacatggaggcatggagtagggcgggaaggggcagtgaggagccgaggaaggaggctctgggagtcttaggggtcttggcagcatggaagtgagaggtgaagccagctggtcttctgggtcgggtggggacttggagaacttttctgtcttgctaaaggattataaacacaccaatcagtgctctgtgtctagcttaagttttgtaaatgcaccaatcggcactctgtaaaaatggacaaatcagcactctgtaaaatggaccaatcagcactctgtaaaaatggaccaatcagcaggatatgggcggggccaaataagggaataaaagctggccaccggcccaactgcagcaaccctgtagggtctgtttcgagtttgtggaagctgtgttctttggtcttcacaataaatcttgattctgcttagtgttgggaactgtgctatgtttgtgagctgtaatactgccaaggtgtgcagcttcactcatgaagccacagagaccatgaacccatcaagaccacgatcctaccgggaggaatgaataactccagacacgccacctttaagagctgtaacactggccgggtgtggtggctcacgcctgtaatccctgcattttgggggggctgaggtgggcggatcacaagttcaggagatccagaccatcctggccaacatggtgaaatcgtgtctctgctaaaaataagaaaaattagccaggagtggtggcaggcgcctgtagtcccagctactcggaggctgaggcagtagaatggcatgaacccgggaggtggagcttgcagtgagctgggattgcatcactgcactccagcctgggtgacagagcgaggc

SEQ ID NO: 232701 - DNA, 479 bp, Homo sapiens
agacacttggatgaagagatttatgactctggggggctgtgaattcctaatgtccttttgagacatgtagatcttccagagcgatgctgcccaatgcagtagccactagccaagtgcaaatggtcacttgcaatatggctagtctttgagatgtgttttaagtgtaaaatacacactgaattttaaagacttagcgcaatacaaagaatgtaaaatatctcattatatcttgaaattatactattttggatatatggtgttcccttggtgtctttggggactggttccaggatcctagaggatacccaaatccccagatgtcaagtccgctatataaaatgtcctgtagtatttgcatataacctacacacatccttctgaatactttaaatcatctctagattccttgtaattcctaatacaatgtaaatgttatgtaaatagttgttatactatattaaaaagttttttattcttta

SEQ ID NO: 232702 - DNA, 329 bp, Homo sapiens
acattaaaatgtgtggaagaaggtactatagtgctacacatttcactaattttgttttgggaattacagttggtttttataaaaatatttatgttaatatgggaatttactttttttgccattactttcagtggcaaaaactgcagttacttttgcaccaacctaacatatgaattgataaatatttttacaatttaatttctaatatggtaaatatcagtaaatataacacaaatctttgtagtcttcaataagtgtaaagcaatctcaaaaccaaaagtttgaggatcactggtataagggaataaaggaacttcatgtaaaagcct

SEQ ID NO: 232703 - DNA, 419 bp, Homo sapiens
ttcatctcctccccttcctggctgcattcctgctatccctggaacgccctaagtattctcctgccccagggactttacacttgctgttcccttggcttgaaatgttcctctcagacattggctccttcctccccgtcaagtccttcaggtcttggctccaatgtcaccttttcagcaatgccatcctaaccaaaccatttaaacctgcatcctggctgggcgcagtggctcatgcctgtaatcccagcactttgggaggccgaagcaggcagatcacttgagctcaagagtttgagaccagcctgggcaacatggtgagaccccatcgctaccaaaaatacaaatattagctgggcttggtagtgcacaagcctgtagtcccagctactcaggaggctgaggtgggagggtagcttgaa

SEQ ID NO: 232704 - DNA, 300 bp, Homo sapiens
agcttacagtgaatccttctgaaggctttattgagtactgtgtaaaaactcttgtaaaaatatagaaagattaactgtagaactacaatgagttttgccctttcgccttgcttatatggagatttatttgtcattgggattctatttctaaagctggcactttgctactaaaatgggatattacaaacatatttttaaatttaatatcaaagcctgttaattctcatgagactcttaaaattattttctcttgacatttaaagagcaagcacaccaaatatactgaagtatgttaaaata

SEQ ID NO: 232705 - DNA, 526 bp, Homo sapiens
tctccaaacactgacaaatgtaaaaaacaacaacaaaaaaacacctcctgttagaacgactgatttagaacacagaaaaacttgcaaacttaaaaaagcagttcatttgcttatacaccttatgtctccctctatgctacttatggatttagaaaaattctctaattcagtctcttttagtattcaaacaagcatagtattgtgtaaatgagaaaatgttcttaacgactaaaccataaaatattgttaaggatatcaagaaatgaagatactttaaggagctacctatcatcccacattaatcgacataccagaaaacaaagaatatatcctatatttaaaccattctaaaaaagaacccaggtatcctactaattatttaacattgtaagtaacaatggtaagttaagtgcaatgtttaatatctctctggtacaatataagattgttatgatatgtgatatgtatataaaaagtatttaatatgatattgactaataaaaatagtctttttatcttctgcaaa

SEQ ID NO: 232706 - DNA, 235 bp, Homo sapiens
tgaggtgaggtggcttatgcatgtaatcccagcccttgggaggatgagggtggaggatcacgtgagaccccgtctctacaaaaaagtttgtgaaaattagccagccatggtggcgtgtgcctgtggtccccactactgaggtgggaagattcctgagccaagaagatccaggctacagtgagctatgatcatactactgcactccagcctgggtgacaaaatgagaccctgtctc

SEQ ID NO: 232707 - DNA, 180 bp, Homo sapiens
ctgcgggtaagggacttgtcttcgtcacttctgtattcttgaaaatgtttacttatttattttagagacagggtcttgccctgttgcccaggctgggacctcagcctcccctgtagctgcaccactacatgcaccactatgcctaatttatttatttattttttgtagagacagggtctt

SEQ ID NO: 232708 - DNA, 805 bp, Homo sapiens
aaaaaaaaaaaaaaaaaaagagagaaagttacatcttattctataaagcttctttcagacccaagggtcaccataacctcaggatctcagaccttgcatctctgtcttattaactgctctctcaaccagaaagacattccttaggggcagagttcacaaaccaacagtccagaggcctgggtatgggtgtgttttttactgatacctggcgctaaaatggtttgagttagctgccacttttgagatggtagatatttcctatgaagttttggatctccggctttgattgaaaaagtgggcccattgaggactctgagtcagggttttcccttggctatggactttgtgagttgcaaagtgccttgggttcatcatggtttctctaaccttctagttaattcttatgtccagccagcttcattcatttctgtttggtaactggttcctgaagctacctgaagctacattcctgtttgctacctggtcctgcagactgctgagtttgagacccctctacctttgaggagatcttgaatgatccactgaggaacatgaggcaggtgatggaacccatggttggaaactggggggaatccctggtttgtgcagcttcttctcttctgtgtgctgcagggcctctccctgggatgtggccttatttggcaggtgtaagtgcattggccagtttggagggagatctgccccctactagctgtgtgaccttgggcaaattgccttccctctctggtcctctctcttctcttgtataaggtgaactggttggagtacactgatagtttagtta

SEQ ID NO: 232709 - DNA, 120 bp, Homo sapiens
cttcatacacgttacagcatatgccagttgtttgtttttattgctgtatagtattccataactgttgtagagttatatatgtatggaatctcacgtgtggaatgtataaacatcttgtgt

SEQ ID NO: 232710 - DNA, 428 bp, Homo sapiens
ataataagataaaagaaacaaattagaggcatttggaaacagaatttacaggatttagcttctgcctgcatctaccgtgagatacgaggaccgtgcctaaataataatggaggtggggacaatgatggtaagaagaggtagatttggatggagagaaagaaatagccatccaaatggatgtatccagtgagagttggacagcggagatgtgggatcatatagtagggctatgtaacaagtccctctatagcagggtttgtttaagctagactgtaagtacccagagccagtgagggtctggtttatttctgcatccccagagccaggacagtccttggcactcaataaatatttgttaactttgaaactggataaagacctttaaggatggtagaattttttgaaaaatgttcaaagacagaaagcaa

SEQ ID NO: 232711 - DNA, 94 bp, Homo sapiens
gaggagtccatgggctgcttgctgtctctaaggggctcggccatgtgccttgtaatgccctatctgctgactcttagcccctgctgttggcctg

SEQ ID NO: 232712 - DNA, 387 bp, Homo sapiens
gaccagggatgctccacaaagcaccggccggccgccgcgaagtgtcaaagtcatgggagacaacgggaagctaagaacccgtacagactgcagttgcctaggagacgtgacaactaagcgctctgtgccagccgagatgagaccccgggactgaaaaaaagctgcaagtgaggaaactgacaccattcaaaaaacgtctgtcgttaatatcagtgtcaatttactggtttcaatcattgtacttaaaaataccaccatcagggaagacggatgaatgatctgtatgtctgtagacatacaggggcattctgtactattcttgacattttttttctgtaactttaaaatcatttcagaataaaaagcttaaaacattgaggttgtaaa

SEQ ID NO: 232713 - DNA, 586 bp, Homo sapiens
atgaagtgagtcttcactgatctctccatattttgacattttacagcacttattatctctactttgtattttgaaactgaatccaaaatagttttgcatttgttgtttaacagtcatgtatgtagttttttttttttttttctttttttttggagacagagtctggctctgcactccagcctgggtaaaaaagcgagattccatctcgaaaaaaaaaaagtgtatatgtatagtgtatgcatgcacagaatactttacagcaataagaatgagtgttctgcaaatatacacaatattgctgactctcccaatgttaaacaaaagcatccagacacacaacaatgtgtacagtatatgattccattgatagaaagcttaaaaacaggcaaaattaattcacccttatggagtcttaagtaaggggaacaaaaggggccatctgggcagtgataatgctgtttcttgagctgggtgctgggttcacaggtgtgttcagtttgtcacattcatcaagcttacacttctcatacatcttcttttctatatgtatgtcatccttcaataaaaagtttttaaaaaataaata

SEQ ID NO: 232714 - DNA, 580 bp, Homo sapiens
ggagactagttatatcctttccttttcactcctagcattcaatgattaaaataattttttctcactcgtgacttttcattttaagttttcctgatcatgatatattgttttcttatctttcaaatatttgggcagaaataatgtgattgtgtagtacatttatcttggaatgtgtaatatatttaaattatatttatataatgaaccattaaactttaatagcaattaacattttgtgagaaaattttcacagctaccaataaataattgctataattagattattttgtggtaatggtaaaggaacgttacttattatagcataatttacatcataatactatgaaagtattcttaaacttaaattggaaatgccacagcatctttttagtaaaataaatgccaaatgctatgaactaataaatgaaacacaaaatttagtaaaatattaccaataaggattttttctttctttattttaaggtattttctcaggagtacatgaatgaaaaataacttctaatattagaaacattgtttattgttacatcaataaaatcttttgcttgttgaatttgtt

SEQ ID NO: 232715 - DNA, 496 bp, Homo sapiens
cagtttcatcccctgtggtgggagtggtctgggcaccctacttttcaatcaagacgaatagagtgggggaactcttcaaacttagaaagggccaggggctgtgctaacatgtgttcacctcctcaggtttcgaagcgtgaggcatcacttccatggagggttccaggctttgaaacctagcaagagtgtaaagggcttttgctgaagttatcccaaacccagccagttggtaaccctgaagatgggctccagtgtccttttgtcatatttctgtcagttttgagtattttcttgatttatggcacaccaaagtgttccacattctccctggactttcccagtccctgtctgtaaccagctgtatcttcaaggaatgatagttctttttttagtgaggaatggtatttagaaaccaaaatctggactctagctgtgctcattcacactaaatgttattgcttctaggcatttcagtgagcagagttagaaaaaaaaa

SEQ ID NO: 232716 - DNA, 371 bp, Homo sapiens
ctttttttggtaccattactcattttttaaaaatctcgtgtgttctacttcaataacgcctttgttcttttcagtgctgaagttatcccaaacccagccagttggtaaccctgaagatgggctccagtgtccttttgtcatatttctgtcagttttgagtattttcttgatttatggcacaccaaagtgttccacattctccctggactttcccagtccctgtctgtaaccagctgtatcttcaaggaatgatagttctttttttagtgaggaatggtatttagaaaccaaaatctggactctagctgtgctcattcacactaaatgttattgcttctaggcatttcagtgagcagagttagaaaaaaaaa

SEQ ID NO: 232717 - DNA, 365 bp, Homo sapiens
cagtttcatcccctgtggtgggagtggtctgggcaccctacttttcaatcaagacgaatagagtgggggaactcttcaaacttagaaagggccaggggctgtgctaacatgtgttcacctcctcaggtttcgaagcgtgaggcatcacttccatggagggttccaggctttgaaacctagcaagagtgtaaagggctttgtaaggcattcagtgattcgtttcctctcgtgggccagctgccatgtcagggaccaaggatacagaagtgcagggcagccccgtccttgagtaattctgcagctcatgggacagagaaacacacgaagcccagcaccatctgtctgccggagcttggtgctgtggg

SEQ ID NO: 232718 - DNA, 531 bp, Homo sapiens
caatgatacatttcaaatgagttgtgctcagtgaaagaagctagtctcaaaaggatacacactgtctgattccacttatttgactttctggaaaaggcaaaattataaggacagaaaacaaatgaatgttttcccaggggctggaggtgattgggagggtccactacagggggacttgaggtaactttttgggatgttgaaactgttgtttatcttgattgtggtggtggttacataattgtatgtgtttgtccaaactcatagaattacacattaaaaagggcaaattttactgtatggagattttatcttaatgaaaaaatctgaccaaaaaacccatttgataaaaatgattaataagccttttggattaacagcgatatgtttaggatacaatactatcttcactaaccggtctaggactgtgaactgtaactctttagaatgtgataacacaggaaaattctgagtcatagtttactgaatggaaatacttttttgatttttcaggtcttatgaacttacccggaa

SEQ ID NO: 232719 - DNA, 523 bp, Homo sapiens
ttttttttgttttgtttttgttttttgccaatggtcacagtttgttattgccttaaaatttagcaattggcagcagaggacagctgagataatgagactttgcagtgtctttccctgacgaaggagattgtcatcactccatttaatgtgttcttttccactagaagcaggtgcagcagcctgttgcaatggaaacagcagctcacctggagccaggcagatcaccattctaatcccagctctgccacctgccagctatgtgaacttctgcaatctacttggtctatctttacctcagtttcctagtacacacggctgctgtgaagattaattacaaacgagtaagataatgatggaaggatgctcagcaatagtggggtctcaataactgggtgtttctccttctcttcctgtttttagatctgactgttttcaccatgggcattaatgattgtgttttcaatcactagcatgaagttcaaggctctgttactagtggtaatgggagatttaatggtaatat

SEQ ID NO: 232720 - DNA, 475 bp, Homo sapiens
atggaggttgagtgctgatctgccatatccacatcatatctcctttagactctgacacaagaggtggcctttccctgaaccctatgttttagaagatcctgaataccacagatgcaatatgagtaaatttataaaaacacatttgtgctcctatctcttgggaacctatattcaacaatggcacagcacaactcataaaccaaagcattagctcacagacattgttcgggcctcagagaagtgtttctcaaggtcacttaccatatattcttgaaaggaaagatggccaagtccaaattccatgtaagtttgtgaatggagccacttcagactttgggggtggacacaactttgcacagaagacctgaaaagtgaaaatatttgggaaagagaaaagataaaattactaccttgtgaattttttcctctcatgaataattttttggcattattaaagcaccagatttccaggaat

SEQ ID NO: 232721 - DNA, 532 bp, Homo sapiens
acattttctttagtacactcaataataaagattttattctttccaaattgatctacagagttggtgtaattccaatcaaaatctccacaaggatcataaaatgtacataaaagtgaaaaggatcaagaacagtctcgacctcttgcagaaatattacatgggcagatttccccaatcagacatcaagtattattacaaggctatggcaactagaacggcataatcctgtggcatgaagataatcagaaattcaacagaactgagcccagaaacagacccacacacggagacactcaacatgtcagaagaggatagcattctcagtggacaatactaaggcaacaggttctccacacggtgaacaagaaactgaattccctcactcaaaaaccataaacaaaattcagtgccaggtagtatcaaagggcaaaatcataaataaaacttttagaagacaaagtgtttatcacctcaggctagggaggaattcttcctttatgttttctttttctccttctcatgtaacacttta

SEQ ID NO: 232722 - DNA, 223 bp, Homo sapiens
aagcagggtgttttggaagacatttcacacgtctccaccaacgggtggatctaccctcaatagacagtacaggtgggagcctttccaacccactgcacacctgatctgtgatggctgcgactggcgagtgtgtctgttttggaaaccttagcagtacacatgttttcctgtgtaataaaacattttgacagttcagactatgccaaataaaagttttcatctg

SEQ ID NO: 232723 - DNA, 392 bp, Homo sapiens
gctaaaagtgaacctaatatctttaaatgcctatttctgcacagtacctttataatgtaatagcagctaggaaatggtatcatagagtcactgtttccacagactgtgggcaagttaaagatggggtaggtattgtgtgcataacagcatgggacacctccattgccccagaagggtgtcagaacagcttttcccaacacgcagagtctgccccttggcccctgaagtttcctctgttacaggaagggatatgctgaagaaagtaaaaaaagactggccaggagcgatggctcacgcctgtattcccagcactttgggaggccgaggcgggcagatcacgaggtcaggagattgagaccatcgtggctaacatagtgaaatcctctctacta

SEQ ID NO: 232724 - DNA, 331 bp, Homo sapiens
  misc_feature (13)..(13): n is a, c, g, or t
ggatacagaatcntgctctgtcacccaggctggagtgcaagcacaatctcggctcactgcaatgtccgctgcccaggttcaagtgactctcgtgcctcagccccccgagtagctgggactacaggcgccaccaccatgcccacctaatttttgtatttttagtggagacggggtttcgccatgttggccaggatggtctcaatctcttgaccacgtgatccacccacctcagcctcccaaagtgttgggattgcggatgtggcccatcgcgctcggcctattctagcttttcttaactgtactccccttctgtcgtcttcagcagctttaa

SEQ ID NO: 232725 - DNA, 349 bp, Homo sapiens
gtttacatcattaatattattattgaaaataaggtggaaatgctgaggaatttggattctactccataggcagtggtcaaacatgcttgaggagctgtaatcaagttgtccttagggaaaaatatttgcacagcacatagaagacaaataggagaggaagctgctatttattgaacacctactgtatgtagcacatgctgaaattatgcacacattttctcatttaatcttcaaaaggaacatattaagtacattttacaaatgaatctgacaagtgatttcttgcatttccaggtttaaacttagatctatctgactggaagaaaccagcgggaggttttttgtgtgt

SEQ ID NO: 232726 - DNA, 423 bp, Homo sapiens
atctagtagtaatagaataattggtagataaacaagttttattacatttttccccaaattatttaaaatagtaaaccatagcatattaatcaaaggtagttttgtattatttgtgataattttgagtaaaatagaaatgatgacataattacctatttggctggttttattcatagggagcatcaggtacatgtgcatcacacatctttggttcctctttttttaggtgaatattagactgtttaagtataatttttattgtagatcaaatattttgtgttgaaaaatagctccaacattaattatggtgaaagtcattgtcaaactatattttgttgtataagttttccttttacaagttcatgatgaatacaactgtgaaagctgctattttactgggattttaataaactgttcaatcta

SEQ ID NO: 232727 - DNA, 381 bp, Homo sapiens
cttagtatatcgagagagtgaaagttgatcccccttcttgaagaggggagtgatgaggggagagtgcaatggcaagatctggaagaatggcaagagggtccaagggtctgtcatcctccaccaaggttcaagacagaaccttttgctgggtcacctcaatctgccagcaatggaagatgagtagctgtggggacatttcataaaagcaagtggtttttttgttttgttttgttttgttttttgtttttttttctagaacaaggctgtgcacagtggctcacctctgtaatcccagcactttgggaggctgaggcgggaggatcacttgagctcaggagttcgagaccagccagagcaatataaggagaccccatctctaca

SEQ ID NO: 232728 - DNA, 794 bp, Homo sapiens
gtgatgtttccaactttagatctgttggaagaaagaagaaaggacaccctctctccctccatattctccccctcctgtagaaatttcttctgtccctggtgtattaactccgggcgagcgtagcataaatcaatcagcaggtagagattagtttagaattcaccagctgttcctccctgtaattggatgtaactatgcaggacaccttttgaaacagttatccagttactaaatgccagacctgtcatgggtcttcagctgactgcgacggattagcccctaaagagctagcgatttagcagcctgcatctccgccccctttgccagggagagcctgggaatgggctcagtggtatgctggatgcttctttcagcttgcagaaaagaaagctaagatagatcatagggcagggtttgcctttctttggaggaggtttttgtagcctttccccattcctcagcttcatacagtgagtgagggtctatggaagtgttctgtgcttctagtgttttttgtgttctctggcactgcttcctgacatggggtagctcctaggaaacacttgatgagaatggttttaggagaggtctagattgcagacagctgcagagcctcactgtagggctggtaggcttctgccttcagacagtcttggaaatgtgaggtggggttgcttatggcagggtcttttatttatttttcttggattactcactgcccattctctgcctctacaatccttccttttccatgtcagtatttctcccttgccccatgccttgaaggagagaaa

SEQ ID NO: 232729 - DNA, 411 bp, Homo sapiens
aaagctgtgcttacaatataatagccaccaaacccaggcaagtctctctggaacacctgcagccctcagtgaggatcagccaccactgtcacccagactcctacgcaagtacaagtgcatcatatgtcattattctgaacattaaggactattcttcattatgttagggattaaacattcaagcatcttgcctttcccttttcctcccagttggccagttaactagaaagtaggaaggggccaggcacggtggctcttgcctgtaatgcctataatctctattaaaaaccaaacaaatcaatcagatatggtggcacgaacctgtggtcccagctacttgggaggctgaggtggggggatcgcttgatcccagaggatagaggcagcctgggtgacagcaagaccctgtct

SEQ ID NO: 232730 - DNA, 484 bp, Homo sapiens
cagctggtggtgatggcagtcacggtgacagctggtgatgatgttggcgagggcactgatggcagggtggaggtgacagtgttggggttaccataatggcagtggagatgcagcagtgggaggagccccaaaggacctcgagtgacccttctcttcccttggaaattccaggccatcaccgtacccacccccccgccagggccttgccgctcacactctcagatcagtagattctggcctctgaaaattaacctgccattatcttggcaatttctgcagtttcaggttaaaattaaacaagttcaggcctctgcaagaacagactattaatcctttgatcctttcaacctgtaggtaattatttcagtaattaaagtattatgatgtggtttcttgtgaaaattgcatggcaaattgctttgtaatgaagttttcacacatattcaaattcagcaagcttaataaaggtgcaagcctctaaaag

SEQ ID NO: 232731 - DNA, 720 bp, Homo sapiens
cagacatccaaaagattaggagacactataaacacttctacaattaaatttcaccttttatgtgaaacagacaaatttcttgaaaaatagaacttgctgagtttcacgaaagaagaaatatacaaaacagttgaatatctactaaagaaattgaatctactattaaaatccttcccatagaatatgttaaggatgataaatatattgtggatatgaagaagaatgaccctatattctagagatataaactacacaacggtagtaaaggccacgatgtctctaatttacttttaaatttgctaaatatacctaatctaagaaaaataaaaatatatatacaggcatatctttggagatattgtaggttctgatccagaccactgcaaaaaagtgaatttgatgataaagcaagtcacacattctgtttcccggtgcatataataattacgtttacaccattcatagtgtactacgagtgcaatagcattatgtctttaaaaacaatgtacataccttaatttaaaaatattgctaaaaaatgacaacgatcatccgagccttcagtaagtcgcaatctttttgctgttagagggaatactgcttttatgttgctggctgccgactgatcagggtagtggttgcttaatcgccatctaccggatggcagcccaaacttcaacatcaaaaatactttgcaaccctgtgaaaccaatgccaaga

SEQ ID NO: 232732 - DNA, 529 bp, Homo sapiens
cactatataaatcattttcataatgagagctgttcataatctacctctccaatattaattttttaagttaggtctgtgtaattatgaatcaggaaaatattcttaatttcagtttttgtaagggaacacctatttgtttttatgctgtgttttatcattgtttttccttagtgaatttaataaaatgttagatttctaatatcgatcttccagtatatatattagacttttaattagatctctttagttaacccttattcatctttgtcaaagcgtattttctactgcaaggaattatgatgttttcacctgtgttgtacctgattagtagcatcaggatactaatgggaattacgccatttgagctatagtaaaattgctttagtgttttctgctggttatataggtcatgggatacttgtgaagctaagtcaccttcagccagctaactgaagactaaaatgcttttgcagatttaaacacaaacagatgtggagttaataaaattattttgtgttccacaagttta

SEQ ID NO: 232733 - DNA, 377 bp, Homo sapiens
gcgaggcagtctgatggctctgccattaactaatgagagacttcaggcaagtcccttctcctctctggacctcagtagctccgcctttacaataagagggttagatgagacttccaaccctgaaatgttttattttccctgatagtttctatacaaaggacagtagacaataaaaaagataactgacctctggttcaaatctcagcttgaccacctatgagccaatcgaatttggacaagttacttaacctctctgcaacttaatttcctcatctgtataataggaatactgttttacctacctcagagggttgttgttaaggattaggtgagataatgtatgtaaagtgtttaacacagtgtttgtcactttcagt

SEQ ID NO: 232734 - DNA, 455 bp, Homo sapiens
tatgtaactcaaagagcagtgacaatctgagcccatggcatgctggatctgtaagtccacagcatcactgctgaacaggaaagcaagcttgacaacctgcttgtccctcctccagaaatagtgatgttgccctgacttcttgatattttaaattctgaccttaaatagttcttgctctcaggtgtaatgtcaggtggctcacacctataatcccagaactttgggaggctgagatgaaaggatcgcttgaaaccaggaggtcagaccagcctgggcagcaaagtgagatccccatttctacgaaaaaatagctggacacagtggtgtgtgctggtaatcccagctattcaggaggctgagacaagaggatcacttgaacccaggaatttgaggctgcagagagctatgatcacactactgcacttctgcctaggtgacagagcaagaccctgtca

SEQ ID NO: 232735 - DNA, 452 bp, Homo sapiens
actttgctgtattataaactacacattcaatgctatggtgactacctgtttttaaaagctaattttacttttttatgattttaagagatttacaagtcaaaaataaacttttttgttgggtaaatttattattaaagttgaggggaaaaaagtaatgaattaagtatgcatttctcaaactgtactttagttcttttggaaacagtgatccattccaaaaaacactttctctctgaagcctttctccactccctcaggtggtgttacggctctcaatgctgtgttcctctggtactctgtataaatcaatgtataattatatgctcctcattttttgtcactataattgttaatatgtttttttgcatcaccttatatgtcttaaccatccttgtatattgtcacaaaatcccatatatagtaagtgtcattaaagacatttcactcccttt

SEQ ID NO: 232736 - DNA, 482 bp, Homo sapiens
tacctccctgacccattttcctcactaaccgccccttcagtccctcctccccgtcttctctcccctcctcccgcacccacccatccctcttccagggccccccccaggcgcgaggcggaaatgggtcaccgacccgcgggtggaatgggcggcctggggttactgggacggtgagtaactgccggcccccgtccgcaatcgggctccctccgtcgggcgcgagggggcaccccagggctggggggactaggttcctccaaccccggggggcccctacacccagccctgggctcccgattgcggtcccatcaccccctcctggcggcagaagtctcccttgcaatgtttcaggcggggacctccctaaaggggtcctcgggggctgtgccccaagtcgaggacaccctctccagcctgaaaggggactctgctgcagggccggggagatgggatctcctaggggaagaggcgcggtgcggccg

SEQ ID NO: 232737 - DNA, 360 bp, Homo sapiens
tgtattaattgagctgcagtcatcctcctggcgggcaggcagccagcacggggcgtaccgccctgtggatacagttccttcaggctaccagaactatcgtcagatgtctatgcctacccatatcaactggaagtcccactgccctggaccaggcacccaggcagggcatgtggtttttgatgcccgtcagagacggttggcagtgggcaaggacaagtgtgaagctctgtctcctaggcgccttcatcaagaggcacccagcaactcggggaaaccatcaaggagtggggatatcagaatgtgatgagaaccttggacaaagaggggacaaaagtgcatcaggaataaagaggcgagaga

SEQ ID NO: 232738 - DNA, 409 bp, Homo sapiens
cagcaggaatcacttgcatggaagtctgtggacaaactaggctggctcacctgcctgcctatgcaaacacccacctcccacccgggagtcctggagggagatatggtgctatcagtccttcacatgctagtgagaattagcatcatcttgctcctagaagagagtcattactccgaggattgagatcagccttctcagcagagtggcaggggaagaggagataagtaatttgaatgtggtgtgttttatggggacggggcaggcctccatggtgtgctagaggtccagggtcccaggagaggggtgatggggctatttaccaactaccatggaagttattttaatattgtgacagtgcacggcttgccagtgcatacccactgcacatcagagctgcgggcccacttgg

SEQ ID NO: 232739 - DNA, 485 bp, Homo sapiens
tagcaggcactagcaaggttgcattttcaggcctccgttgagataagtcagcttcatttatttattgcctttgtcattcttctcaggattcatattccgaggacaaagtttctgattggtttggctttggttgtatggttagcccagaggtaggggagaggagcacatcaggctgtagcacacagtgggacaagagcagttcttctatagcaaaatcatggggctgttaacaggaggtggaatggctgtgtagtggctggaagaaaacagcaaaggctgtgaccagagtctgctctgctaaggtgcaaaggagcttgaactatgttggagtaggatcattctcctgaatgtggccaagaacaaccatcaaaccaaaatcaaacccccttgttagagactgaaagtgtggtgaaatggaatacaagatagtaacatgactcctcttgaaggattggataagctagtctaggtttgaaatctgagga

SEQ ID NO: 232740 - DNA, 298 bp, Homo sapiens
cttctgattggctggaatgaagacagccctcgtcagacactaaatctgccagcaccttgacgttgagcttcccagcctccggaactatgaaaaatcaatttcaggactttataaattattcagtctaagaaattttgttatagcagcaggaaaagctcaggacagtattcaataactatttgctgaatgagtgaacagtagtattttcgtagcacatttagctatattctaatattgttgttattcaaatattctgtattcctatttgtatgttaaagtaatattttcataatctaca

SEQ ID NO: 232741 - DNA, 1514 bp, Homo sapiens
catccaagattagaattcctaatacactttctatagaagcgggttgtaggtaattggacatacaaattgtttatataggaagctaatagttacaataattatattttgagttagggcagtctacttattgtattataagattttagttaataaacctaattgtttgagtaagaataagtcaagaagtgtattcaatcacttagatcagaggttattttatatgaaattaataaaagtagaaatggttggttgaaggtagggaaaagcccagagttttatttggtcatgctcccaatcaccctcctccatattgggggtggggagtagcagtggtgattacttcttctctattaatagttgcagcccttgagcaataataaataaatcaatgtgatataaatattagaaacatgaactgggcagaagttttaaatgaatgaaactttatttgcaggacactcacttatcttgtattatccccatcatggtggttcccacccctctggtatctagtgatgttatgtatgcttcctgttttctcatggtattcttcaaattacccagctcttttcttttcctcttcttatttccatacaaatataactggcctgttttgtcactagttgacctgctaatctctggtaagctgtttaccaatgatactgttactctgaagaacgctatttgcatatcaagacgctggtcttgcagaagtagtaaattaaattcaaaatggtcacattattaagattatggaatgttgggtgggaaactattttgagcaggataattttttcattttttatgaattttagcatgtaatccacaagccatttcatatttatgaaaacagctgtagtgacctaacatgtataaattgaagtaacattaataatgaatattataacctttatgaaataaggcagaactattcctattttaatttgttcatctgtgatcttttatctgtctcctatggcagatttgcaaaagtagtgtttgtagtctgtatcatcattgttatttcatagattctcaaatcataatgctgagtggtttaataaaataatccagtggtacgaattaaggtacatataataatttcatttgaaagttttcatttcctttttaaaatgtgaatgattaggtatgtaaactttatgtgaatgcaggccacttttttgaacaaataatagaagattttaaagaaaaataaagatatcatctcatagaaatttaaattcttactggaagctgggcatgatagctcacgcctgtaatcctagcactttgggaggccgaggtgggtggatcacctgaggtcaggaattcgagaccaacctggctaacttggtgaaaccccatttctactaaaaatacaaaaaattagccaggcgtggtgacacgtgcctgtaatcccagctatttgggaggctgaggcaggagaatcgcttgaacccgggaggtggaggttgcagtcagctgagatcatgccattgcactatctcaaaaaa

SEQ ID NO: 232742 - DNA, 392 bp, Homo sapiens
aacagaaggctttaaagcaaaaaggtttcatgacccacctgagtcatgtggacttttgatctaaaagacatagcctgctcatagtcacatgtcatccacagtgttatagtggagtagaatgtaattgtcagaaactgaggtgtaggaaaatgggaagaagagatacaatacaataaaaacggaaacgcatgcagtaacttccgtaagcaatgagaagcctgcaaaaattactacttagagcaatgccaatcaaatttgcattttaagaatattattctggccaggcgcagtgactcaggcctgcaatcctaacactttggcaggttgaggtgggagaattccttgaggacttcttgaggttcttgaacaacatagtgagacactgtcccaaa

SEQ ID NO: 232743 - DNA, 366 bp, Homo sapiens
tgcactttgctttttttcagctaacattatatcttgggatttccaaatcagttcaaagagattcctgaagttcttctctacagctgcataatatatgtagatataccatatgttattcgtgtgctctcctctgtatggacagttagtttttttctaatattttgttttaataaaaatgctgcagtgaataatattgtgaatatgtatttttgaaatgttgaagatgtcttcagcatagattttcagaagtgggattgtgggtcaagaggtaagtgcatttgtggagctactgggtgtgatcaaattttccttcagaaggattgcaccaatttgtactcctaccagcaatacataggagcatctttc

SEQ ID NO: 232744 - DNA, 538 bp, Homo sapiens
agaaaagtgggttcgagtaagtagaatttatatagagagaacatttcaaaaaactgttaaagagtatcctcaaagagataagagaaggtgttactttcatgaataaaggcagtaaactacttgaaaagaaagaacgaaaaaaaatgagttcttggaaaataagaatatagtagttgaaatgaaaaatttagttttaaaaagatgataaaatagaggcaaactcccagaaagtagagcagaaagacaaagaatagaaaatttgaaagaaaagaaaggggtcatgttcaggaggcccaatatccaaataataggaaattcagaaagagagaacagaaaaaagtagaggatagcaaatcctcgaacagtattttctagaactaaattgatgagttttcagttgacaggcctctcaagagctcaatacagtggataaaaatattcccataccagcaggtatcattactaaaatgcagtgctgcaaacagtggaagattctgcaagcttcctgagaaaaaaaattaaagcttcctgaggaaaa

SEQ ID NO: 232745 - DNA, 205 bp, Homo sapiens
atgtaatgaattaattttattttgcctgctttcatttttttctttgactgtctttgattcttttcttacagtgcgcttatgtaattgtcaaaagacaattttcatatttccaagcttgggcagctctgttcagaccgttcttcaccctcctgcttcaggactcatttcacgtaggcaacgctgtctaaagttcccaagggattga

SEQ ID NO: 232746 - DNA, 420 bp, Homo sapiens
tcagcctccccgcaggctcacacagggcacaggcctgaaagccctgagcccttctgccccccacacacctccacgtcccgcagggaacctgccccgagagcctgcgctggctgtgggagatgggaaggcctccccagggttcttggacctcagtctttttggccgtgctaaaaaaaatcctaggccaggcacggtggctcatgcctgtaatcccagcactttgggaggctgaggcgggtggatcacaaggtctggagttcaagaccagcctagctaagatggtgaaagcccgtctctactaaaaatacaaaaattagctgggcatggtggcatgcacctgtaatcccagctactcgggaggctgaggcagagaactgcttgacccggggtggtggaggttgcagtgagccgagtctcaaa

SEQ ID NO: 232747 - DNA, 425 bp, Homo sapiens
gtggagtattagctctattacttagcagttgtgtgatattgaccaaagaagtcggttccatgtcactgaactggggataacgacatctactccatctaactcatgaagtggttgtgagacttggatgaggtcaagagtttataaactctggagtatggagccctctttctgtcttgagcaaccagaaacatttttgtgcctatgaaagaacttaaagaggaaatacaagtggttaagagctggagtacaggagtaaaacagacctgaatttgaatgctgttttgccgttttgtaaaaccttactcagacaatttgcttaacccttccaagcattagcagagtgtttgacacatagtttagtgcacagtaaatgttagtattaccatattgatggttttagatagttttgtagttaaaggtgtgtt

SEQ ID NO: 232748 - DNA, 439 bp, Homo sapiens
ggctgggcttgaactcctgacctcaagggatccacctgcctcagcctcccaaagtgctgggattatgggcgtgagccactgcacccggcctactcttgaacatttgcagtctgttcttcacactaaatttagaatgctttttttatacttcttttttttttttgagacagggtctcactgtgttgcccagtctggtctcgaactcctggcctcaagtgattctcctgcctcagcctcccaagtagctgggattatagataatgtcactgtgcctgtctgattcctttttaaaaaataaaatcctgtcactcctctgctccaaaccctttggtggctctccatttcacacattaggaaatctagacttttgtttggcctacaaagccctctgagtcccagctgtcactcagatcccatattctactgtaatccctgtctt

SEQ ID NO: 232749 - DNA, 2090 bp, Homo sapiens
acgcccagctaattttttgtatttttagtagagatggggtttcaccgtgttagccaggatggtctcgatctcctgacctcgtgatccgcccaccttggcctcccgaagtgctgggattacaggcgtgagccactgcgcccggccgacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcctcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaattcttgg

SEQ ID NO: 232750 - DNA, 371 bp, Homo sapiens
tgatgacggttagcaggcccaagtctgaggccttccaaagaaacatggtgcagcagtgggcctgagaggtacagaagagagggggtgacctgacaagagctaggtggatggacttcctccgacccaggaggggactgagtacctggtgctgccacaaggtgctctgcatgaggccagaggcttgaagtgggagtaggtgattgcaagtggtagctaactggcattctctgaaagtcagattgaatcactagattctgtttattaagagtaggactttcaatacagttttaaaaagctaccccttttcttaatttctcaggaaaatggcagctccttctttgtcgtcaaaataaatattcagccaagcctta

SEQ ID NO: 232751 - DNA, 307 bp, Homo sapiens
atgaaaatgccattggaactatagcccatagaagcagaccaagattacatgataaacctgggtgactgcctacaaaaataagagatttatataggacctgggaccttctgacaagctactataaaaaaaccacccatcattttaaaaaccacaaaaatcacaacttgaatgagaagagataatagatcagatcaacactgggatgaatcaggtgttgaaattatctgacaaaaattttgaagcagtttttttctttctatgagatggagtttcactccagcctgggcaacaaagagagactgtctca

SEQ ID NO: 232752 - DNA, 469 bp, Homo sapiens
aagacgaggagtagggacctattgaaagcccaggtcccccagtgacctgagtgcagaacgtaggctggtgatcagatggtcaattatgtgtttgtcaaaacacagtgggctgcattccaggctgccagctttggaagcccagcttctgccaaccaaatgtcatctgggaacatgcaacactgggcactgtgaaggagtttgaaatagaccatgccacagccaacctactgccagtcttatagcaccaatatggcatgcacagccgggccccatgtttcagagctcaggaattcactgtactaaattcaagaggtcagatgggttcatgttttcaaagcctatgttctttgctttgaacactgtgacttgctcctcagcaatttccaagggatttttccagtcacatctctgtggaaaccactctttttgtgatggttataagatccttgtaaatgtcccagaggatagg

SEQ ID NO: 232753 - DNA, 159 bp, Homo sapiens
ctgcctctttttctccatctgcttaacatgccctcactcccaaagctcagctgagggacctgttaagcctgaaggcttggcacttcagcacttccttttcagaaagtctcatctgtcagtaacctttgaagccttcaaaatctccatatccttccctga

SEQ ID NO: 232754 - DNA, 397 bp, Homo sapiens
  misc_feature (43)..(43): n is a, c, g, or t
cgctcgatctcgaggatcccttccagcaacgccaaacttccanccaacgccaaactaatgtttgtattcttagtagagatggggtttcactatgtttgcaaggctggtcttgaactcttgaccttgtgatccgcccaccccggactctcaaagtgctgggattacaggtgtgagccactatgcctggcctcagtttcttaaaaggttttaaatcacaccaactggtaccagtgcctctgattgccttgatttttctgtgatcccacttggaagtttgttaatgccacactccactatactccacacattagattgcagtgggggctggagagtggcccagcctttatacataactcccttctgtcgttctgctgtgggaccagtagggtccctgtgc

SEQ ID NO: 232755 - DNA, 364 bp, Homo sapiens
gagatggtcttgctctgctgcccaggctggagtgcagtggtacagtcagctcacttatgtggctcaggccggtcttgaactccggggctcaagtgatgctcccgccttggcctctcaaagtgctgggattacaggtgtgagccactatgcctggcctcagtttcttaaaaggttttaaatcacaccaactggtaccagtgcctctgattgccttgatttttctgtgatcccacttggaagtttgttaatgccacactccactatactccacacattagattgcagtgggggctggagagtggcccagcctttatacataactcccttctgtcgttctgctgtgggaccagtagggtccctgtgc

SEQ ID NO: 232756 - DNA, 344 bp, Homo sapiens
gtagagatgaggtaattgctggggtaggggtgatggtggagtggaggggtagtttcactatgtggctcaggccggtcttgaactccggggctcaagtgatgctcccgccttggcctctcaaagtgctgggattacaggtgtgagccactatgcctggcctcagtttcttaaaaggttttaaatcacaccaactggtaccagtgcctctgattgccttgatttttctgtgatcccacttggaagtttgttaatgccacactccactatactccacacattagattgcagtgggggctggagagtggcccagcctttatacataactcccttctgtcgttctgctg

SEQ ID NO: 232757 - DNA, 94 bp, Homo sapiens
cgcgcacttggcaactaaggagagttagcctgcaaagagaaatctgggatgggtggaatctgtgacttcagttatgacggactttcaggtgaaa

SEQ ID NO: 232758 - DNA, 563 bp, Homo sapiens
tttctattatgttagtccagcaatagagccgacctgacagtcttcagccataaccacagaagccagcattacaacccagaagctaaagttccaaatgtataacatgataaaaacatatcaagataagcttgattaatttagtaaaacattaccagtctctcggccaatacagccaacttcccagcagagacagcgagtcaggcctttaggctccctgggtttggccccgaatccccatacctcagccaacggcgcagcgtactgaccccagtctctgggtcagttcattttagacaacagggttgccgggctgccacagagatcagcaaacaaaatagtccacctgcaaggaacaggccttccttgtgacaaccgtgctacaggaaaaccagccaagttgccggaaccacagagtacaacaaagtttgggtaaaatagttgtggcaaaaatgaaattctggggctacatttccatcctgtatgaaactattgaacatccttggtcaacactctctgtagagatttgttttatgtaagttgtagttccaaaatgtgtggggttt

SEQ ID NO: 232759 - DNA, 726 bp, Homo sapiens
  misc_feature (639)..(639): n is a, c, g, or t
  misc_feature (690)..(690): n is a, c, g, or t
  misc_feature (711)..(711): n is a, c, g, or t
agttcggttttgctttcactgtgacaaagcagcatcaaattcaatgcaatgtctcacaatagctgcgctctccctcttccaagcacagagattctctctctacgccacaaagccactgccatgggatggggacaggtggcatcagcaactcaagactgtcttccctaccctcttcattgcctctttcaacagtatgaagttaaaatcagactacccaggcagggggagctgcaaagaccttggtttctctggcccttccaacagcaagtatcgccaggagcagctccctaatctacatactacagatctatccacaagaagacagatggaaccactcttttcttctgaattctagaaccttaaggaagttaacctgagtggctcagcttggatcaagtgcccatcctggtccaaacaactgtagcagcacatctgtgtatttgtgtatcttgttcctccataatcttgcagtccggggaaagtgtgcagatggatgggtccctgaaaagcaagagttgtttagacaacgctagaggtgttcagttctgggagacaagagttgggccaaggttgataactagcctaagagagtccggatcagatgaataagaactaagatcttgggtgacaacctagatnaagagtcttgaggttcagtcatttcaaaaaagctcaagtctcaatgcttcntgggcttcctgggtaaagatnaaggtgcaagtatcc

SEQ ID NO: 232760 - DNA, 707 bp, Homo sapiens
  misc_feature (421)..(421): n is a, c, g, or t
  misc_feature (453)..(453): n is a, c, g, or t
  misc_feature (471)..(471): n is a, c, g, or t
  misc_feature (488)..(488): n is a, c, g, or t
  misc_feature (495)..(495): n is a, c, g, or t
  misc_feature (522)..(522): n is a, c, g, or t
  misc_feature (565)..(565): n is a, c, g, or t
  misc_feature (578)..(578): n is a, c, g, or t
  misc_feature (591)..(591): n is a, c, g, or t
  misc_feature (614)..(614): n is a, c, g, or t
  misc_feature (630)..(630): n is a, c, g, or t
  misc_feature (667)..(667): n is a, c, g, or t
  misc_feature (688)..(688): n is a, c, g, or t
  misc_feature (702)..(702): n is a, c, g, or t
agttcggttttgctttcactgtgacaaagcagcatcaaattcaatgcaatgtctcacaatagctgcgctctccctcttccaagcacagagattctctctctacgccacaaagccactgccatgggatggggacaggtggcatcagcaactcaagactgtcttccctaccctcttcattgcctctttcaacagtatgaagttaaaatcagctctgaagatgacaatgcattcaaattcaccagatcacccccagctctgaagatgacaatgcattcaaattcaccagatcacccccagctctgaagatgacaatgcattcaaattcaccagatcacccccagctctgaagatgacaatgcattcaaattcaccagatcacccccagctctgaagatgacaatgcattcaaattcaccagatnacccccagctctgaagatgacaatgcattcanattcaccagatcatctantgaagtttcacttctgnttcttancacctccctgactcttctgttccctanagtggaaggagggtctgggaaaggacctttgcctgaaactaanaagtcaacatggntacccctcaatancccacctgggaagggagctgccnatgagccggaagcagntggggaggagatgaaactggggctatcggctttgcangctgggagccccctcctgtanctgccttatcttcnggtat

SEQ ID NO: 232761 - DNA, 425 bp, Homo sapiens
ggctggagtgcagtggcgcaatctcagcctcactgcaacctctgcctcctgggttcacgccattctcctacctcagcctcctgagtagctgggactacaggcgcccaccaccacgcctggctaattttttgtatttttagtagagacagggtttcatcgtgttagccaggatggtcttgacctcttgacctcctgacctcgtgatctgcccgcctcggcctcccaaagttgtgggattacagatgtgagccactgtacccagccttttctttttttaaacggagccttctattctagccacaagtgattaacgctacaaggctaaagcaataaattccatatagggctttagatctacttgcacaagtattgtgtcatttaatcctcccattaatcctgtgtattctgttaatatatgtggaaac

SEQ ID NO: 232762 - DNA, 515 bp, Homo sapiens
aataacttcatcagaactgccacggtggttgtaggaccattctgattccagaggtattaaaatgcaaaacacaatgttgaaatgcaaaacccaacaaaataataaacagccttgtacctaccgcctcccttaagaactaaaacaattcccaacaccactgaaagactgtgttcacctccttgatccaacctcttgcctttccaccccagagaaaaccactgtcctgaattttttcccactcccttggttttgttttaccaaacatgtatccaatatgtaacatattatttgtatttgatcttgtttttgaattgtcctgtaggtagaattatatcttattctgcaatttgctttttaaagtttttgaaagagcaaaacttatctatgctaatacgctaatgtgtgtagctgccatttatttgtcactgcatatacccctctcaattctgttgatggaaatttaggcagtttccagtattattttgctataaacattctcatggctgtctcctgca

SEQ ID NO: 232763 - DNA, 327 bp, Homo sapiens
agatgtcattgcttccaggaaccacatgtgaagacttgtcttcagattacccagtgaaaccacagaagaaatggagaggtcagagttccaacaagcaggatcatcaagaagagaggatattttctctgctgggttcataagatagttttgcaatcctaccaagtagggaggctggtgaattcaaagaagacaaatctatctatctttgtgctaattccgattttgaaaaaaacctatttagagacacatggcaatttaagaaagcaggaaaccaaagaacctggcattcttggaacaataaataaaaagctccttaaaagttaacaa

SEQ ID NO: 232764 - DNA, 158 bp, Homo sapiens
aaagaactgcatgtacacatgatgtttacattcatcttaagtaaaattaattgaccacattgttcctgaaattccttacatgcagggccaactcccttgaatcacttttttctcagttgtcgaagtcagtgacaaatgactacctttaccctctatcc

SEQ ID NO: 232765 - DNA, 311 bp, Homo sapiens
cctagctcatatagccagtggacattgtaaaagaaatgtccatgatattttaaacataaatgttcaatacactgaagttgacacggttttcacctacctgtattttcacatacagggctctgcagctttttttttttctgatagctaaagaacaaaatacatcattgattcaatcatgcatttattcaacaggtattttattgagtgcctactatgtaccagacactgttctaggctctggagagaaaaatagtaaacaaaacataccaaatccctgtccttatagatctttactaagacaataaacagta

SEQ ID NO: 232766 - DNA, 476 bp, Homo sapiens
ctaaccgattgcgacgagtgaaataccagaacccttcatgccaaagaaagcacttagcgcggggttgccacccagtaggttttcataaacgattgtttagtctgctttccttaaataaattggccatcacgtctcccgttagggtcttaatgagaccccaagaggcgtcatttgtataaaaagaaactctgtatatgcagtagaggaaagaaaacatatagaaaggagactggaaaagtgtgctcaaaacgctggtaacggttacctccagagaagagaacgatcgggacgatggtcaaagcggaccttacttcgagtttcttatttatctttttatttttaaacaaacattattggccgggcgcggtggctcatgactgtaatcccagcactttggaaggccgaggtgggagaatcgcttgaggcaaggagttcgagaccagactgggaaatatatcaagaatccatctcaaaaa

SEQ ID NO: 232767 - DNA, 737 bp, Homo sapiens
gccggccgcggagggcgcgccttggagggagaggactttaggtgacgccgccaggaggcgaaatttcacctgccagcagctctggaggtcaaaagaaatgagactgctgggctaagatcaaggtgtcagcagggctgtattccttcccaaggctccaggggagaatctgttcacttgcctttcccagcttctagaggttgcctacattccttggcttgcggacccttcctccatctccagaatcagtaacgaaagatccaaagccatatcctggctgagttggctgagttgagcaggacactgacaaggaggctgctgagcctgcaactcgactgttctgtttgaggagctctgtgctttatcatagaaatggatctggtgagtgcagagcccagggaatctacggaagcatttgcactgtggtatttcagcgtcgtcagtgctcaatcttcataaccctaaaaaacttactgagattggaaaaataactttcctactgtaagtctgaatctcttgaaccccttctcctaccttcacccactgaatccattgtttttatagttctgtgcttgacaacgtggattttcgtaagaatgccactgtcttttttttttttttagacaatatctcagtctgttgctcgggctggagtgagtggcatgatcatggctcactgcagcctcagtctccctgggctttggagatcctcctaactcagcctcccaggtagctgggac

SEQ ID NO: 232768 - DNA, 461 bp, Homo sapiens
gccggccgcggagggcgcgccttggagggagaggactttaggtgacgccgccaggaggcgaaatttcacctgccagcagctctggaggtcaaaagaaatgagactgctgggctaagatcaaggtgtcagcagggctgtattccttcccaaggctccaggggagaatctgttcacttgcctttcccagcttctagaggttgcctacattccttggcttgcggacccttcctccatctccagaatcagtaacgaaagatccaaagccatatcctggctgagttggctgagttgagcaggacactgacaaggaggctgctgagcctgcaactcgactgttctgtttgaggagctctgtgctttatcatagaaatggatctgaggtggggtgttgctttgtcttgtgatcgcagctcacggcagccttggactcgtgggcacgagcaatcctcccacttcagcct

SEQ ID NO: 232769 - DNA, 527 bp, Homo sapiens
agtatattaaagtatgtcaaatgtttatttttttccaacagaaagatccaaagccatatcctggctgagttggctgagttgagcaggacactgacaaggaggctgctgagcctgcaactcgactgttctgtttgaggagctctgtgctttatcatagaaatggatctggtgagtgcagagcccagggaatctacggaagcatttgcactgtggtatttcagcgtcgtcagtgctcaatcttcataaccctaaaaaacttactgagattggaaaaataactttcctactgtaagtctgaatctcttgaaccccttctcctaccttcacccactgaatccattgtttttatagttctgtgcttgacaacgtggattttcgtaagaatgccactgtcttttttttttttttagacaatatctcagtctgttgctcgggctggagtgagtggcatgatcatggctcactgcagcctcagtctccctgggctttggagatcctcctaactcagcctcccaggtagctgggac

SEQ ID NO: 232770 - DNA, 433 bp, Homo sapiens
gaatctttgctggttctcactcggggacacaacaagatgcagcacctcctaggtgtcatctagctgtttggaaagaatagaaggaacatttggaaacttaccaggtgctagaaggtgcttagtaacattcaacaacctatattctcctaggattatggactgctggcaatactcacggggaaggttttaaatggcttctcttcccatggtaataacatggaacttctgaaataaacagtcattagctctctgagttctgtctcagcttcaatcttctcttccttatttgaactttaggcatagaaataagagtaagaaggcattttggttaaaggatattttctccttttttaatcttccattcccttagagggaggtttatttctagtcagagaacataaaagatatacttttatttaagcaagcctgtggt

SEQ ID NO: 232771 - DNA, 855 bp, Homo sapiens
cagagctcagagactggatgtgagggaaaggggaatgaggtcatcgggcccaagcaactgggtggatcatggtgctgttgattgagactgagaaggctaaatgaggagcaggtactggaggtgtgggcacgagagcattgaagttgtatttcggccatgctgtatttacgatgtctaccaggcacccttctagagtctgcagctcagtagacaggtcaaggtgggataaaatttgggaatcattggtatgtgtgtggtattcagggaactggatgaatcactgtgactctaggtcttagagtgttggtcctcagctacgggtgatcttgcccccttcttccaggggacccttagtgatgtctggagatactttctgttactggtgatgggaagaggtacagtttgcttccggcatccactaggcagaggccagggatgccactcaacatagcagtgcacaggccagctccccacacatagagttacctggccccggacgtcagtggtgtcaaggttgagaaaccccctaccctagagtgagtgtagataaagcagaaaaaaaggaaagtaagcccgggggcattcttccatgcagagctggagaggaacagtctgcaaggaagaagggaagcttggagagtgctttttcttgggaggggagagtgtctggggaagaaacaatgctcagccgtgttacatgctcctaagaggctgaggcgtttgagcccagagggaagtgaccaatggcttaggcaagatggacattgttgatgactttgatacagagcagtctttgtggtttggtagggttggaagctccaggggaaccagcctgggcaacatagtgagacccca

SEQ ID NO: 232772 - DNA, 396 bp, Homo sapiens
gaaaaggagcaaaaagtgtgagaaaaattaccactgccgattctgctgcggactgtgggcctcctattctcatggctcagattcctcaacacattttcccgttggcccttttcttatctgacattgcatgatctaaaaatgtttggtgaattgtaaggtacttggtaatgttgttgttgctgctattgtaacaggtacagggcgatgaggtgtccttctcccaaccctcccacaggtccaaggacttggaagttaacttttgagagctgaacaataaaacaataaataattgatgacatttgtttaaagaaatgaccttaaaatatagaagaaataacaaagccaaaacattttcccatgagtttgcctaaatacaaagtaaaattttggcctcct

SEQ ID NO: 232773 - DNA, 417 bp, Homo sapiens
atttgttaagtgctttactagtgcccagcactgggcttagtagctttctcacatgattgtgcatgtacgtaatcctcccaagcaagttaagtattttattttctattttttacaagaaaccaaacaacagccctctccctcagagaggttaaatatattgcagaaagtcacacagtaagatgcagagctgaaaagacgtaattgtttttaggcttgcttctcagtgttatgtctgtatgctttaaactattttagctattgaaactattgctatttcaaatatagtatgctagtttatgcccattttatataaagaaattaggttatgtattaaaatgcaatggttgttttaagggagtggagctttgagtcattgtatgtattaatgctactatcatttaatgttcttatagcact

SEQ ID NO: 232774 - DNA, 368 bp, Homo sapiens
gagagcttcatgttgaatatcggcgaaagtaatttcaatgactaggcattctctggctattgtaaaacctcttctccctttttgttgatgggcttccaggtatgaattaggagctctggaagtgttttcctattctagctcttgagaacttgagttaaatctgtgtagttgtttatgtaccccaaagagtagcttagtgtttagttaaaacactcacagttctgatgccaaccactgtgacaccaaggcagccattcaaagtgcagggataagatgactgtgttattgctatatgcctgtgaagttgttggaacaatattgtaacaggatcttactctatctccttgaatatcaccaatttctgactc

SEQ ID NO: 232775 - DNA, 356 bp, Homo sapiens
ctatgatttggattttgacttttacagagctttctttttaaaataaattgtgtatcaaagtaacaaatactcagctgggtgcagtggctcacgcctgtaatcccagcacttttggaaacggaggtgggtggatcacttgaggtcaggaatttgagaccagcctggccaacacagtgaaactcccatctctactaaaaatacaaaaattagccgggtgtgggtggtaggtgcctttaatcccagctacttgggaggctgaagcaggagaatcgcttgtacccaggaggcggaggttgcagcaagccgagatcgcgccattgcactccagcttgggcaagagtgagactctgtctcaa

SEQ ID NO: 232776 - DNA, 184 bp, Homo sapiens
acaaaataaatgaaactaatactagttttatgggagctgaatgaaagtatttgcagttgatagaaagtattatctcatctttgaaacgaatgataaaatcaatacaaagagctcattgccaccttttccctaattccctatttacccatataagactttcactttaagatatcccagtcaaata

SEQ ID NO: 232777 - DNA, 443 bp, Homo sapiens
gtgatctagcaaacaaagtcttcaaaaaaaaaatacatgaggggaaaaacaataagctgaacatgagcagaaaacacattttcttgcatttgtggtcatcttctatgaagcacagtaagaatctttggaagccagtcttcagggcaaaaggatggaggatgcagcatcatgagtatccagagagtcaggatgaagttgttcttgggaactgcagagacaagcagttctatatggtttcaacacaaatgggctaggaagaaccctggcaccgggagcaataatagtgtcactacctttttctagaggtgggagacaaaaacttagccagacacattcaacagtaagactcaacaaagaatcttcatattcatggacagaaactaaatctgccacatttctagtaaggttctttcttggttaattaaatgtattaatctcttcca

SEQ ID NO: 232778 - DNA, 515 bp, Homo sapiens
gaaaagcgggtttattacagatttatttagcattaataagaagtggttaaaaattgcagagtaaccatatatatgtttgttgtaggctatgggataaaataatttcagtttcaactatatgtcatatccacatttacatatatgtatatgtgtatgtggacatattgtataaatgtacagatatgtatatgtgtgtttatataaatagaaaagataaggaagtccatcaaaatgttttgatagttatcattatctttagaaggtaggactacagcatatttatttcatcttcatactttcctatatttttccaattttatacaatgatcatccttttcttttatgatacaagatcttacaaccacagtaggacaaatgatgagaagtggagatgcttagtagagaggattataatacaatgaaataagttttaaaagggagagggctgcctcttctgcccttcactgagagattgtaaaaactggataacactggccaggcctggtggctcatgc

SEQ ID NO: 232779 - DNA, 382 bp, Homo sapiens
ggcctgggttaggatattttgaattcaggcattgtacaactggatagtgtccacttttgtgtagcagatcttaccgaattatttttaaagtacattgctcctgagggaaagatcagtaaaggtaaagaaaacaaaatatctgtaagaaatgcaggagacaggcttatggcaagtatccatgcctcatcagtgtttacctatgtaagcatggggattcagacaggagatagttgttacaggtaagtattaaggtacttactggaattgaaaaatgaagtcagatagaaagtaagtctgatgtggaaaattagtttgacgatgaggactggatttgctcattaggttatgacagacattttccatgaactgaacaagctaacaa

SEQ ID NO: 232780 - DNA, 518 bp, Homo sapiens
gaggaccacagctgcatggacatctttgcagcggccgcataggcaccactggcctgggtaagaatgctgtgctgccctgctcaggggccttggggagtcatttccgcctccagcttccagccttctgcagaggaacttccatggcatgagccgtcccctcactgtcctgggtctccttgcctccttcatcgagctggggaggcttgtgtcagccacaccactaggctgctgtaaagaagccccaagcaggagacttgttaacatcctcagatttcccaaacacatttttttctaattaaaaaaaaagtcacatgcacattacggaaactagaaaataggaaacaattatgcctagttccaattacccagagacacaccattaactttgcaaagtcctgccctctgatctttccagaggtttttaaaagagtacttgatcttctctatgcaggtttcttaatcacgctttttcatttaaggttcctaacacatttcccatgttgctcagactccaaaca

SEQ ID NO: 232781 - DNA, 343 bp, Homo sapiens
ttgtttccaggtttctgtagaagagtctttgtgtgaaccatgagggcgtaaaactgtaggatgccacccagaagaggatggctgggtgtgcccttggtgcagtcctcagagtccccgcagtggccgtgcacggctggttcccaggcagccacgagggccgagagcttccatctgtgtggatccagtagcaaaatgtggaatccttgctctgttcgtgtgtgtttctttgatttcagagtaaaactacactttaaaagccttttgaaatgttattctataaaatgccaacttagatatgttgctcattttttctctgtagagattacatttttttgtttgtttg

SEQ ID NO: 232782 - DNA, 127 bp, Homo sapiens
tagatgagttctcagattttaaagatctgcaaatgtctgttgtagaaattgcttcaggtggtttcatgttaactctgaagtactccattcttgaaggcatgtggttgttaatagcttcctaccaatc

SEQ ID NO: 232783 - DNA, 443 bp, Homo sapiens
aaacaaatgcctacaaaaacaaaaaatcaaaaagaaaaatcttaaatttcaacattgggctaacaccaaaaacatgaaacttaatagagataaatgcaaagtttgctaactaggttcagtaattctcctaggacaagattggaaagacctagcttggttgccattgaatcttctgccattggttgcagaaaatctgggggatttaggtgcccccaggctgactgagccagtagtgtgatgtcttttgtcagagccagcacagacggagctcaccttgatgatcatagaatgtctaggaaggggtgatgcgtcccctgtggtccgtcctggttagaccgtattagttattcaggaaaagagtgatagactgatagaatgtgaattgatttttattttcagggtatctggaaatatgtcctccctgaactgttgaaattactttg

SEQ ID NO: 232784 - DNA, 665 bp, Homo sapiens
tcatagaccgcgggacaaggtatatttaccatatagctctgtattttccctcttgtgttataatgttttctgtaattaattactctaacccttttagcaaagtctaatacacttcagcattgtctcgtgatgatatacagactaaatggacaggtgagtaaaagaaaaaattaaggcgtcctcactggtgggagcagaatcccaggcagagaactatgcacagaagtttcaggcagtgatcagctgaaagtcagattgcagtccattgtattccatggtggagacaagaacagggagggagcacccatacttaaaagaaacttctaggcttggagcagtatggtattttatacacatcacctctgttagtcaagctttggatgggggctagatagcagcccactgaaagacctggagtccctgtattcttaattgctatgtcggaaagttccatatttagaaatcagatgggcagcaggtaagttaggcattcttctgaaaaaaattaagcctctaccaggactctcgcttggtttataaaatgagccacagaagaaacagcaaactcaagttttcctctcaaaaagtcctgtgtcacttgaaaagttgcttcatacacattgtgtcctaaatatgaaatctaaagttgttactgttttgaaata

SEQ ID NO: 232785 - DNA, 437 bp, Homo sapiens
gcctgcttaagaatccccgtatctttttttatctctgtatatttcctaaaaatctttcttgaaatactgtgtaaaatgctactataaagcatttttaatttaaaagattaatttcaaaagtcatgtaataaattctattgaagaaaaacagtaaggtaaaaggctcatttagcataatgagaatcatttatttctatgtgtcttatggacaaatggtattatgtacaagattataacatattccttatttgtctctaatatttttcattggaaagtatatgggaagcctctagtttgttccaattgtgcatatgataatgattttacattaaatgtttattactgtttggcaaccacctaaatagcctattctaggctgtgtgggtgcatcacctgtctgtattcagcgatcaaaataaactaaggagtaaccaggc

SEQ ID NO: 232786 - DNA, 1109 bp, Homo sapiens
ccagcctggccaacatggtaaaaccccgtctctactaaaaatacaaaataaaaattaactgggtgtgtggcaggcgcctgtaatcccagctacttgggaggctgaggcaggaaaatcacttgaacccaggaggtggaggttgcagtgagctgagatcgcaccattgcactccagcctgggcaacaagagtgaacctccgtctcaaaaacaaaacaaaacaaaaagtagattctaattcaggaggttcggagtgtgtgcatttctaatgcgctccaaggtgctgttgctgctgcttagaaccatcatttcagtagtaagggtctaaaacaacacgactcacaagacctcaacccaccagcccaggtggaaaccaattcacaaacgtctcagtgaaatgattctgttgatgctggtgcgcacttctacatttatgtggggaaggaggtcaggacagaagttgagggacttgggaccccaaagcagataaggttgtggggtgcagatctggctctaggatcctgaagcgagtctctggaggaggtcaggcaaaatggtggcaaacttttatttctgtacggatcaagaaggagctgacagcagcggagagatggagtttacagtaatgggggaaggggtggtctagtggaaagaagctggtttggcatgtcaagggacttgggtttgattcccacttgctgtttactggctttagggctttgggtaaatgacttaactagaatttctaaacaaaattttctttgcccagagaagaaataacagtacaccaccacccgacatacatacgaattaccaaatagaatcgaaacaaaccgcgtggccgccccagagagttcgcgacccacgcgggaggaaggaagcaccaccccttggggggacaacaaactggtgaaggtgtgagacccctggtacgagatagaaatagggggatcaaccacgactttttcgcggctaccaaaactgccgcacaaaggttcgagacaccactcgtcgaaacaggcgcttgtgctgacgcttagggctgcaggaatcaagtgactgaagagctcccaacaagtcgtggagtgaccgacgttactaagtgaggaagc

SEQ ID NO: 232787 - DNA, 1258 bp, Homo sapiens
cacaggcccagctggttcgttatttatttttatttacatagcgaattctctggcatttgtcttccctgctggaaccactcagactggccaagatttccaaaacagtgttctattgtggaaacaagtgccagagacttggtacgctggatcgggtttctgtgacaggcttcagaggggcccaggtcacaagctggagcgtattgtttctgcctcaaagccttgaggttgggcctgagtgctgcacttcaacaaccgcaaagctgggtccttcttggaccacagcaccccaactgacattcagtagcccaccttttgctgcactcagaggtccacttgtccgtgggttttcacaaaggctagggtcctgtggtgatgtacttcctatagccagaattagctcagcactaggtgacaggtgagtgggttaaggaagcaggagttggtcagctttgtggttcagtcatcccagaatatgtcaagagcaaggggccctatctgggcattgctggcagtttcttggctgctctaagcattgccaagaaatgccagggatgatgggtttactactttcccagggagagctgcccttgggacatggaaaactgacctttgagggctatgctctgagatgggaagaagatcgtgtaggtgaagactgcttctgaatatgcttctaaatacgtagcagcatcagggtctggtggagccctctcttttggccacattgaaggccctgccttatttcaggttttggccagagaggttggggaagacatcaacgttcagcagctcctatcttcgccagggacctggaggggtcgggctcaacaaattcttgttttgcagagcaaggtgagtgagtcatcagacttctcctggcctgaacaaaggatttaaaacaccccagaaagagctgccctgacccccttagagacctaagcacacagtacccaaaaaaggcctttaggtctcacagtgcactcgtgcggggttgttgttttaccttctcgccaaccagcctgattttaatttgttatttaatgaacaagctcttatataacacttagcacatgccaggcactggagcttaacaaatgccaacgcctttggtttgatttattttactccaggcatcttttttttttcttagtttatgtagatttgcgtgactgttgtaattgtaagctttttccagttttgtccagatgcttgtagtcttttgaaagtttaattacccaataaaaatttagccttgtct

SEQ ID NO: 232788 - DNA, 713 bp, Homo sapiens
ctgagaatcacagtgtgcaaagcacacccgggtggtgtgtgcctggttggcggaggccgacagggtgcatcctgtcatctctgtagagctaatgagtccctgcacttaggctgtggtgtgtttggttcaagagctgtttatgtgctgccccggacaggggctggtcctcagcagcgtactctcccgtgtaggggatggggaggcttttgttgagagggagaagtctgggcggcctggtctggggaattcagtgggtgcatggtggtgccagttagtgaggtggacaatgtgtgtgggaacacactatgtgggctcgacttccacaggagatggccaggaggctctggagtcgctggcctggagctcctccaagagcaccaggtggcactaacaggtcaaagagtggccagcttagagggaggaggacatcaagggaggactgccctcgggaggactgctcgcagtgtctagggaggagggcaggcaggagcgctgggggccccgaaggggaggggtcgcgggtccctgggacctgaggggtgtcatcggcttcctgcgtgaggaaggttcccgagacaggatggggacagagactggattacagagggtgtagagtgtaggttttatgaaaaaatagagaaaaaagcagactattttccaaaaattttaccatgagggacagaggagagagaagtggcagttggtgggggata

SEQ ID NO: 232789 - DNA, 477 bp, Homo sapiens
ccacctgccttggcttcccaagtgtgagccaccactgaaatacttatatttttaaacttaatttatttatatttattatatttttatgtttttatattttaaaaaatatttttatactcactagacccaattttatactcctaaaccagggaataactgtttttttttctcttacataggcatgataccatagacaatgattaaaattgtaattaccattcatttcttagttttgtggctgggacactgatgtcttcaaatgttagtttgcaaatacagtcagccctctctatccatgggttacacagctgtgaattcaaccaaccatggatccaaaatatatgggaaatacgctggggctgtgggtcacacctgtaattccagcacttagggaggctgaggcagatggatcacctgaggtcaggagttcaagaccagcctggccaacatggcaaaaccctagctctactataagta

SEQ ID NO: 232790 - DNA, 386 bp, Homo sapiens
catgtgcttactggcttgtgcatttcattcctcaggttgtttgggcttgataagtgtaaattacgtagccagtgcatgaatgatcagggatacatactttgacctgcactggggcaggaacacaggacttcctcctggacctggcttccactggagcagagcccaaggcagggcttttcctacgcataaagctctgttgtggtttttagaaaccacccccaggaagaggaatggccaagggagcagaaaggaggaaatgtcagccccaaagttgcatcttgagttggtctcctccatggacaactgaggctctgtccttcagtgaccctctgaggagctggggagaatggagcttgtctgcacatgccttgcttataggagtgctg

SEQ ID NO: 232791 - DNA, 483 bp, Homo sapiens
aataaaacagttgaaaccaaaggcataacacagatcataacagcagctagaggaaaagagaaaatactagaatagatgactaaggtggatacaaaactggttaatgttctactggcaatgaaatcctcacctttggggttattttttttttcttagcagaaagttgcaaacattacttgtaacatattaatgttctacaaattaacaactactctcccagagtctgagccctaatcactagcaaagtcagataaaaatacatttccctagagctgggctgttcatttcggtgatggccttgagcacttgaaatgtagctggtctgaattgaaatgtgctgtaaagtgtaaaatacatgccagaattcacaaacattgtattaaaaagatgtaaaatgtctcataacaatttcatattgattacacattgaaatgatagtattttggacatattagcttaaataaaatattgaaattaaaaaaa

SEQ ID NO: 232792 - DNA, 333 bp, Homo sapiens
ggtcaggggcttggacaggaagttgctgggcaggtgtcctcacagaagtattatttgtgtcaggttgcaacagcctttgtgcaaatttgtgggttttgcagtcttccgtgatagcttttgttatcaggcattcgtgcatgggaaccctgcctaggtggccctccacagctctatttgtcaggtttttggatttttgtttgcttgaacaacaagtgactccatcttgattctgaaacctttcacaaccatacgggcaagccaaagtctaattgtgaggcccactccaatgcgacctgcttctgggcaacgtgatagactggccatggcttatat

SEQ ID NO: 232793 - DNA, 772 bp, Homo sapiens
ttttcagactggaatctcaccattttgcctaggctggcctcaaactcctgagcgccatctatcctctcacgtcagccttccaagtagatggaactacaggtgcaagtgactgtgcccagctaaacgtttctgaaagtttgttctctgaacccttttttcatgaaaataccatgttctagctgttaggaaacactgtatagcttagtagcctcttagagatgaaattacaattggtaaatatctggctttgagaagtctctctgtaaagaaacctctttaactttgtttaacccaatagaccccaaatctattttaacctttaaaagatgcgttagcaagttaccagtgtctgtgttcctggttttctttactccagtagacgtcttaggacaagacctttatgctcattctaatcctgactcatgacattgccaggttgcatgtcatttatgacctcagaaaataaatctgctgtgctagggttaagctgccacttaaaagaataacttggccgggcgcggtggctcacgcctgtaatcccagcactttgggaggccgaggcgggtagatcatgaggtcaggagatcgagaccatcctggctaacaaggtgaaaccccgtctctactaaaaatacaaaaaattagccgggcgcggtggcgggcgcctgtagtcccagctactcgggaggctgaggcgggagaatggcgtgaacccgggaagcggagcttgcagtgagccgagattgtgccactgcagtccgcagtccggcct

SEQ ID NO: 232794 - DNA, 400 bp, Homo sapiens
agtcatacaaaattttaaaattttttcctagggttttttccgccctcatttggcttcagaatcaagactgagtttgtgcatccagttttagatggaacattgaaaaacttgcagatatatgaggcagtgggggaagcaacaaggattatggctaatctagtgactaagtcctaggagggaaggttgaagaagctggattcaacactcaatagagtgatggtactcctccaatatgccagggactgaaccatgctctggggagatggtggtgagtaatgcagtagaatcccctccttcacagaactgccttttagtggtagagacagacaagtgaataaatgattttaatgtagtgcattaatatttataaaatagattaagagcagaatgccatgagagg

SEQ ID NO: 232795 - DNA, 352 bp, Homo sapiens
ggtgattcaaaaatcactaatctcagagtgcaaaacaatggtgctaaagctgccactttcaataaacacctttctccatggtgtattacattctatgcgaagggactatagttagaatcattccttttacctcacttgttttttatttttaattggaaactttagtgttagggagaaactgatcataagacgagttaccaatacctttgtgaatgcctttagtttttttcatagccagttgtgctagtacttttgcctggcagtttcattttttctggattaagtaactgactatcaaattctaggtcaagttcaacttcttctagcttttttttttttttaaccttggctt

SEQ ID NO: 232796 - DNA, 499 bp, Homo sapiens
gatacaggacaattccattaccccaaaatgtaatcaccacaaatccaccctcgctgtgcacctttgtcctcaatccaccctcatcccaacccctggcaaccactgatctattttctttccttacagctttgccttttctagaatgtcatataaatgaatcaagcagtatgtagccttttcagtcttgcttcattcacccaacaaaatacatttgaggccgggtgtggtggctcacgcctgtaatcccagcactttgggaggcggaggtgggcagatcacctgaagtcaggaattcaaaaaccagtctggccaacatggcaaaaccccatctctactaaaaatacaaaaattaaccggacatggtggcagacgcctataatcccagctgctcgggagactgaggcaggagaatcgcttgaacctgggagacggaggctgcagtgagccaggatcgcgccattgccctccagcctgggtgacaagagtgaaacttcgtctc

SEQ ID NO: 232797 - DNA, 366 bp, Homo sapiens
  misc_feature (365)..(365): n is a, c, g, or t
gatacaggacaattccattaccccaaaatgtaatcaccacaaatccaccctcgctgtgcacctttgtcctcaatccaccctcatcccaacccctggcaaccactgatctattttctttccttacagctttgccttttctagaatgtcatataaatgaatcaagcagtatgtagccttttcagtcttgcttcattcacccaacaaaatacatttgaggccgggtgtggtggctcacgcctgtaatcccagcactttgggaggcggaggtgggcagatcacctgaagtcaggaattcaaaaaccagtctggccaacatggcaaaaccccatctctactatacagaggcaggagatcgcttgacctgng

SEQ ID NO: 232798 - DNA, 375 bp, Homo sapiens
gcggaggttgctgtgagccgagattgcaccgttgtactccagcctgggcaacagaccgagactccatctcaacaaaacaaaaacaaaaaaaatggaaatcaaagtccctcaccagctcaacaacctcccatggctccccagtgccctgtggttcagcctaagccctgcgtgttcccctccctccagctgcctccacctggctgtctttgctggttcagcagtgcttgtctcgctgttccctctgcctggtggaggcggcctatctgagaagggctctatgtggttgccctgggctgctgttgtgagagccggctgggtgcctgtggcccctggggcagcttttcttccaaaatgggaactagtggcctgtgttct

SEQ ID NO: 232799 - DNA, 468 bp, Homo sapiens
gcatccagtcctaattcaatggagtgaagtaacagtgctcagtagcctcctttgctgtactgttttaggcttttgctagcttcagaaaatgaatttggaaatattttgtttttgttactatgttatgggtttattttgatccttgaaaacttaatgaaattcaattttctattaaaactggggtttaaggagatattggtcaaatgatatgacatttcaattaggtggaataagtttaagagatctgttgtacaacatgatgactatagttaataatacatgtattcttgaaaaataatgaatggatgtttactcagaaataactgtgaggtaatacatgtgttaattagctaaatttagttgttctacaaggtatgtatacttaaaaacatgttatacatggaaaatacatagaattttatctatcaatttttgaaaaaggaaattaaatagaatttgctcttgaac

SEQ ID NO: 232800 - DNA, 436 bp, Homo sapiens
gtccatgtctgtatcatagcctttctaactccagtcaaaatggagggtaaaaggacaattttaaaaccatctcgtaatattttcaaaacccttcccctgagccctgccccctctattttttctcgatttcatactggtgccaatatttgttcaataagttaattcatatcatcccctggagtttgaattataaaggaattattgtgattataatattttggcatatcctgttgatctctcatttgcccccatccttgatgttataggactgtatgatttttttaacctgagaagtgattaaaaacgttttaaaaatttagtctcctaaatgtagactgtttattgcagaagacagggaaattggcctgactgggggcatttgctaaaaatgcagagctcctgaaatcctgtgaaccttatggagtaagcaagtaaa

SEQ ID NO: 232801 - DNA, 709 bp, Homo sapiens
ttttttgactctggtggatttcttccttctaatctcaagaaagaaagaaagaaagagaaagaaagaaagaaagaaggaaggaaagaaggaaggaaagaaggaaagaaagaaagggtagggaagggaagaggtcagaaataccttgattttcttctctctgaagtcagaatgtgaattcataatatgaatgcaaatatttgggagtgcaaaaattacatattttcagataggattgtgcattttactaccaaattttactctttttggttccagttcaaggattctatgttcctcctaatttaattttttggtccccctagtggttttaggtgtctctgcagccacacacattcggcttttcctgcaaccacactaacctcagtggttttagcctaacttgggtttttcctgggatctttccactgtttttaaaagtcaatatcccaggctacttgtatccacactacctaaagtgcttgtgaaagcttcaaatacctggggttccccctcagacacactgaatcagactctagggcgtggggctctggaatggatttttaacaagctctctcaataatatgattcggggagccagatgctcacattgtatagatggaacctagggctatcttctcctttttctattcttttttttcacttattgggaagggttcagagaggaagagccagtagcagcaagacatgaaat

SEQ ID NO: 232802 - DNA, 422 bp, Homo sapiens
aaataattttattattttttatgggtatgtaagtgtatatatttatggggtgcatgagatattttgatacaggcatacagtacctaataatcacatcaggataacgggattatctgtcacctcatttataatttatttatgttacaaacattccagttatacttttagttatttttagatgtacagtaaattattattgactgtaatcacccattatgctatcaaatactagaacttattcattacatctaactatatttttgtacccattagccatccctgcattccttccctaacctttcctagcctctggtaaccatcattctactctgtctccatgagttcagtcgtattaatttgtagcatccaccaatgaatgcttataggtttttattgatttcctccccttctgtcgtcttctc

SEQ ID NO: 232803 - DNA, 1176 bp, Homo sapiens
agtttactgcaacctccacctcctgggttcaagcaattctcctgcctcagcctcccaagtagctgggactacagacatgcaccactgtacctggctaatttttgtatttttagtagagacggaaatctaatttcgccatgttggccaggctggccttgaactcctgacctcaggtgatccacctgcctcggcctcccaaagtgctgggattacaggcgtgagccactgtgcccagcctattttagtactcatcatattatgttaaagagcttgtctcctacactggactgtgatttccctatcattaagaactcggtatggtttttgtgcatctaacagctaatacttgataatgtttgtgtgccaactctgtataaacactattctaggaactcagtaaatgtttgcattgaattgagtttgtgttaggagttgtattagaactctacaccaccttatagtttataaaacatatgtatattcattgtcttatttaattttgaaatcaactgagtgctgcaaatgagaaaaatcaaagcccagagaaaactgtaactggtccataattacacagcagttaatggctgaacatccaggctgaactttgccagttagtggctgaatattcacgaaattctgatgcctccatagagcgggatagaattatggaggacttgtcattctggactgcggaatttggacctgtgtattgaaacaagaagagaaagggaagtgtttcttaagttatttttggatgaaggctttttgcgatccaaggcttcatcccctcaagctcaacaatagcattccttgggggagtgagaagatgatgaatggtcatcagtttgcttgcctcacccagattccattcctacctcccagaattttccctggtcccacccagctccacagtaacaatcaatcccaatcagtgactgtacttcattttttggatcaaggaatacccctcccttttctgtcttcctccttagggctttggataggagccctttaattgatgttgactaaactggaggccagcccctgcataccaggaatgccagtggctttgttagttgaggagggcgctgcattagcactgccctctaaatcccagagcaggtggaggaaatctaattagcatttagtaagccaaggtgccctggggagtttctg

SEQ ID NO: 232804 - DNA, 559 bp, Homo sapiens
gtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaa

SEQ ID NO: 232805 - DNA, 452 bp, Homo sapiens
agatggcatcaaatccaataatcatcacaggaatagaaaccaaggtccaagtttgggcatcaggaggtatcttcaggttctctcttcgtctgcttcctagtgtatagccacaagcctactatactgtgatacataaaacccagagatgtggcaaatgaaagtgggagcaacaaaactactacagcgtaagcctgtaatgcaaggcggaggaaggaaagtaaatgcttaaagttttcatacagctaactctgttgatagctgccaagtaaagaacctaaattcaagtgctttataattgttacaaattgtgccaaagtacagcgtgttacaataaattatgaagcttatctaaattataaaagtaattaaactttcctcagatactcataactctgccctccataaattttctgttcattgcatattcaatacctatgtgttccagtaaaaca

SEQ ID NO: 232806 - DNA, 794 bp, Homo sapiens
actaaaaatattggaaattaattttttattatttacatgcagattttttactagatacattaaaatgttagtaggctggtttttctttaaactcagtatgcttctgggttgctacttcttaccatttactagttcatgtgatatagattttaattttagtaatagccttctgaaaatgtagtgactcaccaaggaattaatttttacctagaaatccatgcctgagcaacatagtgaaagtccatctctacaaaaattacaaaaattagccaggtatggtgcctgtagtctcagctatttgggaggcagaagtgggaggattgctggagcctgggaggttgaggcagcagtgagctatgattgtaccactgcactccaacttgggcgacagcgcgaaacccagtcttaaaaaaaaaagaaaagaaaaaagagaaatcaaaagttgtgcatgtgaagcctcttgaagacggaacaaacctagaatactttttatacctttaaataaggtaatttaaaaattggttgataaatcatttacttggcagcagggtgggcatgctttgataagtcctatgtaaagagagatcaattgctcataaaatattaatacaatttccctttcccctggggtttagagctcagttttagttgaatcgtgtaactcctcacgaagtataaaataccacctatgatacctatttgacacttaaccattttagtgtataagaaaatacatgcatctctcaagagacaataatagtgattttaggattatctttgctcctatttactgt

SEQ ID NO: 232807 - DNA, 1357 bp, Homo sapiens
agcgcgcggcgggaaattgtttcccagagcccggattcgtgaagcagttgagtgctgcagcggcagtcgtcgcccctgccgccgctgccaccgaaggaagcatcccagacaccgggaagatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcctccttgttagaactgataagcgaagtgattctcttataagagttttggaggctggaaaggcaaatgttattttaccaaaaagttcaccaagtggaataactcatgtgattgccagtaatgcaagaattaaagctgagaaagaaaaagataactttaaggctccattttatccaattcagtatctaggggattttcttttagagaaagaaattcagaatgatgaagattcccaaaccaattctgtttggactgaacatagcaatgaagaaacaaacaaagatttcaggaaagatgcaggatttcttgaaatgaaaggtgccttaagagagaccatgtatagaacccagaaagaaatgcaaaatcatgaagatgttaatgttggttctattttgattcaacatcacaaaaaagaaaaattcagtggttccagtaaagatttgaaatttgttaaaatgagaaatacctttggaagccatacatatgaaaatcagaagggaaattaagaaaaaagatgaagatattcagaggagttatactttgaggagaaaacgcaagaaaggaaaagaaagcaattgcaagaaaggcgttgaacatgaaaaaataaaaagtaccttaagaaggcacatatataatagagatcagaaagaaatgaagaattctatttttgctgaatatgccaaagaatcaaaagccatggctattaagacagatgtggatgttgttgaaataaaaaataccttaaggaagcacatatatagagctcagagttttggaggctggaaaggcaaatgtcattttaccaaaaagttcaccaagtggaataactcatgtgattgccagtaataca

SEQ ID NO: 232808 - DNA, 1391 bp, Homo sapiens
agcgcgcggcgggaaattgtttcccagagcccggattcgtgaagcagttgagtgctgcagcggcagtcgtcgcccctgccgccgctgccaccgaaggaagcatcccagacaccgggaagatggaagatggtaccccaaagcatatcatccagatgacaggatttaagatggaagaaaaagaagcgctagtcaaattacttttaaaactagattgcacttttattaagagtgagaaatacaaaaattgtacacatcttatagctgaacgcctatgtaagagtgaaaaatttttagcagcttgtgcggcaggaaagtggatactaaccaaggactatataattcatagtgccaaaagtggcagatggcttgatgaaacaacttatgaatggggatataaaattgaaaaagattcccgttattcacctcaaatgcaatctgcacctaaaagatggcgtgaagaactgaaacgcactggtgctccaggagccttccacagatggaaagttgtcctccttgttagaactgataagcgaagtgattctcttataagagttttggaggctggaaaggcaaatgttattttaccaaaaagttcaccaagtggaataactcatgtgattgccagtaatgcaagaattaaagctgagaaagaaaaagataactttaaggctccattttatccaattcagtatctaggggattttcttttagagaaagaaattcagaatgatgaagattcccaaaccaattctgtttggactgaacatagcaatgaagaaacaaacaaagatttcaggaaagatgcaggatttcttgaaatgaaaggtgccttaagagagaccatgtatagaacccagaaagaaatgcaaaatcatgaagatgttaatgttggttctattttgattcaacatcacaaaaaagaaaaattcagtggttccagtaaagatttgaaatttgttaaaatgagaaatacctttggaagccatacatatgaaaatcagaagggaaattaagaaaaaagatgaagatattcagaggagttatactttgaggagaaaacgcaagaaaggaaaagaaagcaattgcaagaaaggcgttgaacatgaaaaaataaaaagtaccttaagaaggcacatatataatagagatcagaaagaaatgaagaattctatttttgctgaatatgccaaagaatcaaaagccatggctattaagacagatgtggatgttgttgaaataaaaaataccttaaggaagcacatatatagagctcaggctgtcagatacaactgcattagaatagataaacaaccagtgtacaacgtagaggttaaaaatgctgaatttcccagaggtgtattaaatttaattgaaagcctcatagaaggaca

SEQ ID NO: 232809 - DNA, 421 bp, Homo sapiens
tatggaagtctgtcaaaaaaaaccctcagtttatgctgtgaagcctcatggttgatattgccctgaaattaggcaatagcaatgggttaacactcaacacctacaaattgtaagcagttctcaaattctcatagtacttgagttatctcaaccaataagcatttctccaaaagtcaaaagttaaaaaaatttcttggattagccatcttaaatgtaaaataaaattaaaatgagaattcgttgactcttgactcttaagtgcaatcctgatagtaaaatcatgaggggttttgtttgttttgttttttcagcctttaaaggtgtgtgaatttggtattgacttgaatgaaggatgttagagcctgggatgctgaggcagtaagtatttagaggagcaacccttatatataggaatgaggga

SEQ ID NO: 232810 - DNA, 367 bp, Homo sapiens
ctttgaggttaataaaaagttgtttagcttcttagcacaaaagattgagaaaagtcaggtggaataacatgtgcattccaaaagaacaatctgcagatgcattcatcatggaagacaagcctttaaaggtgtgtgaatttggtattgacttgaatgaaggatgttagagcctgggatgctgaggcatgtgtttactagaatattttaagttacaagtgtggataccattctactggacagcatgcttttgggattagaactgcagaagccccacctctgcttcaaatataatagcaataaatgtgcttttgcatatgcagtatatttgaagaaataaagattattatgtggctaataaatatgtttg

SEQ ID NO: 232811 - DNA, 356 bp, Homo sapiens
aagactctgtctcaagaaaaaaacaaacaaaagcaggcaaggctctggggggcctatgctcaaggctgacctggactcagccctggcttgactctgctgttcaagcccccagccataagcagaaggcagctctcaggacaactcagaggtgggacttgagaggttgctgcctgctggtgaattctggctccaccattagtgttgtgaccctggataggtcacttaacttctctgagcctttgtttccatatctgcaaagtggggtcagcctcagggctgctgcaaggatggtagaggttgaagctgagggcaactgtcagtgctgagcgtgacaagcgcctgatggctggcggccg

SEQ ID NO: 232812 - DNA, 464 bp, Homo sapiens
cgtctctactaaaaatatgaaaattagcctggtgtggtggcgtgtaccataatcccagtactttgggaggctgaggccggtggatcacttgaggtcaggagttcgagaccagcctggccaacacagtgaaactccatctctactaaaaatatacaaaaattggctgggcatggtggtgcgagcctgtagtcccagcaactcaggaggctgaggcaggagaatcacttgaacccaggaggcagagattgcagtgagccgagatcacgcctttgcactccatctcaaaaagaaaaaaaatttacagttaggatttgtaaaattttaaaaatcttaaagaacaatagttaaatcttaccttctataattaaaataattaaatattaaggattctttggagttgcgtcattaggagctttacagtaagatatcttactagccaatattagcctgccacaggcaaatta

SEQ ID NO: 232813 - DNA, 500 bp, Homo sapiens
agttggcggggagggaatggctgaaattaaacatggtgattatcccaccatcagtggaagttatccagcagcagtggacatgactgcgaatcctccagaaaatggcttcgctgcgctccacggatctgctctcccaccccacctgcggcttgcacagcgacacacaagcgttgtgattggctcttccttggctgagacaagggtggggaccgaaatggcgtctctaacagctgatttttcagggcagcagctctgtgctaggagaagagaaggccgggctcactggcggtgcggagcccgccagggccaatccgcatccgggcggaggtgcaagcccgaccgcagtactgacacgtgccgcgacgtcccctcccggcagctcgcggggacctgggagcgggtggggtctctggctggcggggagccagggctgcgggaaaccgcacgaggtcgcgttcgcgagtggcggagaagcccagacccccgggcgcacgcggccg

SEQ ID NO: 232814 - DNA, 2818 bp, Homo sapiens
gaagagaaaagcataggaaaggaaacagtggtaataggaattggggtaaaatgaggatccttccccacaaacattgctattattcagctcatttcaaaggattccgctgctgccatttgtgagagccgctggaggctgagtgaaagtcattttgaaagactgatccaaagaagaatggaggccagagtggagcgtgctgtgcagaaaaggcaagtcttatttctttgtgtatttctgggaatgtcttgggctggcgccgaaccgcttcggtattttgtggcggaggaaaccgagagaggcacctttcttaccaacttggcaaaagacctagggttaggggtaggggaactgagagcccggggaactagaattgtttcagaccagaacatgcaaattttactgctcagttcgcttactggtgatctacttctaaatgagaaattggaccgagaggaactgtgtggccccagagagccctgtgtgctgcctttccagttgttattggaaaaaccttttcagattttccgtgctgaactatgggtcagagacatcaatgatcacgctccagtatttctagacagagagatttccttgaaaatattagaaagtaccactccaggggcggcatttctcctagagagtgcacaggattcagatgttggaaccaacagcctgagtaactacaccatcagccccaatgcctatttccatattaatgtccatgatagcggggaggggaatatctatcccgaattggtgctgaatcaagtgctggatcgggaagagataccagagttcagtttaaccctcaccgctttagacggcggctctcctccaagatcagggaccgccctcgtgcgcattctggttctagacgtaaatgacaacgcccctgattttgtgcggtcgctctacaaggtgcaggtgcccgaaaatagccccgttggttccatggttgtctccgtgtcagccagagatttagataccggaagtaatggggaaatagcctatgcattttcttacgccactgaaagaattctcaaaacgtttcaaatcaatccaacatctggcagtcttcatcttaaagcgcaattggactatgaggcaattcaaacttacacattaactattcaggccaaagacggcggcgggctttctggaaaatgcactgtagtggttgatgtaacagatataaacgataatcgacccgagctgctcctgtcttcacttactagcccaattgcagaaaactcacccgagacagtcgtggctgtttttaggattagagacagagattccgggaacaatggaaagacagtgtgctccatccaggacgatgtccccttcatcctgaagccatctgtcgaaaacttctatactctggtaacagagaaacctttggatcgagagaggaacactgagtacaacatcaccatcaccgtcaccgacttggggacacccaggctgaaaaccgagcacaacataaccgtgctggtctccgacgtcaatgacaacgctcccgccttcacccaaacctcctacaccctgtttgtccgtgagaacaacagccccgccctgcccatcggcagtgtcagcgccacagacagagactcgggcaccaacgcccaggtcatctactccctgctgccgtcccaggacccgcacctgcccctcgcctccctggtctccatcaacgcggacaacggccacctgtttgccctcaggtccctggactacgaggccctgcaggcgttcgagttccgcgtgggcgccacagaccgcggctcccccgcgctgagcagcgaggcgctggtgcgcgtgctggtgctggacgccaacgacaactcgcccttcgtgctgtacccgctgcagaacagctccgcgccctgcaccgagccgttgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgtaccgccaggctgctgagcgagcgcgacgcagccaagcagaggctggtggtgctggtcaaggacaatggcgagcctccgcgctcggccaccgccacgctgcacgtgctcctggtggacggcttctcccagccctacctgcggctcccggaggcggccccggaccaggccaactcgctcaccgtctacctggtggtggcgttggcctcggtgtcttcgctcttcctcctctcggtgctcctgttcgtggcggtgcggctgtgcaggaggagcagggcggccccggtgggtcgctgctcggtgcctgagggcccctttccacgacatctggtggacttgagcggcaccgggaccctatcccagagctaccagtatgaggtgtgcctgactggaggctccgggacaaatgagttcaagtttctgaaaccaattatccccaacctgctaccccagagcacaggcagggaagtggaagaaaatcgcccatttcagaataatttgggtttctgataaagaatgtaaactaaatccgcgtctgtgaatacgtttctgattaggaacttattgcgaggttcccttaagggagtgtctttacatcatttcaaatatgtactcttgaagtcaagcaataaatttctatacataaaataggatcctgatttagtatcaagaacccttcacaaagcatgaaatgtatatgtgtaatgttttatgtcaaacaattatgcttaatatacagtctattaaatgtaagtcttgtttgagatatttt

SEQ ID NO: 232815 - DNA, 3721 bp, Homo sapiens
gaagagaaaagcataggaaaggaaacagtggtaataggaattggggtaaaatgaggatccttccccacaaacattgctattattcagctcatttcaaaggattccgctgctgccatttgtgagagccgctggaggctgagtgaaagtcattttgaaagactgatccaaagaagaatggaggccagagtggagcgtgctgtgcagaaaaggcaagtcttatttctttgtgtatttctgggaatgtcttgggctggcgccgaaccgcttcggtattttgtggcggaggaaaccgagagaggcacctttcttaccaacttggcaaaagacctagggttaggggtaggggaactgagagcccggggaactagaattgtttcagaccagaacatgcaaattttactgctcagttcgcttactggtgatctacttctaaatgagaaattggaccgagaggaactgtgtggccccagagagccctgtgtgctgcctttccagttgttattggaaaaaccttttcagattttccgtgctgaactatgggtcagagacatcaatgatcacgctccagtatttctagacagagagatttccttgaaaatattagaaagtaccactccaggggcggcatttctcctagagagtgcacaggattcagatgttggaaccaacagcctgagtaactacaccatcagccccaatgcctatttccatattaatgtccatgatagcggggaggggaatatctatcccgaattggtgctgaatcaagtgctggatcgggaagagataccagagttcagtttaaccctcaccgctttagacggcggctctcctccaagatcagggaccgccctcgtgcgcattctggttctagacgtaaatgacaacgcccctgattttgtgcggtcgctctacaaggtgcaggtgcccgaaaatagccccgttggttccatggttgtctccgtgtcagccagagatttagataccggaagtaatggggaaatagcctatgcattttcttacgccactgaaagaattctcaaaacgtttcaaatcaatccaacatctggcagtcttcatcttaaagcgcaattggactatgaggcaattcaaacttacacattaactattcaggccaaagacggcggcgggctttctggaaaatgcactgtagtggttgatgtaacagatataaacgataatcgacccgagctgctcctgtcttcacttactagcccaattgcagaaaactcacccgagacagtcgtggctgtttttaggattagagacagagattccgggaacaatggaaagacagtgtgctccatccaggacgatgtccccttcatcctgaagccatctgtcgaaaacttctatactctggtaacagagaaacctttggatcgagagaggaacactgagtacaacatcaccatcaccgtcaccgacttggggacacccaggctgaaaaccgagcacaacataaccgtgctggtctccgacgtcaatgacaacgctcccgccttcacccaaacctcctacaccctgtttgtccgtgagaacaacagccccgccctgcccatcggcagtgtcagcgccacagacagagactcgggcaccaacgcccaggtcatctactccctgctgccgtcccaggacccgcacctgcccctcgcctccctggtctccatcaacgcggacaacggccacctgtttgccctcaggtccctggactacgaggccctgcaggcgttcgagttccgcgtgggcgccacagaccgcggctcccccgcgctgagcagcgaggcgctggtgcgcgtgctggtgctggacgccaacgacaactcgcccttcgtgctgtacccgctgcagaacagctccgcgccctgcaccgagccgttgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgcgtaccgccaggctgctgagcgagcgcgacgcagccaagcagaggctggtggtgctggtcaaggacaatggcgagcctccgcgctcggccaccgccacgctgcacgtgctcctggtggacggcttctcccagccctacctgcggctcccggaggcggccccggaccaggccaactcgctcaccgtctacctggtggtggcgttggcctcggtgtcttcgctcttcctcctctcggtgctcctgttcgtggcggtgcggctgtgcaggaggagcagggcggccccggtgggtcgctgctcggtgcctgagggcccctttccacgacatctggtggacttgagcggcaccgggaccctatcccagagctaccagtatgaggtgtgcctgactggaggctccgggacaaatgagttcaagtttctgaaaccaattatccccaacctgctaccccagagcacaggcagggaagtggaagaaaatcgcccatttcagaataatttgggtttctgataaagaatgtaaactaaatccgcgtctgtgaatacgtttctgattaggaacttattgcgaggttcccttaagggagtgtctttacatcatttcaaatatgtactcttgaagtcaagcaataaatttctatacataaaataggatcctgatttagtatcaagaacccttcacaaagcatgaaatgtatatgtgtaatgttttatgtcaaacaattatgcttaatatacagtctattaaatgtaagtcttgtttgagatattttaaattgctttccattgttttcaatctctactgagacttcctgagttgattagaaagctgtatgagtgtacctaccctagtctcagaagcatagactgtagagtatctttttaagcatttttaaaaaatgcttttaatgcatcatacactattttaacacttttaatctgagaagaagcatatgaggcatggtattttaggaatgaacaaatagatggtcttagagattcagtaagttcactaagttccactaactaataagtgacaaaactgagcatccatcccagatctgtctgactctgggtcagtgaccctgctccgattccatactgttttctgtcattagatatcacctggcaagtttctgcctaattaaggagaagtcttttatcatatttatactgctgtccaatcttttctatatttagaaataataatgtacatatttatctatggttttattttcttatacaccaaaagtcctgcttttctgggtcaattttcaactattattactaatgctctgatctgtccaaactcaagcggaaaacaaaattgaaagggcaacctgtgccttctcctttcttcagaacatatgactttcatttcccagaaaaaagattaatggtcctgagtaggaatattacataattttgattgcatcattagttaattattttcttcatattgtagattttctgcagtcacccatacttaacatttgtaatacattttcctgatttgaaagtttgtttttaaaagttttctattaattatagtgcactattgaatcaggaaaatttaagaaaaagaatagttagttttaaatgcataatatcaaagagaatcatagatgatcattaaatttttagaaattctcggaagttaaggagaagcatgtttt

SEQ ID NO: 232816 - DNA, 462 bp, Homo sapiens
ttaagaagcatctgcagttgttgaatgggggctgggttgcgactgtccctgccttgggcgccaggttcatccccagggatcagccctctgctgacctgggaatatggtcagaatggagttgctggtcttgggagcaggcttgctctggacacaggtctagcctctacagaaaagcaccatcattcaggtgtccggccagcactgaggagtcaaagggggtctttctgaacttgtatccagtgatgtgttctcactctagctttgatggtcctcagtggagccaagactccgtatgttctaagagaatggcaaaggcctccttgtcttgtgttagctactgggtagaattttacgtagtaactaggtagacactgatttagaatccagatggaccttattctagaaataggaatctgcccaaaggtagaaaattggaattatttgtaaatcaggaggctgtaa

SEQ ID NO: 232817 - DNA, 673 bp, Homo sapiens
ctgtagtcctaactgttcaggaggctgaggcaggaggattgctttagcccaggagttcaaggccagcctgggcaacatagtgagttcccctctcttaaataaaaaagagttcccctttgctttgttccctttccttccctctccacagaagtacttttgttccactatggctgctttagctgccgctgcagtcatggctgcactaaattttagcattgtttcagctttaccccttccctattaactagtacatctcttatgttcctaactgtaaattttttcaagtggaagctcattgatttcagctcattgattttttaaaggttggatagtcatagttgcagattagtccatagatttgctgtactcctgtgttaataatagcaaatattattattaaataatgttgttattaaaatttttagtttttatcttgagcacttactggccaggcactattctaagcagcttttcttttatgtaaaattgtgtattatgtatagaaggagcaggactgaaaaaaaaactaaacaaaaaattgtgcattatgtattctcacagtcactttatgaggtaggaatactgttgttccaatttgcaaataaggagtctaaggcatggggtctgggtccaaggtcactcagctaattaagtggacagagtgaggctttga

SEQ ID NO: 232818 - DNA, 471 bp, Homo sapiens
ttcatctcctccctgagctccagcctgatggtgtcctcctcccagtgctgcatctttggcacggccccctggttctgataaaaggtggtccataaagctgctctggagccaaaatattgcagtcacatctcggcagcgacctgccctcaggtggcattttcaagtcatggagaaggtggagagagaagcaatcagcagccacccactgcagctggagaccccagaacttggtgtctgcctcccatggcactgggaaggctggagacaggaagaggaagacagagctcttaccagggggaggcagagatggcacagcaagagacatgcccccagaatgccaccaatgccccaggacaggcccacccatgggaccaggttatcggggccctgaggggatggggtggaatctgaagggtgagccttcttccagcagtcatgttgcaaggaaacgaaatcacgttacttcttcca

SEQ ID NO: 232819 - DNA, 349 bp, Homo sapiens
gtaagtcgacaggcaggctttcctggccagctgtccctggtgacctgatgtaacctgggacgtacctagagaaaaagaacacaactctgatttcagaataaaaactaggctcctgtagcaaacatcccacatccatgtttgttaggaaactgtgtctgtgaattccagatccagggagggggccaggagtggggtgcagcctcagggcccctcattcactttttgccaagtgagcttttctttctctcagtgattttcctgggaaccaccttcccttttccctctggagcctgtttatgtcccctgagtgtccttgccacaggaacctctctcctgggacacccaggtc

SEQ ID NO: 232820 - DNA, 548 bp, Homo sapiens
acgggaggcgtccctgctctgatcgtgcgcctggcttggctgcctcctgcagcccagcgctacctgcacagcttctaggagaggcggcgcctcccacgcatcctaatcacatgtctacaggaattcagaggccaaggagcccatggaggcctggagagaggaggcagggtgtcccggagaaggaggagggcagagcacaagctgctgcgtttctactctgcctcctgtgtcagcaactctccccatccacaggaaggagtctgggcagaactgaaggttgtcacaaggagctgctaaacagatcaaaaggcattgaaggatggagtgacatgatatatgacctgcccaatccttgactgcacatcacataagcagtcctaaggatgtgaagtatatgatgccaccagttgaatggattgaagctcctacacgtacactgttggtttcagattctctactctacaacatcagaaaagaatctatttttggtgagataacaaatgtgctatgttactctagaataaagacatctgtttacttacaatttt

SEQ ID NO: 232821 - DNA, 606 bp, Homo sapiens
cattttaatgcatactttggggattcccatatcccaccaaagcttatgctttgatctttaggtggaattgctttatgataaaagggttcttttactgttcattttggatgatgtggatgagtcttagagttttattctggtctttacaaatatgatttgctattttctaaacttatctaatgactaacttaaggcttgttatgataagattataagaaaacactttggggaatcttgagagttttctttgtaattataatttataattctgtaacatagagaacatgattaacatgaagctctaaatgtatccaatagttttgctttcttatcagtgaatctatcagtatactagtagtaactggagaatttcaaagatatgcttacactttaaaccctcaatttccagtgcttcaggtgggtttgcacatatgacaagacaggcaaggagtaagaaggagccagtataagaattaaaaaggagaccgggcacggcgacttatgcctgtaatcctagcactttggtggccgaggcgggcagatcacttgggctcaggagttcgagaccaccctgggcaacatggctaaaccctgtctctactaaaa

SEQ ID NO: 232822 - DNA, 394 bp, Homo sapiens
agcccccagcacctgccagcacacaggtcctcagtaaaagtgcatcgtgagtgaacccctgcagctcgccatactctgattggcagcaccctcattttccttttctcatcatgaaatagctcaaacacccgcatttgacttttctcattgtgaaattttcaaacacacgctaaactaggagagtaatgtaaagagcccatgtgctcaagaacaagccaatcctaacatcgggccacacttgcttcaaatgtttaagacatgaatattgcaatacagttaaagcccctggaagccttcctcatgtcaccccgagtactcttccaaagcatcccattcctgtttttatactattactgcatatgcgtgtgttcataagtcatacagaagattttta

SEQ ID NO: 232823 - DNA, 548 bp, Homo sapiens
caagtagctggaataacaggttcctgccactgtgcccagctaatttttgtatgtttaatagagacagggtttcaccatgttggccaggctggccttgaactcctgacctctggtgatccgcccacctcggcctcccaaagtgctgggattacaggcgtgagccaccatacctggcctgaaattcttatctagaccctgttaaggttaaagaattccagattgttgttgctaccattatttgatttttttaatgcatccagagtgtcatgtttcctaaacctcaaactctattctaattttatacagttttattgtctcactgaaattatagattcttgagatcgagaccatcctggctaacacggtgaaaccccatctctactaaaaattcgctgggtgtggcagtgggcgcctgtggtcccagctactcgggaggctgaggcaggagaatggcatgaacccgggaggtggagcttgcagtgagccgagatcgtgccactgcactccagcctgggtaacagagcgagactccgtctcaaaaaaaaaaa

SEQ ID NO: 232824 - DNA, 230 bp, Homo sapiens
atttcagataaactgacacaccttcaataatgcaggtttattatgtaagtttttactgatcctacaaaggatacaacaactacatgtccaaagatgtaaattcggggctaatcttctctatttaatcctttactgtttggggagaagaattactcatctgggattcatgaattgtatggtcactcaacctgttttcttgcaccattttttatcataagataggttcttct

SEQ ID NO: 232825 - DNA, 511 bp, Homo sapiens
tcttctgggatataatatctaacatttatctcattatctttatatctaaacctctcctttgtacaaatccagtaagcctagcctggaaagctgagttcattcctcccttactccatacccagctaattagcaaatcttatctctccaactctctgacaattctcatgctaattcaccttacattgcagccatatcagaagaagaaacatagcgagtatttccctctcattcaaatcctccctcacctggctacagcgacttcttcctggtcagccttagcatgattgccctccttctcccactgcatagacggcagtgtcttgttctcttgattatgaaggttgttatttaatggagccatagttctttctctattattgtagaactattattggacagctaaaacagaagagatgaaaatagaccagcttcagtaaataagaatatcaacttaataatatgacattctcctggaggaaaacaaatgaagtatgctccagggtctgggaaa

SEQ ID NO: 232826 - DNA, 355 bp, Homo sapiens
gagaatcgcttaaatcctcgaggtggaggttgtggtgagccgagaacatgccattgccctccagcctgggcaacaagagtgaaactccatcccaaaaaaaaaaaaagaacgaagacatttttctgtataaccataataccattattatacctaagaaaattcatttttttaaatttatttttaatttttgtgggtacactgtaggtgtataaaaagtgactattgtaattgttattttgaatcccagtctaatcaagtttatcaatcaagcacattaaacaagtctttaatcagtcaagcccctcacctgtttttttccccttgaaactgactttgaagaatctgagccagtttt

SEQ ID NO: 232827 - DNA, 546 bp, Homo sapiens
accaagaaaattagtgtgttatcactgatgttattgcagattgcctagatattccatagggaggaaaataaagtacaattaaccaattattgaaaagaaatcaattatatattaatatgcaggcattttctaaagtaacagaaatagctctagcaagcttatggtcatcaataagaatgattatcataaaagtaaatttaaaagtcttttaatccattgtgtttaatctggaactggtcctctaaattgaaaatgaaatcatgaagtataaatgggcccaggcactgtggctcacgtctgtaatcccaacactttgggaggccaaggcgggtggatcactttaggtcaggagttcaagatcagcctggccaacatggcgaaatcctgtctctattaaaaatacaaaaattagtctggcatgatggcgcatgcctgtagtcccggctactcaaaagactgaggtaggagaattgctttaacccaggaggcagaggttgcagtgagccgagattacaccactgccctccagcctgggtgacagaggaa

SEQ ID NO: 232828 - DNA, 607 bp, Homo sapiens
taccctcctccaacgaaaggacgaactgatccaagagacggcgggaggcaggagaaagcggagctccgcatcaggcaggcccggacaggcaccctccaaagagggtttcattagggatgcaaaatgaatctggctttacagctggtgtagaccaggctcctgccccatcctgggctacccaggcccagccggtgctgacagcaaagacagaaggtcggtttctgcctaaagcaaacgctcagcgaggctggaacagaggggagtgctgcgtggtaggggcgagggcgcttggaggggcctctgcctgcagcgtctgggtccccagcccagggctgcttctttaaagacaaacaaaggcgaagatgcggaggctcggaagccggagatggggaaatcagttgtcataaaagagagattcagagagggacaccgccagagtgcgaggcagagagaagccgggagaggaattcaatgccgtgtgcgcagcaataaaataatatgaccgctataaaagtttatagcgtataaatttctgaaggttaagaaactaaacagcagcaaagcaaacagcgaggggaaactttccggagctgagagagccgcagct

SEQ ID NO: 232829 - DNA, 218 bp, Homo sapiens
gaaacaacattggaagcagtttctcctctgcctctttaatcccttggccaacgcaatcttgagttaagcacagtctcactattaagtcttgtagggtgaatacatctttacttccagttttcatccactttatcttcatctcggagaattattgtgaaaaaaaaagttctcagtgtataactcatattaagtaaaagacatgtaatacattgtaataa

SEQ ID NO: 232830 - DNA, 391 bp, Homo sapiens
gaacggttcaaggagctgcaatcggcaggaggaatcggaaattttaattgcattattaccaattataagaatttttgtgctatgagtgggttttgtgctatgaggggacccaaaaaagggctgataaaacaccaaaaccactggtgaggagaacttaagagggaaccaggcttcaagctcctaaactcaccatggactgccacagaatttaaagcacagtccatattcctcagaaagctaaccaagcccaccactgggtgtcctaccaaaggccgttccctggcattattctagacagaacaacccagacggcaaaaatgtactgctgtggagagatgaatcaattcctaggaggactggacagacattctcaaaagtttgttggaaagat

SEQ ID NO: 232831 - DNA, 382 bp, Homo sapiens
ggattttctctaatctgattttgttgcttctacccataatcgtactcttgatgctgaatgctgattggcaagtcagaaacttggccaggcatggtggtgcacctgtaatccaagctacttgagaggcagagtcaggattgttagagcttaggagttctgggctgtgatgcactatgccagtcggatgtctgtactctttggcatcagtatggtgacctcccaggagcagggaccaccaggttgcctaaggaggggcgaactggcccaggttggaaagggagcaggttaatactactgtgccgatcagtagtggcattgtgcttgtgattagccactgcacttcagcctgggagacataggagatcttcatctcttaaaaaaa

SEQ ID NO: 232832 - DNA, 425 bp, Homo sapiens
tgcatacatatatacgtacaaatatttcatagtaagtaccatttcttcttggacccttcctggcactgtgctaactactttctacaaacttagcttacataaactcttgatatacccttgaggtgagtaggtattatctgtagtttacataagatgaaatagagcctcccagcagttaagtaacttgtgtgaagatgggacccttgttcatgatggttctagaaccttcatcattaatgataatgctgaagtaagtacatgaattgcctgaagaagtggtcagagtttatcatagaaaatctagctagtactcagtgtgtggaaaatgtatacactcttgcatttatggaaatgataatgttcagtatttctgatattctattaactattttttaaattagcaaaaataaaatacaaattggcaa

SEQ ID NO: 232833 - DNA, 503 bp, Homo sapiens
caaagatgagagttatttttctgtgtggtgcctggcacacagtgccggtgtgcaaaatcaccaacgcttggattgtcgatgtaacatttgctcacggaaagctgacctcacccatgttgaagctccctttcctcatctgctgagtcaggatgcagatggggtggctttcagggactgctatacagacagagttctagaaggttgtgtggcccggaagcggtgctgtgccgatgttaggggcctctacctctgaactacaagcaaattctcccctccaacaagagcacattgtgttctggccccggtctcccactaaggctactttaaatgcagatccttctgccaacagctacttttagcaagggcagactatcataaggagagaaacttgcaagaaaatagcaaaatggaagcattgttcccgagggtttggagcaggctcagggaacggtggggtgggagagccctggagacgtgctttgccatcacaaataagttgtgca

SEQ ID NO: 232834 - DNA, 734 bp, Homo sapiens
agaattcctaaggatgaagatatttttccgttgtctgctgaatccctgaagcctagcatgtgtaagaagacacagaatgcatattcactgtatcatttagtcctgggctgctgagagaaaatgcaatctctatgacaaagccagctccaccttctatcggtcccctactgttgggtgaatagtcctccaaatgctggcaggaaggggattgactgctaaggaaggaaatctcaggcacttctcatatctgaaaggaaggcacaggaagagccgcaggatggaactcagactggatgaaactgggaagattttgctagacagaaattagaaacgctcctacaaagaaactgaagttccatgaacatgctgttgccaccctgcaatttagtgtcatactctacttgtaactctcacctaacaatgtgtcatctttactttttatgttatttatttacaagtgcattttcagtatcaaccccttcattcattaatcctaatgtggccttttccaatgtctacttaccattttaaatacttaccataatttacagggctttcttgaacatatccaaggtatattatatgagtctagcttaatggaaagtcttgtataccaaagcaggaaaaaaaacacatttaatttatgatggctttgaattttgatcataatttactcctggagacctattcacacaaagcaataccaatacaatttttcagaagcaataaaaaat

SEQ ID NO: 232835 - DNA, 400 bp, Homo sapiens
catgaactaaatgatatgaagataacacttccagttcttaaattctgcaccagaaatgcctgctgcacagccagtcaccagtgcttccatctccacatcttcacgaaagagcaaaagaaaagacatggaagtaacttaattgctcagtgcctcagtttcctcatctgcaaaatggaaatcataacagcatctgcctcatagggttgtcttaagaattaaacgagctaacaaaagtaactggcacacggagctcaaatgtcagcgagaattatttccattatggtcactcttattactaattctatatcaaccaataaaatattcctgccagtatttttcctaacccaataaactctgcactacagaacttttagagctaatataaagtactcttgtcaaa

SEQ ID NO: 232836 - DNA, 321 bp, Homo sapiens
ttaacatttcttccaatctcctcctgataaagtctgagcctcctttcaaggctcatctccaaggccatctctaaggcaatttttcgtccctccttacactcttaaagtaacttctccctcctttcggccagtacttaactacattcggccttgtataataccttattgcatatggttcttaattctcctttcagaatcttggctccttagaatgatccccttcactcctttatatgtgagagaggagaaagtaccagagacagggtttccatgccatataatcttccttttttatttgggacaaggagtatactatattgt

SEQ ID NO: 232837 - DNA, 387 bp, Homo sapiens
gagactcatacagaagaaaacagagattaaaattgagagaattcccacggaaggacacagagctccccccgcctcagcctttctctgaatgtgactcagtagtgttcacggcataagccgtcctccttgcttcatgccaccctcatcctcaacacaggttcctgcacaggcagaatggctggaagctctggatagagcacaattccaagatgtccctatcctaaagtcagggaaagaccactctgtgaaacagactctagaagaacagcaattggatgcctttgttgtttgtaaagtaacccatgggcaatggattataactgagttgctgatgggatcatcctgtttctcagtccagtcaatagaactcttcattgtattgtgatc

SEQ ID NO: 232838 - DNA, 417 bp, Homo sapiens
ctgtaaagctgagctcattgactaacgcttaggaagtggagggccttacattctagattccaaccttcgcctacaacaaaggaaactgccggtattttcccattgctagtgacctctgctttcttgtgaccaacaagtaagcaagtcaagtccatttgttaagctctgtgactcttttcattgttaggaaaatttggacttcaaagtgagggagttttgggggatgcttggcctctttgggaccgagagggtgaggacagctgttttcttgttcaattggcagccctggattaaatttctaattttcttcctcacctatttcctccctgtttcctataagcttagcccttttcctggcacatagtaggtgttcaataaatatttgctgaatgaatgaataaagtgcattgtgtgaac

SEQ ID NO: 232839 - DNA, 555 bp, Homo sapiens
ttagacaaatggtgttggaacaactggaaatcaatatgacacagatccattagacacagatcttacaccctttacacaagtgaactcaaattggattatattcctaaatgtaaaatgtaaaactatatgaacccatagaagacaaccaaggagaaagcttagatgacattggctatggtgttgactttataagtagaacaccaaaggcacagaccatgaataaaataattgataagccagggtttttgaaaaattaaacacgtttgttctgtgaaagacactatctagagaatgggacaagcagcagcgactctcattcattgctggtggaaatgcaaattgctacatccactttggaagacagtttcacagtctctcacaaatccagcaactatgcttcttggtattacctaaataacttaaaaatttatatctatacataaatctacacatcagtgtttatagcacctttatttataatagccaaaacatggacccagccaagataaccttcagtaggtgaatgaatacattgtgggcatccagaaaatgaaa

SEQ ID NO: 232840 - DNA, 746 bp, Homo sapiens
ctggaatagctagttccttgctgtgtggccttgggcaagccactcaagtgctctgggctgtcatttactcacctgtgaactaagagggctgaactggatgatattgaaggtccctattagctctaagtcagggcccagcatgcaggcatatcaagtttcttttcttcattttcaaaaagtaagcttctgagaatatttttgaccatattgcaaagtcaaataattattgagtgagtctgttatttcatgccattccttttctactagctaatctagtttgcaaaataccctatgctgctggtgaaaggaaaaaaaaaaacaaagtgtgaacccaaaactcatgattcattctaagttagttcaacagattagttcctcattctctcagatctccagggaagagacatcaacaccagcccatcgctgataccctttgtcctggcctccggagcgctccctgcacagtcccaagtctgcaagaagggggatcttttcttgaaaacctacagtgctaataattgtcaaaaatatataaattctaaatttaaaatttaaggtattggtgcctatgaaatgtccccaacacaaagaaatgataaatgtttgagatgatggaaatgctgattaccctgatctgatcactcactttatatgtattgaaacatcattatgaactccatgaatatgtataattgttattagtcagttaaaacaaataaaactaaaaatgtttaacgataagaaga

SEQ ID NO: 232841 - DNA, 466 bp, Homo sapiens
ctatatatgagttatattatgcctaagatatattaataaaaacaatgtttgtcaagtacttgctatatgccaggtactattctaagcacatatgttctaaattaatatatgtattactttaaggatacataacctagtgtctttttggggtccatggatgaagtgtatcttcactcacctttaattaaattcggttgtttcattcttcatttgtgaatgtagggcattcacaaattcacaaattcattctttcaattgtgaatgtagggcacaagccacagtagtgtcaggagtgcctggaactttgtcaccattagaaatcatagctatttttgtatcttgttataatgattatagatatctcaaaatattaacagtcatcatttgttttgacctaccactgatcttgttatttaatgtattagcaaagaagcatatatagtacaatatcaaaactgtgttcttt

SEQ ID NO: 232842 - DNA, 386 bp, Homo sapiens
aaaatgtggcagtgacagagtatggggtgagaaccacggagagaggaagtccccgaggcagatgatgggacagagagcggggaccagaattttttaaaacgcatctgagatgcgtttggcagactcatagttgttttcctttcacggagaaagtgtgggcagaagccagctctaaagcccaggctgcccagcctgcactggcagagctgacggaaggccagggcagagccttccctccctgtcacagacatgagccctggagatctggaatgaggcagatgtgcccagggaaagctgatccgccccgacccagggccccccgggtgcccctttgagcgtggaatcgttgccaggtcatggctccctgctatcgaacaccggacatg

SEQ ID NO: 232843 - DNA, 661 bp, Homo sapiens
ctgatttaggagagggttttcggtactttgaaatattaatattatgaaagttgaacactgatgtttcaatctgcttcactccatccccattacttcttgtcagctgtctatgagcattgggccacttgccacagttttacatgataaccatatttaagtggtaaaaaagatcagaacatatacagtgccttcttaagtcaggttcctgatttatttctggtactatccatttagatacatattaatttacctaatttcttaaatccatggaccagtactgatattcctgtttgtctttatttaggattttacatgtgtacgttaaaaaatacattggtaacagctgactgacaaccaaaaaagtaaaaaagcaaaacaaaaatcaccgtgctttgacaggtttgtcatgaagcaaaatgcatgagaaatttgatctgtttcagtttgcttgttatcagtcagaaatcacctttgctttgcccagagaagactcaggttcactgaattctcttcaccactccgtgaaagtgtgtagcagcatggacagcccatgttatgtacagagtaaatggtgcactgggtggcatgtggaatcttgaaaggacagtgtctcttagatgcttaacttactactgggagtgaagaagatcaatgaatctca

SEQ ID NO: 232844 - DNA, 438 bp, Homo sapiens
ggcgctcgcgctctgtctgccagacgggcttcccggtaactgaggggctgcgtcctgctagggctctggggaaagggacccccgtgagctagacagggaggagatgggagtccaggacggcgcgtggggtgttatgggcccgggtccccccgccccgctctggctctggcagcgaggcctgggcgcggcctttcctccgagctgcagtccttgggcctctgcttggagacgttggtgtttatgacctcgcctaggagggggacatgggctggggacagtcagggttcgactggcggctgctcgagccccggtgcctggcgggaacagggagagggcttttcgggcttcatccagttcccctctgctctccacggccgcttcaggcagagaccaaaatggctccccgtcatcgccctgagaggctgaaggggcctaatt

SEQ ID NO: 232845 - DNA, 485 bp, Homo sapiens
cacagtataagtaacaggaattgtgtggcataaggaagagtcctgagtgggttctcaaattggacaattctgacaggttacagaaggtcataaaataggctgaaaaaaggagaggggtggaggttatgaaaaaatacccaggtcagaggaataaaaggccacaaaaggcaaacttactactttataattgtgcctaagtcaggcccagtctacatttctattttgatgactgatttacatacacactcatatacattttaactctgaaagtagaagttccatatgtgttttatttactctcatttattttttatctttaccagttggcctatttttttttttcttcacatgacatcaggagatcatcattgcaacaagcaactcagcttagaagcgctgggataactccgaaagagacatgtgagacaagatgtagaactttgtattagagtacaataaaatttataatgcacaaaaaaaaaagc

SEQ ID NO: 232846 - DNA, 392 bp, Homo sapiens
atgccctgtggtgaggcctaccaggtcttaataataaaagtggtagactgttagccatcagtctaattcaagtgtccagactggagttattacaatgagtagcacagccatgtgaccagcattacttcctatatatacagtcttgaatgtttattcagaggaaatggattacaatttccctgacatttgggcataaaacatctgccatcctatgaattagaaaagtaatgaggtcttggatgatatgtcacttatctttattaaatgcagctctcagcacgtagtagcatctagtgctcaataaatgcttgatgaatgaattaaatgaatggactatcactacatcatagttcggctgtaaatacatagaataaaatgatttggcttatgga

SEQ ID NO: 232847 - DNA, 221 bp, Homo sapiens
caaacttcagaatatagtatctattgcttcactcccacttcccaagccctgcccaaatttttctcctggtccactctaactcagaaccacattgggaaggcaattccaggaaactatgtttctagcttagctaagttggcaaagccacttcaacaaccgtgagacaaatacagactggtagaatgtgactggccactattagagaaaaggataacacacag

SEQ ID NO: 232848 - DNA, 474 bp, Homo sapiens
gtcagcagggaatataatagtgtcactttcatttcacttctagagcaaagcttaacaaactttcttgagtgtgtgacactcacagaggatgcaaattcccaacaccctccacccagccccagcgtctacttctgtgggtctaatggggacccaggaatggctcttttaacggccccctcatgagattgatgtgggtagttcccaaatcctgtgaggtgggctgtcagtgcaatagagcctggggtatgcccatttgtgcttaggccactgagaaatttacaggctcgataggcctttggtatgttcaaaggtgagtgaaggataacaaggtgaagagatgcctgtgaatctgattttttggatggctgcaactaagagtcaatgggcatgaaaaacaatccaagagctcacatttatatgaggcccttatcagtactgagagagacattctcacttcacaagcttggatgtgca

SEQ ID NO: 232849 - DNA, 509 bp, Homo sapiens
gctcggcaaagcttctgatacgtggtcctaagcatcacagggagcatgtctcaaagctgtccccgactcatggctgaggctgttttgcgtagcttcacaacagggctctccagcactccccgagatcctatgagctatctaatatctttaatcaacttcttctctgcttaagagccagacccactctggctagtctcaagcagagaaaaagtgaaataaagaatgtcaggcaactaaggttcctgaccacagagggtttcaagctgggagctatcacatttttgccttcaaaaggccactctggcagcagaggtgtggatgaattaagaggaaaatcacaggctgtggcattaatttaagagctgatcaagacgggcctcgaccaagggagtgacaaaaggaaaaaaaaaaattaggagggaaaaggcaaaaaccacaaacctaaactataaatatgcagttctgtcagtaaacacataaaaacacacagataaataaaaatcaaaaag

SEQ ID NO: 232850 - DNA, 602 bp, Homo sapiens
cacacatgaaaatcaaaccaattcttgcctgtctaaattaatttccagggattctgtgtgtggggcaccatataataattccacaatatttagcacagtgctttgtccttaagcaactatgaacaactcctcagcactgttgttcttctttggaataagtctacataataggcctcaggaaataaatacaatattagagtgtaagaaaatcagttaatgaaaaataatcatgagtgaaactgatccttgttgatgtataaaataaattttatgctacatagttataaggttgccgatgagaaatatcttgaaataggttgtgaattttaagtttgcgcaagtttttttttttcagaatcaaaatgtgtttcattctgtgatcttcctgtgatgctaattcttctggggtcacaattttttcttgtattattcagtgggcagattaatttctcaatacgtgctaatctacaattgagatgcttaaatcttcacctgcactgatctcttccattttctgtggcacaaaaagtgaagtataatattcatttttctacatcagacaggtctttctgatatacctttcttcacagtcaccagtaaca

SEQ ID NO: 232851 - DNA, 444 bp, Homo sapiens
ttaaaataatattgattaatgttaccagaaaccttttgcatctcttaatatgtctgaacacaaaaggaaaacaccataatcatataaacccattctttgtctcttcttctaaatcatatgtataaccagtttttccttaagaatgtagcagcatataagctataaatttctggagtatatgcacacaaatttatctgggtgggtatgtaggtatatgtgagtttgtttcctcttccaggagctcaagaaataacatactcctgaaaaatagaatagaaatttctgtgctttatgtttttgccaggctattacattttcttatcatttaggatcacttataaaatgatcattgtttattttgttttataatttttacaggagtgagactgcaaacccacatgtttgatagttcctaccaaattaaaagtttagaaagcataaatc

SEQ ID NO: 232852 - DNA, 275 bp, Homo sapiens
ctgggtgacagagtgagacaccgtctcaaaaacaataaaaattaaaaaaaatggacatatggtttattcattgggaagagcacctagtgttggcatgagtgtaaaaatgttcttagcagccaagtcattgcagacctttctctcctactctgtgttctggtcttcatatatttttctttctcacaaattctaccattatgatcatagttgtattcatcttcttgagtcagctaaataatccttatattttgatgaaaagtaaccttcacttccaa

SEQ ID NO: 232853 - DNA, 453 bp, Homo sapiens
gactttgtctctctgggcctggtatttcttctgagagtattgacacttagccaaaagccacaatcttctagcctgccctgtgtgatttgatgtgtgcactaaataatgaggccttccccaaaggcagtcatccagcctgctgggcttcacctctccctgaggaaacaacaaaaccaaagatgtcattcacaaacaatggagaagaaaccaagagaggtatgcagcccattcgtgcacagaatcgagattccaaatgacgcaaaatctaaaacatagctcaatgtaaacaaggtcagcaagacagggaattccacagtcctcatttgaggaaactgcccactggggaaactcgtaccaacagcctgcaatagttcatttacttaaaagcagggatcctttgctgacactggtttctctcttattttgccccgccaataaaaaaagctgaagcca

SEQ ID NO: 232854 - DNA, 498 bp, Homo sapiens
gcatagattacctacataagaaatatcattgtttcagatgtctgttgctgtttaacaatccattgtaaagcttggttgcttaaaacaacaaatacttactattttcttctaattctgtgagttgagtgggctcttctgggtggttcttctagtcttcagttgcaagtaaatttgatttaattgattatgactgaggtcactcatgtagctacattcaatttcaactggactggggctggagctgcaagaatggcctttctccaaggcctcttttcagacaagctttagtcattcactggtctagcctggacaacatggcagctgggttctaagagagagacagtggaagctgctaatgctcttactgtatggtcccaaaagccctataaccattttcctttcaccttcaaattggtcaaatcagttacaaggccaacccaaatccaaggagaggggaaatagagggagacatatgcagatagagaaatggcaaaaaaa

SEQ ID NO: 232855 - DNA, 157 bp, Homo sapiens
tggtgcataaataattctggtagattcaactagattatggtctatggagatatcaaagaatgtagggtgtcaggacctagattcctagaaatttagaacgaggggaacaggcaatttgccaaagggcaaagagttcatacttcaacgttatctcctg

SEQ ID NO: 232856 - DNA, 668 bp, Homo sapiens
taacagttcagtaaggctgcagctgttattacaatcattttataagtgaaggaacagagaggttaagtaatttacttaagggcatacagcagttggccactggtggaatcagtatgcacaacccatcatgaccctgtgttcatgctcttaacttttgtaccattctgcttgttcaagggaacatacatccaactgagggaggtggggtgaggggcaagagtttctatctttctacacagtgaattttattaattctgtagagctcatcttacagtactaccaagtatggctgcccccaaatctgtgactcagccaagattatttttaaatatttcccattcttatgacctatccaccactttggcacctatcctcttccaagactatctcagcatctggctcgctacctttgaccataacaaacatttgaataacaaaccaagtttatgaagtatcatgggcatgacaaattagtttaagaaacattcattcagtaaattttgaacccccatagtattccaggcatacagattcaaagataaacgtgagcaaagcagcctctctggtgttcccatctggtgaagaaggccgacatgtcagcaaaaatccatatttaacctacgttctcttatattggttagtgttacctagatttgcctaagcattaa

SEQ ID NO: 232857 - DNA, 1865 bp, Homo sapiens
caagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctgaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcagttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaagacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtaggatgtgccagagtagttatgtggctttatcacaaaaacgtttcttcaccttttatttaaccattcattgattgcctgaaggggtccatgaataaaatttttttcaatat

SEQ ID NO: 232858 - DNA, 910 bp, Homo sapiens
gtccggggaaacagagggaagcaaacagatccaagaaatgtgttcaagattgattttgcaggacagaaaatgggaggtgtataaagagacttccaagctcctgatctaagcttaggagggaatggccagctactgagatggggaagctgaagtgtgagggagttcaccattgcaagtaagtcgcatttaaaatatacatgaagatgaaagtctatgagagtggtggtcattcatccataaaagtgagagagagggtttctgttcatttccaggtgggtttgtgcccttcgtgatgaccccttggactcacctcaagcagaggtctaaattacttgagagtgtgttcatgtaaattcactagtcagatatgaatgccactcaggcatcacaaaacaatcacagaagacaggagtgagcgcattctcaagaatgttttctgaaatgagcagaagagctttgataccagaagactttgtgttggaatttggctttctattattagaaaacgttatcatccggagtatttaaaagatagatatttggtttaaaataaatctaatcctctcatattatgtttctggttctaggccatcttaaatggtttcctgagtgactttccaccagctgtaaagcaaactgcatcaagcattgtagaagcctcagttgagatttataacttgagggacttatccaaatgtgtgcaaggtagtgtactgaaccctcgttttctgatctgcaccctccctacttttccattggcccccaaatatctcagtaacattgtatgtatgcaggtgttggtgactcacccagaaatcccatcacctgttcctattcaggctgagtgcttcacaactatttcacatggccaacactgcctcccatttctcactcccagctgattacttgt

SEQ ID NO: 232859 - DNA, 964 bp, Homo sapiens
gtccggggaaacagagggaagcaaacagatccaagaaatgtgttcaagattgattttgcaggacagaaaatgggaggtgtataaagagacttccaagctcctgatctaagcttaggagggaatggccagctactgagatggggaagctgaagtgtgagggagttcaccattgcaagtaagtcgcatttaaaatatacatgaagatgaaagtctatgagagtggtggtcattcatccataaaagtgagagagagggtttctgttcatttccaggtgggtttgtgcccttcgtgatgaccccttggactcacctcaagcagaggtctaaattacttgagagtgtgttcatgtaaattcactagtcagatatgaatgccactcaggcatcacaaaacaatcacagaagacaggagtgagcgcattctcaagaatgttttctgaaatgagcagaagagctttgataccagaagactttgtgttggaatttggctttctattattagaaaacgttatcatccggagtatttaaaagatagatatttggtttaaaataaatctaatcctctcatattatgtttctggttctaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtagtgtactgaaccctcgttttctgatctgcaccctccctacttttccattggcccccaaatatctcagtaacattgtatgtatgcaggtgttggtgactcacccagaaatcccatcacctgttcctattcaggctgagtgcttcacaactatttcacatggccaacactgcctcccatttctcactcccagctgattacttgt

SEQ ID NO: 232860 - DNA, 918 bp, Homo sapiens
gtccggggaaacagagggaagcaaacagatccaagaaatgtgttcaagattgattttgcaggacagaaaatgggaggtgtataaagagacttccaagctcctgatctaagcttaggagggaatggccagctactgagatggggaagctgaagtgtgagggagttcaccattgcaagtaagtcgcatttaaaatatacatgaagatgaaagtctatgagagtggtggtcattcatccataaaagtgagagagagggtttctgttcatttccaggtgggtttgtgcccttcgtgatgaccccttggactcacctcaagcagaggtctaaattacttgagagtgtgttcatgtaaattcactagtcagatatgaatgccactcaggcatcacaaaacaatcacagaagacaggagtgagcgcattctcaagaatgttttctgaaatgagcagaagagctttgataccagaagactttgtgttggaatttggctttctattattagaaaacgttatcatccggagtatttaaaagatagatatttggtttattaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtagtgtactgaaccctcgttttctgatctgcaccctccctacttttccattggcccccaaatatctcagtaacattgtatgtatgcaggtgttggtgactcacccagaaatcccatcacctgttcctattcaggctgagtgcttcacaactatttcacatggccaacactgcctcccatttctcactcccagctgattacttgt

SEQ ID NO: 232861 - DNA, 651 bp, Homo sapiens
gggtgtggacccccaagcagttgaaaatccatgtataatttttgactccccgaaaacttaactaccaatagtctactgttgactgagaagtcttaccaataacatgaatagtcgattaacacataaacagcccagtatctgtatatatatttttatacattcatgatgtatctttttcttaatttttttgatatttctaggctacatggtttgtctatgttttttcaaattgttgcaaatctccaaaatttttctagcatatttcctaaaaaacagcatatgagtggacccacataattcaaacccatgttgttcaagggtcaactgtacttattaggttaattgcttatttcagtgaaaccatcactacttaaaacatttaatgaactcagtcacaaatatactcataaattaaagaggccaattttcatatgtggctcactagctttagaagacattaaaatgaacattttaagaaatggtaaccactgcgcccggccccaaaatctattcttagcaaattttcagtatagaatagtgttactaactaaagtcctcatgctgtacattagatctctaggtttattcatcactcataactgcaagtttgtgtcctttgaccctctcctcatttccttcccctcccaactc

SEQ ID NO: 232862 - DNA, 607 bp, Homo sapiens
gagacaggctcatagcaggatcgctttgctggcagacacacctggctttgaatccagccccgcaacttggggaaagttacttaacatctttgagccacggtttcctccttcataaccagacagcaacactccaagatgcttgtgaggctctcaagaggatttattccagcgctgagcgcagtgcctggcgcacattaagatgccaggaagccggatgggtgattgctcaggtctgtccagccagttgggcagccgtcagaaactgggagggctgacgagacaccagcccagagagctgtcagggagcggcagagcagaggagagggcccaggatggatcggcaggtgtcagccaggatggacgggaggagccgtgctcagagccagcagccccaggacgagcagctcctggctaggaacagaagacaggcactgtgggacaagtcaaagggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaa

SEQ ID NO: 232863 - DNA, 308 bp, Homo sapiens
tgcagccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaa

SEQ ID NO: 232864 - DNA, 231 bp, Homo sapiens
gtgctgggattacaagcatgagctaccacgcccagccacatcttgcaattctatactgtttttcaatttacagggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaa

SEQ ID NO: 232865 - DNA, 407 bp, Homo sapiens
tctatttattatacttgtagtttcaaaattactgagaaacaaatttactacctagaatactgtgttaatatacaattttctttagttttacagtatccagtcaaaaggctgtcttccaaaattgcttaggtcagctacttctccatgcaactctttcagtgaggctgtatcatgcgtttgtaatattgttagattcatttgttatagcctgctttctccacaggacttcctaacagcctatttcttttttttttttttttttgagatggagtcttgctctgtcaccaggctggagtgcaatggcactatcttggctcacttgcaacctaggaggcagaggttgcagtgagctgagactgcatcattgcactccagcctgggcaacatgcaagaatctgtcgcaaaaa

SEQ ID NO: 232866 - DNA, 1491 bp, Homo sapiens
  misc_feature (506)..(506): n is a, c, g, or t
  misc_feature (570)..(570): n is a, c, g, or t
atccaacagttctgatttattccactcacacaacaagtcagttcttaacacaaaccacataggttcttccttaaataaaaagctgtggctatgaagaagtgagagttttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcgagcagtcctcctgcctcggcctcccaggtggcttggaaccgcaggcatataccaccatacctggacatgtttttaactttaatttttatttttgtngagatgaggtctccctatgttgcccaggttgctctcgaactcctaggctcaagcagtcttcccnccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatagtcagagctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgctgtcacaactttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccgtgagtgactaaagtaatgcattaatggttgaatggctggccaccgtgcctcatgcctgtaatcccagcactttgagaggccagggcgggcagattgcttgaggtcaggagttcgggatcagcctgggcaatatggtgaagccccgtctctactaaaaatagagaagttagccaggtgtggtggtgggcgcctgtggtcccggctacgtgggaggccggggcaggagagttgcttgaacccaggagggagaggttgcagtgagacaagatgatgccattgcactccagcctgggtcacagagcgagacttcatctg

SEQ ID NO: 232867 - DNA, 1668 bp, Homo sapiens
  misc_feature (506)..(506): n is a, c, g, or t
  misc_feature (570)..(570): n is a, c, g, or t
atccaacagttctgatttattccactcacacaacaagtcagttcttaacacaaaccacataggttcttccttaaataaaaagctgtggctatgaagaagtgagagttttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcgagcagtcctcctgcctcggcctcccaggtggcttggaaccgcaggcatataccaccatacctggacatgtttttaactttaatttttatttttgtngagatgaggtctccctatgttgcccaggttgctctcgaactcctaggctcaagcagtcttcccnccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatagtcagagctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgctgtcacaactttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatag

SEQ ID NO: 232868 - DNA, 1209 bp, Homo sapiens
  misc_feature (101)..(101): n is a, c, g, or t
  misc_feature (165)..(165): n is a, c, g, or t
ccgggcgcggtggcgcgtgcctgtagtcccaggtggcttggaaccgcaggcatataccaccatacctggacatgtttttaactttaatttttatttttgtngagatgaggtctccctatgttgcccaggttgctctcgaactcctaggctcaagcagtcttcccnccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatagtcagagctcatgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgctgtcacaactttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatag

SEQ ID NO: 232869 - DNA, 356 bp, Homo sapiens
agagagagagaaaagaaagaacgaaagaaagaaagaagaaaagagagagggatgaggagaaggagagagggagggaaggaagaaggaagaaaaagagggaaggagggagggaggaaggaaggaaggaaaaaaaaaaatacccagcttctctagaaccagcagatctgcaaactggaccctcagtgccacatggcacccatcggctagagcagagagctctgtctgtatctttcagacagagttatctgggtcaccagtgcactcatagccactttactcatttgtgttacctgtctggcccctgaaagtatttgtgattttgatccccaataaaaccataaagctttcttcaaatg

SEQ ID NO: 232870 - DNA, 630 bp, Homo sapiens
gaattttgtgggcttggggagattgtgggttctctgatttcaaggggaatgatgtgatcctagagttgcaaagaacaagtgacagtggaggcgcttatgctttgtgattgcactagagacaaggaagacacaactagaataatggggagcaggaatggagcggccaacagaatatctgactgttagggatctttgatgaaggctgattctcagggagtgaactagatcagtgaccaactatttgtctttatataactgggtaatgtggatggattctaataaagggactacttacagcacagcaggaaagacacaaagaaaccagacagaagagtgtaagtagtaaggggccaagcagtcacctgactagagagagtgccagcttgccaagaaggcaccagacagaagctgtgatcttcagcaaagggacacagtctgcctgtgctgaccctgcaggggcagaggtgggggataaacacactcttctctcacctgtcttctgccaccccctccattagctgaaccccaataaaagcatgagggtaagggagatctctgcagtatccaattcaggtgagcctcctaaggaacaaagcagaacgtagaaaaattaagaatgggtctagggaa

SEQ ID NO: 232871 - DNA, 564 bp, Homo sapiens
cagcccttaaccctatgctgtagccacagatgcagcctgagtccgctgcacggagactctggcgtgggtcttgacgaggtgctcagtgaactcctgatacagaagactttggagagatacagactccttccaaaggctgattctcagggagtgaactagatcagtgaccaactatttgtctttatataactgggtaatgtggatggattctaataaagggactacttacagcacagcaggaaagacacaaagaaaccagacagaagagtgtaagtagtaaggggccaagcagtcacctgactagagagagtgccagcttgccaagaaggcaccagacagaagctgtgatcttcagcaaagggacacagtctgcctgtgctgaccctgcaggggcagaggtgggggataaacacactcttctctcacctgtcttctgccaccccctccattagctgaaccccaataaaagcatgagggtaagggagatctctgcagtatccaattcaggtgagcctcctaaggaacaaagcagaacgtagaaaaattaagaatgggtctagggaa

SEQ ID NO: 232872 - DNA, 457 bp, Homo sapiens
gcctttagttctttccctcctcagattcatgagctgcttctcacctcttaaatctggtctacctatagtgacttgcttgaccaacagaatatgctaggagcaacattctggaacttccaaggcttggttgtaagaagctttgcaatatctgcctggatctcttagaaccttcaatatgggacacttgctctagaaatcagccaccatcctgtgagaagtccaagccacagagtgaggccagaaatagttgctgcagtcaagagccccagctgagctctcagccaacattcagcatcactgccagccatgtgagtgagtgatggtgaccttggatgtccagctcagtagaaccttcagatgatttcagccctagccgttccaactgcaagacatcctgagtgagctgagcccagtcaacagagatgtgagagataaaaatgcattgttttgagacact

SEQ ID NO: 232873 - DNA, 421 bp, Homo sapiens
cagcagaccgctccccagagccctccagagaggacgccccactgaagatgactctgttgggggtgcacgaggagggagaggccaccgagggctggagggcaccaggattggaagaagactggagtcagtgccctgccatgatccacaggctgcaggggccactgcccagtcaggcactgtcacccttgctcccagcttcacctgcgctttctccagtcacatccctgggaggctggctcggctgtgccagctgtgactctggcagtcactaacctaaccccttggagcctcagttcccattggtgcaatgaggccatgtcttctggaatcattaagagtcagcgtatgtgaacaactttcagaactacaggccactctgcaagtgtagtaagctgatgataaaaatctcaaactgatatct

SEQ ID NO: 232874 - DNA, 312 bp, Homo sapiens
tcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcctagttttcaagatttttgtccaaaaatataatttgaaccatgaaccggga

SEQ ID NO: 232875 - DNA, 715 bp, Homo sapiens
ccagctacatgggaggctgaagtaggagaattgcttgaacccaggaggcagaggttgcagtgagccgagatcataccactgcattctatcctgggtggcaagctagactccatctcaaaaagaaaaaagaaccatgtgaaaaggcatttcagaaaagtgtcattccacctcatcccttctgtcacgtttcagtctcccattcttcccatctaccccgtaagtgaccagtttagtttctacttttttcttctgtatttctttttgcacaaataaacaggcacatatatgttttcttatacagagatgatattcagtgtctttttttgtgtggtactgggcaatttaaatgctgtttggtaattttaactcttaaggatactgtttataattgatctgtccttaatgccaatgtattagaaagcacactaaatgattgttttcttttttgtaaaatatttgtgagattttttaaaaaatgaaggtgacatgaattttgatgggcttattaacactgaactatttcttgataagagttgtctaaaaaaatgagaacatatgccaggcgcggtggcttatgcctgtaatcccagaactttgggaggctgagacgggcggatcacaaggtcaggggatcgaaaccatcctggctaacaaggtgaaaccccgtctctactaaaaatacaaaaaaaaaaattagccgggcgtgttggtgggc

SEQ ID NO: 232876 - DNA, 474 bp, Homo sapiens
tgactcttgtttttttatctgtaaactggaggtctcatttacctacttaagactacatctatagtgcctatcttgtggggttgttaagattaaatgagatcatggtttataataagtacccaatatatgttagttgttacagtattacctgtttataggttgtaaaaaggtcagattgagggtgggcgtggtggctcatgcctgtaatccccacactttgggaggccgaggtgggtggatcacgaggtaaggagatcgataccatcctggccaacatgttgaaactccatctctactaaaatacaaaaaattagccagacatggtggcaggcgcctgtagtcccagttactcgggcgggaggctgaggcaggagaatcacttgaacctgggaggcagaggttgcagtgagccgagatcatgccactgcactccatcctggtgacagagcaagactccgtctcaaaaaaaaaaaa

SEQ ID NO: 232877 - DNA, 407 bp, Homo sapiens
gtggctgttcacctcgccacagtgcctgcctggtggtgagcgctcagtaaatggaagcttctgttgcatcctcataagggccagccccttgctcctctctatctagaaaaagggttggccaaggcatcacaccgtggacatctgacccctcctcccacctgtgccggaagccacaggcctcaggcctgttcctgctctcctccagccctggggctgaaggctccatctctggtcctgcccgtgactggcctccctcctctgcctggcccttccaggatgtctgctggacactttgttccagaaccacttttttttttcttgggacagagtcttgctccagcctgggcaacaagagcaaaactcggtctcaaaaacaaaaaaaacaaaacttatagatgtatctacca

SEQ ID NO: 232878 - DNA, 518 bp, Homo sapiens
tctgatatcaacccatggtgccctcttgtggcaacagaaatgctgcatttgaattaccgaaagatcactgtagcccagccagagagttttggttggggaaatattttttgtttgtttcgggcaatgaccaggagcccgtgatgtgctacagaaggctcacagtggcttgtgagagccagcggttaaattttcgggacttctgcaaactggtttttaagcatagccattatggaaaattaaagtatttaggctgggagcagtagctcctgcctgtaattcctgcacttcgggagactaaggtgagaggctcgcttgagaccagcctgggcaacaaagtgagaccttgtctctacaaaaacattttaaacttagctaggcgaggtggcacatacctgtagtcccagctactggtaagggcgaggtgggagaatcccttgagtccagcagttcaagattgcagtgagctgtgaccatgccactgcactgcagcctgggtgacagattgagacgctgtctca

SEQ ID NO: 232879 - DNA, 473 bp, Homo sapiens
ccactgccgctaccaccactttccacttataccaataactccatgctctcacatttttaaagatttgactatgctatctgtccctcccttccctcctgatcattcttcccttcctttatggatcaacttaaatgttgttcacatgcaagctttttttgacttgacctctgtctgtgataagagaaaaacatactcctctaagatagcatttattattttatttgtaaaacttgtttaattttttccccactgagttataatctcagaagaaagtgtttatcttgctcaccacaaaatctccaggatttatcagagtgtccagaagacactattgtatgtttaaaaattgttaatggatgaatgaatgatgactgaataaagacacagagctacctcagtaacaacttcaaattaaaagatatatagcatatactgttagatagcctagaataaatattaatttcatatttatc

SEQ ID NO: 232880 - DNA, 496 bp, Homo sapiens
tagattccctggaatatgtcggagcttttcaaaggctcctcaggacatcttcttccccagtttttccttttaagttttttggtcagcctcttgttagcactaactggattcctgccccagacagctgtgatattaaacaattgccattgatttttaaaataaatgtcctagggctagggctttttgcatggagagagctatgagtcagatcaagtaaagataagacctgacaatgcaccttttcagggaactgccagacaaattaattagtgacagttttctgggatggagcttttgttgagctccaaacctgttctgcccctccattggctgccaggctgttggtggttgtcacagctattttagttgtaaggctgttgattttcaagtctaccatgaagctggggagagggggatgggaatggggcaagttgaaaaggcacaaagctcactgttcttacagagaataaacatttagattggtgtaagcctttga

SEQ ID NO: 232881 - DNA, 447 bp, Homo sapiens
aatcactcgtgtctcctgatggcaagttgttcacttgttcttactatgtgaattgacatttacaataatatcctctattagcacatcaaagcagggtaaattcaagacagatcagataaagatttctacatgtctagaacaccaaaaaactgtcagaaactcctcactaaatttaataaaataatttttgttccacattgataaaaaacttacatatctgaattttaaatggcttcttctagatgttctgactaaaaattctgattaagttcattgaagatagaagttattcctgcaggtcccaagaataacgtagtgctagattcactgtcaattctatattaagaattctgggccaggcgtggtggctcatgcctgtaatcccagcactttgggaggctgaggcaggtggatcacttgaggttaggagttcaagaccaccctggc

SEQ ID NO: 232882 - DNA, 429 bp, Homo sapiens
caggaaatatcttatgtaaagctgaggccatcttgactttggactcaaaataaaggtgatattcatgagccttattttaagaccataaatgttaggaagagatggtgtcctgtagaggaaggcactgtgaacaaagtttcaaatgctttgccgtggaatgtgttataattgccatcattatgattagcatcctcacttcaagccttgagttggttcatgagtcccagtaactctgaattatactgattgaaacccttcgttctgaaggacagctctttcgactgcgtctccacttcttgtttctttacgagaaataaaatcccttttcttccccagttctgtcttgtggtaacatgtgctcatgtgttttgtctcattgtagtctattgcatttctttctttaatgaaaaaaatagtaactacccttta

SEQ ID NO: 232883 - DNA, 367 bp, Homo sapiens
gcacgaggttcaattgggaggaattactggactctggaagttgaagactgtccatataattaaaatgtacaataactacccaggtttaccttgcaagtttcaacatacacaaaattaactttatatgactcttcaaaaacagtttgccatcatacctaataatctggtttaaattttaaaaactcatccattttactttttaaatcaacataaatattttgttaaatgatagatgatgaatgctctcactgtccaatcttcacacatcttatagactaagtataaagaatccaagatttatagtgctgagtagtttttatatgtttacgcattattgtcattactgcattttttttgcccattactc

SEQ ID NO: 232884 - DNA, 691 bp, Homo sapiens
aagagtcttggcagatgtgactaagatccttgagatgaggagataatccgtggtgggccctaaatgccatcacatgaatccttataagagagaggcagaggaatattaggaccagacacaaagaggagaaggtcattgaagacagagcagaggatgcttaccacaaggcagtgaatgccaacagtcaccagaagctggaagaggcaaggaaggggcttttgttgccttaagccatcaagtttgtggtaatttgtcacagcagacctaggtaataagtaaatactctatcatattctagaacctatcatagtttctaccatctgttctcttaatgaaaaaataattcatacatttattacatgtttattgaaaggctactatgtgccagactctgttcttgatactctgttcttgataccatctccctcactggcattagaggaaatggacaataagcatgtaaacaagtaagataattttagacagaagcacagtgaagaaaataaaggagtgaaaggaatagggaaagaatgagtgggaagggggctcctttagctcatagggtcaaggaagcactctcagaaaccatgatatttgagctgagcatcacaataatgagtgataaatgctcagataaataacaggagaaagatgctcctgacaaagagaatagcagggaaaaagtcttgcg

SEQ ID NO: 232885 - DNA, 637 bp, Homo sapiens
aagagtcttggcagatgtgactaagatccttgagatgaggagataatccgtggtgggccctaaatgccatcacatgaatccttataagagagaggcagaggaatattaggaccagacacaaagaggagaaggtcattgaagacagagcagaggatgcttaccacaaggcagtgaatgccaacagtcaccagaagctggaagaggcaaggaaggggcttttgttgccttaagccatcaagtttgtggtaatttgtcacagcagacctaggtaataagtaaatactctatcatattctagaacctatcatagtttctaccatctgttctcttaatgaaaaaataattcatacatttattacatgtttattgaaaggctactatgtgccagactctgttcttgatactctgttcttgataccatctcctagacagaagcacagtgaagaaaataaaggagtgaaaggaatagggaaagaatgagtgggaagggggctcctttagctcatagggtcaaggaagcactctcagaaaccatgatatttgagctgagcatcacaataatgagtgataaatgctcagataaataacaggagaaagatgctcctgacaaagagaatagcagggaaaaagtcttgcg

SEQ ID NO: 232886 - DNA, 549 bp, Homo sapiens
atttaaggcagtgttaggcacatatacaggttcacaattatttagtatcctgataaattagtccttctgtctttataatcttctttatctctacttacgctttgtttgccttacagtctattttgtgtaacaccaaatgtagctgctccagcagctacatttttgatttaagtagaaatttcctggtttatcagtttcaatgcatttaaacttttctctgtcattctctctgctctttgtctaaaattgtgtcttttagagatagtatagacctggacttacaaaaaacttccattcaatgagaatctctgtttattaattgctgcatttcatttacttacattcagtatgatgcctaatatatttaaaagtgtttaccatatcttattccatacgttcttttcactttgtttccataagccgccctgcacttctcctattttaatggtcaacatacctgcatttcttccctcctacccctactggcttgaaagctatacaggttatttcttgtttgttttgaccagtattaaaactttattaaagaac

SEQ ID NO: 232887 - DNA, 634 bp, Homo sapiens
tggccaggatggtctcgatctcctgaccttgtgatctgcccgcctcggcctcccaaagtgctgggattacaggcgtgagttaccgcgcctggccacaagaccccatctttacaaaaaactaaaaattagctgggcatggtggcatgtccctttggtcccagctactcaggaggctgagacaggaggatcgcttgagcccaggagatcgaggcagcagtgagctatgatcatgccactgcactccagtctgggcaacagaacgagaccttgtctctaaaaataaaaacaaaacaaaacaacaagaaaacaggaccatcactcacagcacctctgcctctgccctgcctacttgaatgaggtgcagggcatctcacctgctcagagcagcccttgaatgagccccagctatttctagggtcctcaaacgaaacctcccacggccaagtcatacccaacatgggcctcctcccctattctggcccctgctcggagatgctgagtgacagaggctggacttggggtgtttctggcaaagcctcactgcaggaagccccacagctcaggcccagtccttggttcacacggtcccacttccagcttcttttgcccttaagactgatttgtccctgggaga

SEQ ID NO: 232888 - DNA, 714 bp, Homo sapiens
ttaagctccggcttgtatttgtggaattgtacggataccatttccccagaaccgttatgccttattcgcagtctaaaataccctcattaagggaccaaagtggagttcacgcggtgcggccgcttagaatagtggatccccggctgcagaattcggcacaaggactgatgtgccatggtgcaatcatggctcactgtaacttcgaaatcctgtgctcaagctatcttcccaccttggccacccgagaagctgggactacaggcacatgctaccacatacgaccaatttttttacattttttttaaaggcagagtctttctatgttgtccaggttggtcttgaactcctggctcaagtgattctcccacctcagactccagagtagctgggattacaggtgctagcacccacttcactgacaattctctgaattgaaatcatttgttcaacatatactgaatccctatggtctcctaggcactgagtgaatgagtgttcacgctgatgaagaactcacactctaatggaacgacagataaactcaaacaatttgcaaagtgacacaattagatttgccttttgggccaggcatggtggctcacgcctgtaatcccagcacattgggaggccgaggcaggcggatcacaaggtcaggagtttgagaccagcctggccaacgtagtgaaaccccgtctctactaaaaatacaattag

SEQ ID NO: 232889 - DNA, 537 bp, Homo sapiens
aaatcaatcatgtagtggcttatgatacaaagttcaaaggaaatacctgtgagagcatgctcatataaataaataattgaatgagtaaataaatggagaagaggcaaatctttcttagagaagaatttcaaatatgtatagctattaccaccccttttcctgtgtctgcttcattctctccctcctttgaagggaaaacagccaaaaccagatagaggaacattctacgggatagccagcccaaacttctcaaaactgtcacgaaaaacaaggaaaaactgagaaataatgcagttttaggatacctcgggttgcatcttggaccagaaagatgtcattgatggaaaaagtggtaaaatcaaaacaaagtctaaagtttatttcatagtaatagaccaatgttgatttctcagttttggcaagtggtcaatggtagtgtaagatataaacaggaaactggctgggtgggggtataatcctttgcaacttttttgtaaatctaaagttattctaaaataaaacatttattaaaaaata

SEQ ID NO: 232890 - DNA, 416 bp, Homo sapiens
aggctggggattaacatgggagcagacggcttggctcagaaccaagtgtgactaattgagaggacaaacaggaaggcttttcacctgcccagacctcattcagggtttcctacgagacgatagcatcaggagccctggcgagtacaggcagttttgttccttgctctgagtctcttgtgctgatgacgtcaaaggggcctaagacagtgcccccaaacctggacagagtgtggaggagaaagaaagctggtgagcaagcattttggccttgaagaccagatcgctcatcccaaagcttgggtccctggcctgggaactgggtttactgattccccttgtgattctagctcctttaaccttaagacggagcctttcttctggcaattacccaggaatgggactttcttccagcacag

SEQ ID NO: 232891 - DNA, 720 bp, Homo sapiens
  misc_feature (695)..(695): n is a, c, g, or t
  misc_feature (705)..(705): n is a, c, g, or t
atactaacatgttttgggaggaagttttctcccttctgaggcacatgcctgtctctcagtaaacactggcctaaagcaaggttgggaagtgactttctccccgacaatatgtcaggctggtgggaagtctcctctcaggaacgtctgtgagaagaagcaagtgattacaagctggtggatgcataaggagctcttgatcttgggagtgggaaggggccactcccatctgcacatggcctcttgctgtttccctggcttgtagcatggagatttatgggcatgtaacttttacagtcactttttttttttttgaaacagagtctcgctctgtcagccaagctggagtgcagtggcacaatctcagctcactgcaacctccgcctcccgggttcaagcgattcttctgcctcagcctcctgactagctgggattacaggtgcacgccaccacgccagtctaatttttgtatttttagtggagatggggtttcgccatgttggctaggctggtcttgaactcctgacctcaagtgatctgcccgccttggcctcccaaagtgctgggattacaggtgtgacccaccatgccctgccatgatgtcacttttctagcaagaggtctccttgtctgtattcaagtggggggaggtagaatggggagcaacaggtgtgaccagaaaacagcttcccacccancccacccatntgtttccccatccca

SEQ ID NO: 232892 - DNA, 476 bp, Homo sapiens
tctgaagttggtttccagaagagtgagtctgctgtcaggaaaggggtaaaaacaagcacagttgcagcagcgtgattcagtgcacagaagtgagttgattaggtatcccatcaccacccctaaacaacgttaaggctgtgtagtaataagctcatcagtctttccttccccaggatgaatgggactcttgggagtcctcaatctctctttaagaaatgaggcattgaaagacaggacccacacagggatactgcttctcctcaagaatgtagtgaaatcactgtggagtgtttagaggaaagccaatgcctctgggatttaagaagggtgatcatctggccaggcacggtggctcatgcctgtaatcccaacactttgggagggtgaggcaggtggatcacttgaggtcaacagttcaagaccatcctgggcaacatggagaaaccccatctctactaaaaatacaaaaactagcc

SEQ ID NO: 232893 - DNA, 505 bp, Homo sapiens
gccgtggtgaagaaggcggcgaagaggagctccacagccgactcctgcaagacagccccgggctgcactgagtctcgggcggtggagtcgcccggggcgctgacccgacggccccgtggagatgaaaagcacccaaatttactattgcgaaaagccagggggcagggaagtgctattaccgccgcgactgtgtgtacggttttgaagtcgattaaatctcaagtccaccatttgggaaagtcagctgtagcaacaggcaacattaggatctatccacccgccttgcgatggttcccagagagaatgcgggaacttactctaagcactcttcttggtgctttaagcatattcactcattcggttctcacctcccctctgtgaggcacaattgctgctcttgttttatggagttgaaaacggagactccagagtagtgctcaaggtccctacagctagcactcccggcaggagtccagtgctcttcaccacctggtggtgcggccgc

SEQ ID NO: 232894 - DNA, 393 bp, Homo sapiens
gtactcttcatataaggtagcacagcaaaacagagaaaataactggcttaagtcatataaacatatttgctacagactccatgtctgtagatggtcacaaggctcagtttgtaatcacagctgcctccgtattggctacacggggttctttatgaagttaacctttaagagtttcattcctacaggatctcagtcttcggctgtgtttttattaggttgctgcagttttcctttactgaaactagaaggctttctggtatattttctgattctcagcagtcctcctggcttctgttgtgaaactgccacccaatttgctttttttctttccacgcttcagtgacatgaagaacacaaaatggccacacagtagtgttagctttcaattaactg

SEQ ID NO: 232895 - DNA, 369 bp, Homo sapiens
tagttccatatcgttatggtagccattcctgtgctaataagatctgagctggatgagggacatgaagaaagcagtgagaatgatgaagaaaaagagaaagattagatatgggagaaacatatataaacaatagcagatggagaggaaggcagacagaagaaaatgggtgatgagtgaaacagttaaggtggcatatgttaaattattaccacttactcacttgtaatgagggcatctgctgttactgttctttgaaattgtcattagctagttaaaattctccaggtattttttaatgttcaaatgtttactgctctcaaaatgaaagagccaaggtagggttgaaaaatctattgagctctagcttca

SEQ ID NO: 232896 - DNA, 379 bp, Homo sapiens
taattcagtgttgtttcattataacattgatgagaaaagaaagttggttttcttttacatcatttcacttaaagttgcagtttccaagagcctattgaggacacgaaggctgtcaaccttgaggctacataccttgaggctgtcctaggctaaactctggtgatccatttctgataacctctttcaaaccttcatttgaaatgctttttatcaccccaagtggaatgtatatgaaaccaaaccccttgtttttattcccctttccgacataccttttaagagtactaaatacataatagcgttttaagagtactaatatttctgccaaccagaaaacctcaccaccatcttacctagttctagatcgcgagcggccgct

SEQ ID NO: 232897 - DNA, 400 bp, Homo sapiens
taattcagtgttgtttcattataacattgatgagaaaagaaagttggttttcttttacatcatttcacttaaagttgcagtttccaagagcctattgaggacacgaaggctgtcaaccttgaggctacataccttgaggctgtcctaggctaaactctggtgatccatttctgataacctctttcaaaccttcatttgaaatgctttttatcaccccaagtggaatgtatatgaaaccaaaccccttgtttttattcccctttccgacataccttttaagagtactaaatacataatagcgttttaagagtactaatatttctgccaaccagaaaacctcaccaccatctttcggaaacttcgccatcggaaacttcgccatcggaaacttcgccatcgg

SEQ ID NO: 232898 - DNA, 276 bp, Homo sapiens
gggaatggagccggagaatgctcccagaggccatttgagtaggcagatgtgttgggcctggtccttgcaggttgtttcgtgggtcccagcaggaacaggagcctcctgcttgggagggctgtgagccttatgtgggtgtctggccactccatgtgctgctgcccgtgctgttggaccaggaggccttatgtctcccatcaggtgtgacagcccagggatttccaaggcttagggaggacagcagtttcttctctctcttctggatcccttccctgc

SEQ ID NO: 232899 - DNA, 484 bp, Homo sapiens
ccagtaaaagaatgtggtgaaactctcatatacatactttaggtttttatttagtgttgtcttcagggtcttcaggtttaagaaatggatcataaatagtggtttatgatacactgaattgtgttcatataccatcctttttgtgaaaaaagtatttattaataattattcatttatctaccattcagaaagataattgcaatactgacagtcacatccatcaccctcttgccactctgtcacgagtatcctgtgccataagtatgtcattttttttactgtaactactctgtaccctgagataaggagtcttcattgccgggcgcggtggctcatgtctgtaatcccagctactagggaggctgaggcaggagaatcgcttgaacacgggaagcggaggttgcggtgagccgagattatgccattgcactccagcctgggctacaagagcaaaactccatctcaaaacaaaacaaaacaaaac

SEQ ID NO: 232900 - DNA, 514 bp, Homo sapiens
cgtcctccccctctgtcttcacagtatcctgtctctgcgtggctgtctgtgttttctcttctcttcttataagacatcagtcatattggagtagggcccaccctaaccacctcattttaatttaatcacctctttaaagagccactccaaatatagtcacattctgaggtactgggggttagtattttaacatacaaatttagggggtggacacaattcaacccataacattatatttgctttatctctttctttctataatatataggcatattgatttgataatccattagaagacatattatagacattatgacatctcactcctaaacatgtcactttgcatcatttaagaataaggatgatctcctacataaccttaatgccattatcacatcgaagaaaatttaaatttgtattaatccatattcagttgtccaaatgtttttttatggcagtttttattttcctgcataattacccaataaagttcatacattggcattgggtgtta

SEQ ID NO: 232901 - DNA, 358 bp, Homo sapiens
ctaaatctcttcaacagcatcctttaccgaagcaacattgtcccagaatctgctgaagcagcaagaaaagaggtcagcagtaggaccaagctgcatatcttcttaggcaggagtgcatcactattgaggccaaatggacactcactagcaaggtggctggaaacaactgttccagaaagaacccaaggaaaaatttccaggaggaacccaaacagaaaaatctatgactgggaagctaagggatttgccaaggcatggggaaaagaggatctttatgtttgaagaatgatagaaaaaataaagctgttcattattacattctaccatgtttagccaattaaacaggttttactggagg

SEQ ID NO: 232902 - DNA, 395 bp, Homo sapiens
atggggtgtgattcagagatgtgagtttgaagtgatggaaccacatgatgtctgtcagacttccgcaaggggaactgaaactcagatgagtggcaggactgagaggaattaatgcagagatggttgttggaatcgatgctattttctctgttttaatttgcttttattatcaaattacattgctctgtagctatgaatgtttgtgtccccccaaaattcctttgttgaaatgctaagccctaaggtgatggtattaggagatggggcctttaggaggtgattaggtcatgagagcagagcctgcatgaatgaatcagcgcctttacacaagagacccaagacagaccccttaccccttctaccatgtgatgacacagaaggtgccaattatgaac

SEQ ID NO: 232903 - DNA, 470 bp, Homo sapiens
caatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaa

SEQ ID NO: 232904 - DNA, 802 bp, Homo sapiens
aaactgacaacactgctgctgacattttttcaatggcaatcccaaattcaaactgaaaccccactgaagagctaagcttcattagatctctacaggctgacttacatcaagtggaatttactgttgattctgggtataatacagaaacagctgtttatcttcagcttgctttctgatgcacatctgtttgggttacttcaagaggcatcatggaggattcaagtttagggaggatacagatgctcaaatctgatgaacaattggcttattcttcctcaatgaatatattcagaaagcttgttagccattgaataaacacgttgcattaggggatgattgtttacaaataccttatcttgtggaataaactgaagttgtgctttccttcattaacgtgcacagaagcagttggcaaatagaaagtgctcaaaaaagtttgtagtctgtgcctgccactattatatttcatcatcatagatgccagaatcccctcttcacctattgcccggaatctgcctaatgagatatttgctccaccccctgctgtaactacatcatagcaagagagccatcactcaggttggtagaaatgaacttgaacattgactctcatccctttttaggagatatttgccactaggggtctcatcaggtacctctatgctcttcttaggggttcttttcttttatgattgacagaattaataggtgagcgttctccaaagttctcagcatcaaggatatagtctcttcgtcacagagtattgttatataataaaaaaaggtttataccatgttataa

SEQ ID NO: 232905 - DNA, 532 bp, Homo sapiens
cttctactccacactaaattggcatgtggtcatattgtctgagacacagattatgccagcgtaaggcttcctgactcttcttcaccccgcaacacaccaaggcaggaatgtttgtgggtggggagggggcatgagtagtgggtgctagggagctagataacaagtttggcttggtgattcaggagttcaatagagatttcttgaaaggatgttttcagtaaaattttggaaaatacataataatgggggaggggagagaatttatatcaatgaacagccctgcaagcagtgtatgaaagtgcttactctgcgatgggttaaaatagtgtgttattttaattggcaattcttaaggttactaataacattgaacattaaaatttattttggtttatttttcctcattgaaaactgtcaatttatattctttgtccacttatgtttgggggatcattttaaaaaattgatcttgctgaattctgtatattcagtctatgaaatcatttagttagtaaatttgttgctaatactc

SEQ ID NO: 232906 - DNA, 486 bp, Homo sapiens
acgtatctgctaactctagaaaggtttggcccttctccaatgtcatgtatagtgacaaccctatattctgccaaatctaaattttcagaagtggaaaaattgagttcatgtaattgataaattcttcaaaaattgctaacacattgaatgtattacctataaatggccttatcagtgtggatattatccttaatactatgaatttccagcagtcacactgatgtgcttataggtattaagtgccattcagtcagatgttataattagaatgggcctaaatgaagataacttatcaggtataccatattacctaaccatgttaaatagatgcatacacaatgtctattgtaaagagaatttggattttttgaatacataacatacattatgtgtaagtataacatacattaagataaagaacacagtgagccaagattgcgccactgcactccagcctgggtgacagagtgagactctatctcaaaa

SEQ ID NO: 232907 - DNA, 402 bp, Homo sapiens
ggaggataatgggcagttactgatataagaggctgagatttctaattttattcaaatcttagatcatatattgatgagttgtaatggggtaacatagttaacagtttagaaatctgttgactatgtgcttatcagagctggagccctaatatgtttagtcattgttttaaaaatgtttttgcattgattgctgtttttagtgaatgccaaatatattgtctttaattttattttcttaggaaaattaagcgttgtaaaaacaaaagtacatttaagtttactagttgttatcaaggctaaaggctttattttattgtctttggtaatagttgttgataccaaacaatgagtacttccactttgttgtttagtgatcatattaaagtattgatattttaaaaa

SEQ ID NO: 232908 - DNA, 150 bp, Homo sapiens
gcaccgttctacattagggacattagtctgttttacagacacctttcaactccctggttaacttttaggtaatatactctgcactttagcaggaatggaacctataactctcacagaattaggaaagtgaggctgcctacagcctaaatt

SEQ ID NO: 232909 - DNA, 490 bp, Homo sapiens
tatgtttttgtgtttatctctccccagtgtccagaagaatgactgtttatttctttttaaaaattttgtgtggtggcagaagggctaaccaagggtttcctgttcactcatgtgagtttctggtggagaaaataacttttttcatgctgagatatggcaaagatgaagcatggtcagcaggaaaagtagaaattgtcccaagatgagaacgagttataaacttgtcatgaaccgtaagtgaggttgggtctagaaaggccaaatctactgtcagaaaatctcagtggaaaagtcagaatttgagaaactctgatttgaagaaaggcaaagtataactgatgtaagtattaataaaccccacaaagctctggactgtgaaaaacaaaatttaaagatgaagacagagagagaaaaaaaatggaacagaataggtggttataaaacactcgttttactgcagtttcagaaactttcctgggccgagctccca

SEQ ID NO: 232910 - DNA, 2018 bp, Homo sapiens
gagtggctcctaaaagcagcagccctaatcttctgtttctcaaaaaacctctttgtagtcattcttaattatgaccttgtgatacataggtcctattaattgattcaaccaattgagacactgaggcctaaagaaattattggctataataatgaggtgattgccttagctatcacgccagatttgctcttttgttttctcctgatattttaaactcttccttgctggaatattaataactcaaagataaaaagggtacaacttgtttccatgtgggaggtaggaagaacattgcttttggagtcagttctaggcctggtgactctttgacttgccagttgtgtgccatgatcactccaagcatccattttctcatgtgtaaaaagcatgttaaaaattttaaatgaggagtttaaaaattacactcccagtaggcttactatgaggactaaaataaataaaagtgtgaaatgcagtgccaagcacataatagctgctcaataaatggaagctaaattattttccacagttatctttcaaatttcactttgatcagttttcacagactatcttctaagcaaattctgtaggtgtttgccttcggaaaagtgcgtttgttgtcagtgaatggttacagggaaaaggagatacttgtcatgcagctggaaacatgaaaacttggccctgtgttcttaaaaatgaaaactccctgcaggatgggtcaagttgctaccataggctggagcctatgattctcagagcagcatcactcttaatggcactgttctgcatgcccttaccttgctcattttgctgggctcagtactaattttcatcccctaggcaggcaaactaagtgtcattgtggcagttccttccatactaagaggaagcattgatcactaagagtcagcatggtttactatgagtaaattaaaccagacctatcttgacctctgacaaggttgtcgtgatgaccatgtcagtttggttccttgctgtatgcccagtgtctgacactgatcctagcatatagtagacactctatatattaaataaatgagccaacaatgtccttgtgagcataatgaaaaattactggccagtgagagtttcgttggatggctttgtaatgaaagacagcacaaagagattgctagcacctgagctcaattggctttgtcttcaggccagttatacgcaattattttcaaaatgatgaattgattgaggacactgataactctacctgaagatgaagaaagagccaacgtgttaaatgtcagaaacagaatccaaagaaatcctaagaaagagcacagaagaatggcaagaactagtcatgtatagttagaatgcttaagatttgaatcttggtttcagccagcacttggagtgtgaccatcagcaatttgcttaatcttccaggcttagtttcatcaactaagttaggaggggaatctctacctcacagggctcttgcatgaatgaaacgtttggcgtaatacggaagccctcagagcagtacgcttcaagcagtttatgaagtccttagcgtctttcttatggccgaaaatagtttggaatgggttgaaacaatgggccaacctaaccagatgaaactgtaaagaagataaatgtaaagagtgtttaagtaccataatttaattatacaaatataagacaggagctatgtaacagaggagagattttagctgacagtaagcatggaatgatttggaagaaaaagaaaagccttggccaggcactggggctcatgtctgtaatctcagcactttgggaagctgaggtggaaggatcacttgagtccatgagtttgagaccagcctgagcaacagagcgagaccccatctctacaaaaaataaaagaattagcctggtgtggtggtgtgcacctcttttcccagctgcttgggaggctgaggtgggaggatgtggaggctgcagtgagctgtgattgcaccactgtactccagcctaggtgacaaaggaagacc

SEQ ID NO: 232911 - DNA, 492 bp, Homo sapiens
ttaggtgtgctaatgatattggttatggggagaatacgtgagtcccattaaatgcccacatttaggtaacacctgtattgaggagttgtattagtttcctagggctacggtaataaattgccacaagcaggatagtttgcaacacagaaatttggtctgtcacaattcaagtccaaaatcaagggctcgtggggccatgctctgcctgaaggactagggaggagtcttccttgcctcttccagcctctggtagttactggcaatccttggcgttccttggttggtgacaacataaacttcaatctctgtctccacagtcaggtagcctttttccctgtgtgtctctccgtgtcttcaaatctctctctcccttataaggatggcagttattggatgtagggcccactctaatccagcatgacttcattttgagtacctctgcaaagaccctatttaccactaaggtcacattcaaggtaccaggggccagga

SEQ ID NO: 232912 - DNA, 443 bp, Homo sapiens
taacacttagaaattttttatttctggaattttccattgactattttcagacagtgatggaccatttctgcaggtaactaaaacctccaaaacaaaaaccaagtttaagggaggaatactgcacatgctaactgaaagcacatattttgctggaaaagtcactctattttttaaaatctcatgagatgaatcacatcatttctcacttttgcaaactgttttaatgtctggcttaaaaaacaggtagatcctcatggctgcatgtgcagtcactctgctgcagtatcacatgctacaacctcaagaaaatccacgttgcctcacgagagatagcgagtgaaaaaggcaaatgacacttagtagtattacaaaaataatacatctgactccaccagccctttggacagggccttgagcacccccagagcccctggccacacata

SEQ ID NO: 232913 - DNA, 564 bp, Homo sapiens
cagtgtccactagacttgacaaggtaataacatttgtaggtatatataccccatgcaaatgcactaaaagatgtttatacaaatgctaatagcagcattattcataataaccccaaactggaaacaagccaaatatttatcaatggtaggataagtaaatatgttctgacaaaatcacaataaaatactttaaatccctgaaaaataataaacaacttcagtgtacaactacatggatgaatctcccaagcctaatgtttgtcacaaaatgccagacgcaagagtatgatgtatataattctatttatgtaaggttcaaaatagataggagtaatctatgtcgatagatgttatagcagtggataccatttttaggatgggtttgacacgggatgagggtgccagaagggctcctgaagtgttggtaatgttttatttctataaatgggtgttgattacatgaatatattcagtttgtgaacattatttgaggtaaaatagaatttgtatgcctttccgcatgtatgttattctgcaataaaaatttatttaaaatgttttgta

SEQ ID NO: 232914 - DNA, 501 bp, Homo sapiens
acctctgtggagagtggagcgtagggagaggtgactggggcacccgtgccttgacaccccactttcttctcctgctcccctataatgtcctcgctatggaagcaccttcctgggacttcagaatggaaactgctgcagggcccttctcatgcatcccagtgggcagcacgagcatggaccgccagtgatgcactccaagccacttcacctcaagcatcctatgcatctgccagacacgagtggggcctcaacactgcttgacagtttgtgaagtgctctaacattctggacatgaagctttcatggactgcactagtgtgctgtcctgccctgtctgtacacacgttttttgctcctacagctgatgggacccacgcatagggcagatgtcagccctgttgtaggctatggagctgcagagtccaagagacatcacttccccagcagccagcatggtccccgcaggctctcagtaaacgtctttgctcattactgacgaat

SEQ ID NO: 232915 - DNA, 452 bp, Homo sapiens
gggaggctctcctaagttcttagttcctccctcttcactctacctgccctttttaagacacatagtaatatagtgggctctaagtagtagacactttgttcatttgctacttctgtacccctgggtcctcttttactcttctgtcatttgttaaaaatctcggccgggcgtggtggctcacacctgtaatcccagcacttcaggaggccaaggcgggcagatcacttgaggtcaggagttcgagagcaacctggccaacatggtgaaaccccgtctctactaaaaatacaaaaattagctgggcatggtggtgcatgcctgtaatcccacctactcaggaggctgaggcacaagaatcgcttgaacccgggagatggtggctgcagtgagctgagatcgtgccactgcactccagtctgggcgacattctggaactctgtctcaaaactaaa

SEQ ID NO: 232916 - DNA, 378 bp, Homo sapiens
aagattccaaaacgcacaggaaagttgaaaggcctcaggctgtgatgtctctgaataagacaaaagagaatatcaaagttgttgtgatcaagggaacagatttcacaaactgtcatcaagaggaggccatcatggtatttttctaatgaaaagtattgcactgaacccaggttagaaggttcatctgagtgactcagagcttggtttgacaaagactctgtccttcaaagaccgtcaaagagggtctgggcgagctgcttgatcgtcctaagcagttttcttgccactcctaagaaatgggtttatgggctccttgaaaatagacaagaaaatgtccttatccatacattaaaacacaaataactgcttagacgtctg

SEQ ID NO: 232917 - DNA, 535 bp, Homo sapiens
ataatggctgtactcatgtacatttcccttaattgtaagggttcccttttctctgcatcctcaacacttcttatgttttgtctttttgataatagttattctaactagtgaggtgatgtctcattgtggtttgcctccaattttaagtattaagcctttggtatatgcagacaaatattcaccatcttcacattgtagctttagtcattttgttgacactggtacaagtttacttggcttaagacatttcatagccagcaccaggcgtgctggctcacacctgtaaccccaacacttcgggaggcttagccgggcagatcacttgagctcaggagttcaagaccagcctgggcaacaaggtgaaaccctgtctctaccaaaaatataaaaacttagcatgcacatctgtggtcccagctacttaggacactgaggagggagaattgcttgagctcgggggatagaggttgcagtaagcagagattgtgccactgcactccagcctgggtgacagaaatgccatcttaaaaaaaaa

SEQ ID NO: 232918 - DNA, 138 bp, Homo sapiens
cacgtttctctgaacatttatgcaatctcagataagagtaggattttccccaaaattctctcttcactaaaaattgagggcaaacgtcgtaagttaatctttcactttatccactaagcaaaggttggaaatggatgt

SEQ ID NO: 232919 - DNA, 445 bp, Homo sapiens
cctcccttaaacctactcggtatggctctgtctgccagcttccttaccccactctgtgggacaggtcagagggagaagggtcagcacagtgtgtgagggaggattgtcagcaggaaggagcacaggaccctgacatttgatgagatacagcagtttgtgatcctagcagcaaggaacgtgatccacataagcatgcaactcttcccatcaccgggtccctgccctctgtgagtgcctatgtgtctgagcacagctttagaatctgcaagacactgaactgcagttcctccacccacagcagactcaggctctacaacaaccacggaagtggccacagccaaacctaccttgaaggactccatgagggttaatttgatggtatgagtgggagtccctggcatggtacttgttttccacagtaaagataaattaattataggtactt

SEQ ID NO: 232920 - DNA, 246 bp, Homo sapiens
taaagtggtgtctctgaagtttctccactggaaagttgctattttccctttgtaattaataaatgtcctgtgggggagatgctttatgagtatgtaaatatcctgtttctcatcatatttttgcctactcattttagcatcggttgatgattcctggctgcaacagttattaccatagtttttagcaaatggtgattttctttgtatatcactctttctgtatttattgattggaattctactgta

SEQ ID NO: 232921 - DNA, 456 bp, Homo sapiens
  misc_feature (149)..(149): n is a, c, g, or t
gtgaactccttgcagtattattgtacagtgttttgctccttggggaaaacatcatctaggtttgtcagtttgtgcacaattctttctttcttcctttctttttttgagacggagtctcgctctgtcgccaggctggagtgcagtggcgngacctcacctcaccgcaacctttgcctccccggttcaagcgattctcctgggaggcagaggttgcagtaaggtgagatcactcagactccatctcggaaaaaaaaaagaaaaagaaagtagctgggcatggtggcatgtgcctgtggtctcagctactcaggagactgaggtgggaggattacaggcatgcgccaccacacccagctaatttttgtattgttgtagagatggggtttcactatgttggccaggctggatttgccaattttttaatggactgtttctctagatattttattgcctctt

SEQ ID NO: 232922 - DNA, 355 bp, Homo sapiens
ggagaagtcagcaccagcttaccctgggaaagtcaaggtgggcatcacagagaagtgatgtttaatttaggacctaaaggatagatgagatttgtcagacacattgaagagctcctgcctataggaagcatttgcatgcatttctctttttgcatgtcctacctgcttggtaaattttatagcctcaaagctttttccaaggacaaatatagagtcatttaatttaacatcaatatttttggaggacacattactatttaatagatgagtcaaaagcataatggtagatgatggatgctaggcttggaaatgcatcatctaaaggccaaactttgcttaagaaaaaaaaaacaat

SEQ ID NO: 232923 - DNA, 633 bp, Homo sapiens
aaaaccagtcctggaatcagatgtggggacaccctctgcaaagtttcaggcctgtctgctccactctgaaccattcacggtggggcagtgtttggtgggagtggggacaggagaaccagccagcgccccctccccctgccctgaaaacacggactgccgtgctgctggagccagggcttgccgtcttgcactgagaggcttggccagctcaggagggcagctccccgtccccatgcagcagagccctgccctggtatttatcctggaatagggcttggtgagacactagtgcgctggctcattgtctggtcatttatcccgtttgtgattgctcatatcagtgacccaggaagcccttcactacgtttcatatgtgcacaccactggtgcttcactctggctcaaggcgtgcctcaagccagccttggttctaagagagcatcaggtaccagggggatcacagttcacttccatgagggcatgaggtgggcagtaaagacaggtgggtctgatccaaggacagtggagacggtgggtaggaaaatgagccctaatgcaagggtctggacatacttccaccacaagccacagcgggaactgcctgaagaacagggcttgccaggagcccccaca

SEQ ID NO: 232924 - DNA, 745 bp, Homo sapiens
ttatcctcatagaactttgagcacagagactggcccaggcgggtgtgggctgcacctgtgcctgaggatcacggtgactccacctggtccctgtcctggagcacgtggcggcgactgggtacacgtgtcgtgggcacagtgcagcaggctaagccttcatcggattaaagtcgccggtttgatttaaaggccttaaaaatggtttaaacacacagcagcagcagaacacacaggagaagattcctctgggcttggccagcctcttctgtgcctgtgtctcatggcctggctcctgttcactcaggttgagatgaaaccgtggctgctgccatactgggcgcagaggaggctcccatctcctggtggcgctgaagcccacagccatccaagggaccaacatcttgcagcatcgcgcagggaggtaggagagaggcagggaaagtgggcatggatggccctggcttgctgcacagcctgggaggaagcagggggacaggctgtggatgtggcccttgccggtcctgttcaagtcccagctctaccatctggatccaggggctgagtcctcagcgcacggggcgaacggccgcgtctttgcccaccgtgcctcactcactgtcatgcctgtggctgagacttgaaggttagggatcaacttttacctaaaattacttctgtagaaaataacatttcatgattgagaaagcagcgcgtatgcacacattgcagaatagacaaatacgca

SEQ ID NO: 232925 - DNA, 431 bp, Homo sapiens
cagaatctcattcagaagtgcataaatattagataaaaaccagttttctcagtgtttcctggtaatattattgaagtgagcatgaatttttgtgtctctagttatataatttgtctcctaagtgaaacccaactccgtgaagtctggaaggaaaccctggcaacaatggcggcttcatcgtgtctgaggaggagccgcagagagtgccttctgtttgaagggggcctctcggaagcggcaatggcatggcaagcctgctgctttttacctcagctgtatgctgcggagtggtataaatatgataaatgtaaatagctaaagaaattctctttttttacccgaatatatgagctggtgtctaatggactgatcttaagggtttgaaccacaaaccaagttgaattaataaaaatggaggctttgttcacata

SEQ ID NO: 232926 - DNA, 465 bp, Homo sapiens
actttcctctgagcctctgaaattctttttcttcttgtctctggagatggccgctagtactcttctgctgttaggaacgtcacagagaaaagcttagtttatacagtttgtgttgcccaggtaagtcatttcccttcccataatgatggggaagagattacatttagaaatagtgaccccaaaaggccatgatctgattattgagtcctgacttctgatctgaaactttgaccctgtccttggatagtggagcctgggatggctgtctgtccctcttttacctcttttagccagaattttccctctgcctcctccttggcagcagccacttgctcgggtgttctgaaatgtgtgtggattgtggcagtggcaggacacagagatgatgggctattggaccaaaaccagtcctcctgcttcccagtggggcaggtgggctggacttaatccatgaaagagtacata

SEQ ID NO: 232927 - DNA, 494 bp, Homo sapiens
tctgctccaatgaagctgatacctcttcctctgcccggccatcccacctgcttttgcctctatctcttacaaaataatatatttggtgcccagaaatttggatatctcatatgttcctctgctttacatctctgctctaatatcacctttttaaataggtcttccctaatctctcttaaaaaaaaaatgaaacaaaaacaaacaaacaaaacccatagtggccaggtgtggtggctcatgcctgtaatctcagcactttgggaggctgaggagggggctcactttaggttgggagttcaagaccagcctggccaacatggtaaaaccccatctttactaaaaattagtaaatttttaaaattttaaaattacaaaattagccacgtgtggtggcactcatctgtagtcccagctacttgttaggctgaggcaggagaatcacttgaacatttggggtggaggttgcagtgagccaagattgtgcagagagagat

SEQ ID NO: 232928 - DNA, 625 bp, Homo sapiens
agagacaagttctcactctgttgccctggctggagtgcagtgactattcacagatgctattacagtgcactataggcccggactcctgggttcggcagttctcccacctcagcctcccacacagttgggactccaggtgtgcaccgctgccccggccccctgtctgtctttttgtctaagctgcatgccctcccacttctgcttctttttgtgttctgcttccttcctctatttacttatggtttctgtccctttgttactaagggcttgtatgtgactttcacttgctgtagctcctgacccttctgcccattactgttagattcagtttcttggtattccaactctgtgtttctgggagaggcaatgtaacaggctcaacttgggtccagtgtctggctccatcagtcatgatagggaagggggagcaattcccaagaaggagctgggcaggtacttcaaaacatggctactgtactgtgtaggggcctatggattactggtacctattaactaggtaatccttatgttagctgattgaggcttaaccccatacaggtagctttgatcatcagggtaggtccctgggaagacctgccagcagcatgcatttctttgggctgct

SEQ ID NO: 232929 - DNA, 278 bp, Homo sapiens
aggttgtagtccccaggcatccccaaccactttgtgaaacgatttagcaccaacatgtatttcatgcctaacacttcaacattgctgagcgctaaacattctaagcagtggtcagagctttcgttaataaccttgttaagagaagagagttgtatttagagaattattcagtaaatgctgttactttcaaggaatatcataactattgagaaagaccttggagaacccaaataatatagatattgctctcaaatagtagacttctcttaaagttaaaa

SEQ ID NO: 232930 - DNA, 455 bp, Homo sapiens
ggctgtgcccacagggcgattgagacatatctctgcacttatcctgaggtgatccaactcttgcctggtctctgcctactggggacattgtgacatatctctgcactgatctcccaggtgctataaatttagtataggctcaggctacatggcattgtgatatatcactgcactgatcacccaggtgatataactcttgtctaggctctgcctacagggggcttgtgacatatctctgcactgatcacccaggtgatataactcttctctaggatctgcctacagagggcttcgtgacatacctttgtactgatcacccaggtgatgtaactcatctaagttctgcctacaggagctttatgacatatctctgcactgatcacttaggtgatcagtgcagagacttgacaaaattccctgtaggcagtgcttttaaaagggttacatcacctaag

SEQ ID NO: 232931 - DNA, 512 bp, Homo sapiens
gtttaacacatacatactgaggatatattttaatatgtttgatgtattttaatgtgtttgatataatgtgggaaggggttgcctctagaaacgtgggcatttagggcctataagaaggtcttaaaatggcactgaccactgaaaattccccaagtactgtgtagaccatatatagggttgtgaattcacccctttactctttaagaacccaatttgaatccctttatcctagtgggaatcccaggtgcccatgaccaccagaaagggccctgagggatgtgaacagtggaggatgggttctgagaattccacaacccagagggactatgcttcaaaacaactagaccgctgagttttactgctgtgagatctctctctagatgtggaaatgggccagatgcagtggctcacacctgtaatcccaatactttgggaggccgaggcaggaggagcacttgaggccagcagttgagaccagcctgtgcaacatagcaagactttgtcgctaccaa

SEQ ID NO: 232932 - DNA, 407 bp, Homo sapiens
attccaattgttttgaaggcagaagatgctcgtggaggggatatcatgttgatgttatctcagggcatgcggtttatacttcttggtttaaaaaaagaacaatttgaggagagaaaatcatggacaacttaccagtcagtaagttttttaaaagtcttttaaagctttgactatccagtattcaaatcttgtgtaatacctattacagatcagttttcactgcataatatgttatatactaaagaatgtaacatagagaagtgatcattaagcacattattaatagtataaaccccctcctcatagagtaaatttgagttaatagacatagagtactttgagcaggatttggcattcttacagtttatttatattaactatatatatttttaagacctagtctcact

SEQ ID NO: 232933 - DNA, 1350 bp, Homo sapiens
ccaatatgaggaggaagactccgtaaatccaacaaacaggagaattagcaccaaaagaacttaagatcttaacagaatggtttcaaagaaaatgtagtatatgaagtcaaaagctcaatggacttgctaaatagcaaattagttaaaattcaatgaataagttaaaaacagcttaagaaaagaattagcgtttgaggctgccatgagcctcaaacatccagccttttatctctctgtagcataaagagataaaaaaagtagaaaaaattataggaaggttaaatattggaggactgaatgagaaagtcccacatacatctcataaggaatctagaacaagagagaaaataagaaaactaatttcaaaatgaaaatagatgagaattttccagaaattcaatttcattcctcaaattaaagaagcacaacacatccccagcaagttaaataaaaataaatccacagacatctccagtgaaactcaataccaaattcaaagatacaatcttaaaagaaccaaagattacctagtatgaatgcagactggcatcatgttttttgcaacatcaggggccagatgacaatggaataaagtaatatctttgaagtaatgagaaaaaatatcaatctagaattctatacccaccttagctatttttaagagtaagggtaaaataaaatttcactcttgcagaaaggacacccaactctagagttagaaaacagtaaccaaaaataaggtgggactcaaagactaaaatatgttggtaaatctaaatcagcaatgactgcataaaacaacattaatagttaacttaggaagttgttaagataaatgtaaaatactaggcaataacaacatagtacatgagaagaattgatggccattaattcttttttttttttttttttttgagatggagtctcgctctatcgcccaggctggagtgcagaggcactatctcggctcactgcaagctccatctcccgggttcacgccattctcctggatgaccattaattctaatgtcttagtatcattgaggacatgagtaggagttctgattaatattacaaatctttataaaatcaaatatgcatgctaaaaatttgatgcatattcctagattctgaggaattctagcaaagtggcaggaatgacagaattataaagttgctattttgcaactgctaacaaagtaactgatttaggcaaagatcaatggatgaaaccttttagctaaaaagttgatgggaaacttcacagtgagtggggaacacatggtcagtgcctgaacccactaagtgtgcactgaatgtggtattaccagagaatacagcaccacctac

SEQ ID NO: 232934 - DNA, 526 bp, Homo sapiens
agtcacttcgtctctaagttttaattttctcaactgtagaaaataaatgttggactagttattcaaagcagaagttctcacattctgggatttagattttatgtctggaagaactaaaaatcactcgaaccagaagttgtgaaactaatgagtcattacctacacttaagaaaaggagaaaattacagcacatgtgactacataaaagataaaacctttagtgaatataatgagacgggacactccccaccctgcaaagcagaaagtcaaaatttttctcctttgaaaaccaaagaaggaaaaatactcccaagtaaaataaaacaaaagcaaaagcaagaatgcctaacagtttctctctgtttctaacatcaagcactgacacttctgagaaggcagtgtctgtatttgtaccttctccccaatttcatttccaaattaggtgacaaaaatgagattttgttgctggttaggtggctcatttgttttaaaataaatatacattattttcaagaagaaaatatgt

SEQ ID NO: 232935 - DNA, 358 bp, Homo sapiens
taccataagctttgctaattgagattcctaaaattgggacacattttaaaattctttaaatatttaatgaaggccaagaattttaggtctttgggaaatttttcaattaactactaataatttcccgccaaattaaatttgacataatttgaaaacaaaacgctcacctcttgctgggtttcctttaccaaatccactttctctgcagtcccagctactcaggaggctgagctgggagaatcgcttgaccccaggaggtggagattgcagtgagccaagattgcaccactgcactccaacctgggcaacagagagagaccctgtctcaaataagcaaacaaacaaacaaacaaacaaa

SEQ ID NO: 232936 - DNA, 396 bp, Homo sapiens
cctaaattagctaggctttgaattaccatggaaatactatgaaatatcggtgtgtcctatgtctgaatatattgaaaagagattgatctagtatgtattcatttaggttttgggggtcccatattcaacaaattgtgtggataaatgtcaacacaatcttttatccgcaagattagtcaaagtagattcttgccataggtgtgatgcacccaaagaacctgactgttgtaaaaccatgtaatatttcagggaatgcaaagcaaatgtactacaattagttaagctagaattgaaccaggagtaaagttaaaggggtctagatctaatttcatacttattgctgatgaaagaaggccctgttaagtaaaaccttttcctgagaatctagatataagg

SEQ ID NO: 232937 - DNA, 430 bp, Homo sapiens
cagtgacatgatcttggctcactgcaacctctgcctcctgtgttcaagtgattctcctgccctagcctcccgagtagctgtgattacaggcacccaacaccacgcctgcctaatctttcatatttttagtagagatggggtttcaccatgttggccaggatggtcttgaactcctgacctcaggtgatctgcccgccttggcctcccaaagtgctgggattacaggtgtgagccaccgtgcctggccaaaacgctctttatttggccttgagaatacccacgtcctgcttttcctcctacttcttcagctgctcctcagtctgtctgctggttccctttcatttatttatccagcaggttgagacagaaggttaagtaggattgggattgggcacaggccctcctctccttttacccttcacactctttg

SEQ ID NO: 232938 - DNA, 509 bp, Homo sapiens
tccgatctacactggcgtgtgccagatccctccaggatgtgaagggcagccaaggtgctggggagtcctgagctctccagagagtgatgactagctggctacctcatcccactcccctactgtgtccctgagactatttgccttgtctccccccaccattgtgtggctctcctcaaaggcagagcagtcatagaactgtcattccagtctccagagctggcttgttggggccaggtgcggtatggctcacgcctgtaatcccagcactttgggaggccaagtcgggtggatcacctgaggtcagaagtttgtgaccaacctggccaacgtggtgaaacctcttctctactaaaattaaaaaatgagccgggtgtggtggcgtgtgcctgtggtcccagctacttgggagactgagtcatgagaatcgcttgatcccaggaggcagaggttgcagtaatccaacatcatgccactacattttagcctgggcaacagagcgagactccatc

SEQ ID NO: 232939 - DNA, 432 bp, Homo sapiens
caggtctcaggaaaggaaattagagccttcacagattcccccgccaaatggaaagcgagaaacacaagctagtcttctgatattgaaagctgccttttctaaatactgagttcaatttatttttaagctttccagattgtcagatggccagtcaagccaacttgctcaattgtaaaattcagctcagaagacagacttcccaggaacccaaacctatccttcctatgcctttgccctataacctcctagggtaatggagagaagccaaaaaggcagtgtgggtttggggcaccttcagtaccacatcatcaaaatatcttttcatggatcattcaaaatttgtggcaaaggagggtggaagggaatataccactgatgattgcccatagaaccacagtaattatacaaagcagaggacatttaattttgcaa

SEQ ID NO: 232940 - DNA, 312 bp, Homo sapiens
cagctttggcaagaaccaaaggaacggaacctctgcttccaagtgtacggtcaggagcagcgtgttaattaagtgagtcatcttccgtggcagaatcccagggtacatgggaccagacttcgcgaggctggcattaggaaaaggaatgtgagggatcctcctccccaaaccgtattctcattttcttgtaagagctgtacgtgttcatgaggaagatactgcattcaaagaacgaaatcaccagcagctttggcaagaattcaaatttgggctgatgccttcggccggataaaattttcagaagcagtgata

SEQ ID NO: 232941 - DNA, 454 bp, Homo sapiens
ccaagaaactattaattcagagccaccctggtgagttgaatttcttgaatgtcttcatggtcttgaaccaaagtcatttccacccaagggagagtcaggtgaaagtccccagggccctctctaggggaccggagacctccagactaagctggtggaggatgggctcaacctccatgagagaagagcagccaggatcagggggcattaacgttaattttcccaggacttttctgcaaatgggtattggatggaaatatttgttctcagtcagatgagtttctcctattttagtgagaccaaagaaagacaattttaattctgtccaagctgacttttttgaatgctctggaaatgttggaattccacatcaaagtacgtaactgttttaaactgataactaacccaatatgtgaaaatatatgcaagcatgaataaagggttgactaattccaga

SEQ ID NO: 232942 - DNA, 554 bp, Homo sapiens
ccctttgccccagaagaagacctagttgtgggagatacaagacagagcagagaggctcaaaccccagcttgccagccggaggggagagaaagcgccccctggtgtctaagagtgttggggaaaccacaaagaggagggagctcaagaaaggggtcccctgaagctgcattatgagttcctacgctcatccctacacacatgcattgaaatgacccagaagggtacacaagggcctcaggatctgaaatgctgtgtggcctgagagccaggtccctggatggctattgaggggtggatctgagcagcactacagaggctttgaaaattaaactgacactggaatgaaagctcacaggaggagagtcaggacttctggcctgaaactctgttaattgcctactaaaaaaaatttttatcagtattctccagaagaggttaagaggacagagtcttacaatattcaggtgtgcagaatacaatccaaaatcattcagcataccaagcaacaggaaaatctcaacaaactaaaatagaaaaagacattttagcccaaa

SEQ ID NO: 232943 - DNA, 421 bp, Homo sapiens
cgaagtttggggttcagggtttatatgggtgcaggatagagggcatggtgggccaaatggcaactttttgggtacaaaaccagaaattcctgttctcatttagggccgcagatatacaggcttgagggtgaagcctttgccagagaaccaccctcttgtatctgtatttccctgtgtcctgtccacatcagtagcactcttagagatcattaagatgaattctccctgccaacactcatttaataaatgagaaaacaagtgtcccagagaacgtatgtggcccattattatacagttgaatagtaacaggcaaaaaactatttatatccatgggctttggcctagaaccctggctccactttggttctcttcattgcatatcattatggccttggaatatgattttcctgaccttataatg

SEQ ID NO: 232944 - DNA, 513 bp, Homo sapiens
aggaggcacagttgagtgaggccacacaggccacccgagagccccgtcttgcagtctttccattctagcgagcgcgagggtcagcgttgcctgcgagaagggcttggttcctcggggcgacggggtccgggatcggagtctatttcactcaggatggaatcaatccaggcaagttgggccgagttaggaaaaggtttagaattagggttagggtcacagtagggtcaggggtcggcagtaaggtcaagggcgcccagtgagggcggggaaagcctggccagtctgatccagccccctccctccgttctgcttcttccttatccgcgcccccacccatggcgccccagcatcctttcgcgtctgagtcccaggcccatgaactcccggggcggggccacgcccaagtgcccgcccatcgccgcctccagggtgacgccctgtatgcaaataagcccgtcccgcccaatcagctcccgggggcaggaccgcccgctcccaaggcacctgcggccg

SEQ ID NO: 232945 - DNA, 616 bp, Homo sapiens
aaaaaaagcccgagaaaaaagtaaaggaaaaagaaatacatggggattataaaaataaatgaaatgaaaaataatagcttactcttgtgagcgtattacaaatatgatcccatttactccttgctttatgaagtaggtaccattatttttcccttttacagaggatgaaagtgagatactagaagtttccaaacctagcgagtctcagtaagaagtttcacttcacaaacagataggagaaatgatagtggatcagaagcatgatttaaaagaaataataaaaggccgggcgtggtggctcatgcctgtaatcccagcactttgggaggccgagggaggcagatcacttgaggtcaggagttcaagaccagcctggccaacacggtgaaaccgtctctactaaaaatacaaaaattagctgggcatggtggtgcgcgcctgcaatcccagctagtccggaggctgaggcaggagaatcgcttgatcctgggaggcggaagttgcagtgagccgagatcgtgccactgtactccagcctgcgacagggcaagactccgtctcaaataaataaataaataaattcaaaaaaattactggccgtcgttttccgtcgtgg

SEQ ID NO: 232946 - DNA, 2031 bp, Homo sapiens
  misc_feature (621)..(621): n is a, c, g, or t
  misc_feature (645)..(645): n is a, c, g, or t
  misc_feature (1230)..(1230): n is a, c, g, or t
  misc_feature (1512)..(1512): n is a, c, g, or t
  misc_feature (1568)..(1568): n is a, c, g, or t
gacttttgcagggctgtgcctcctttcctccccagacaaaatccatcacgtcagcagtcacagggcaccctggttccctctctgaatgaactgttaaatgactaagctggctcccaacagaggcagagcccagcaatatgcggcctgtaatctgtcagatgatacagcaacaggcccagtgaggggcccgacacaccccccaggagagtggagtctctcactgcatgtgacgtggaagacgccgaagaggtgagggaggcaccatatgctgcgggcctgccaagggagaataaacagcaccggcagcctggcacagagctctggcgggaacgtccaccaagatcggtcaggcactctcatggcgtcctcctggatacaggcttttgcttttgtttttaattttggagcagtgaagccgaaagtgaggagtgaggacaaggagaagacccatttgctcctgttcattcaaacagcatctcttcattttgaaattggcaagaggcagttcggggctgtggcaggtcctgtacaccacctgttgcctcccaagtcactgtgcctttctggctttctttacctatgtcctgtaaaacgccagatgaggacatagaaagatgaacntaaagctgaaaagtgaacttaaanctggaaaaaatgaagcaatctcagctatgatagctgtaatagaaaaatggagttttcctcagtttttcttcctcagaataaatgggatgatcctgatggctgtttaagtggagaggatttgtttgcaagaactctacatcttcaacattttgtagagcattccctgcgatgtggaaaattctgctgggctattccctgaggacacctctacctttcgtgtccagaattggtgggttcttggtctcactgacttcaagaatgaagccgcggaccctcgcagtgagtgttacagttcttaaaggcggtgtgtccggagtttgctccttctgatgttcagatgtgttcggagtttcttccttctggtgggttcgtggtctcgctggctcaggagtgaagctgcagaccttcgcagtgagtgttacagctcttaaggtggtgcgtctggagttgttccttcctctcggtgggttcgtggtctcgctggcttcaggagtgaagctgcagacctttgcggtgagtgttacagctcataaaggcagtgtggacccaaagagtgagcagcagcaagatttattgcaaagagcnaaagaacaaagcttccacagtgtggaaggtgacccgagcgggttgccactgccggcttgcagcctgcttttattcccttatctggccccacccacatcctgctgattggtccattttacagagagccaattggtctgttttacagagagctgattggtccgttttgacagagtgctgactacctcttgagagttttccaggcttcctaaggctttggagctttcctgagtcagggcctttgcacatgctatgtcttttgccagagaggctgattgctcagcnttatgcatgcctggttccttcccatcatgtaggtcttctggtcaagtaccccctcntcagagaacgtttctcccccacccttcccctccagtgcgcactgccaaaccctgctcgaaaccaccctgttctctgtcctatggtcactcagttgacatcacaatccgaaatattattcatttccctttctgggaataaacatcacaggaataatcagagttgtagaatgagatttgtatacaaggctgcctatgtctgtgtttttataatggcgaaatattagaatcagcttaaacattgacaaatatgtgtaaggctcagtaaattacagcatatcttgagggaagagcattagtgcaaagacattaaaattttgttgttcacgaatgattgtggggcacagtggctcatgcctataatcccagtactttgggaggccaaggtgggtggatcacttgaagccaggagttcaagaccagcctggccaacatggcgaaattccatctctagtaaaaatacaaa

SEQ ID NO: 232947 - DNA, 504 bp, Homo sapiens
ataaacagatctgtgtatctctatccctagaaatatgtatgtatcttattcaggcagaaaaacatggggtggctcaggagataaattattaatctattcaatacaaaagttgatttctacttgttagaagaaaaattaaaaaccagaagacaatgaaaataaaaccaagaagcttacttgcaattcagactaatttcaaattttatttaaactcagtttcttaactttaagttccacaagggcaagaactacgtttgcatggtgataacctaacaaattcaaaccttgctgatttatattggcaacccaaatgatacagaattttagagcatctcagaagtcatcttattcaaaaatcctctaatttaaagataagattaagaaaccactctggaaaaagggaagacacaaatgtcaccctgaagcagctcaggctccttatccccaaatttagggataatgttcagtaaatggcaacatttactgaatgtggctatgtgttga

SEQ ID NO: 232948 - DNA, 314 bp, Homo sapiens
agattaattcaatggctaccaaaattcacacatattgatgaagctgtaatcagggttacctgtgaagaaattatctctcaatccacaaacccaagaaatccaaaggaccaaaagcagggaggtagaagtaaagaggactgacccactcccagtccattctttcatacctctctacaaccctggccacaagtcatcaaaaaccatttcctgccgggtgcggtggctcacgcttgtaatcccagcactttgggaggccaaggtgggcagatcacgaggtcaggagatcgagaccatggtgaaaccccatctctact

SEQ ID NO: 232949 - DNA, 603 bp, Homo sapiens
ccaggtagctgggactacaggtgagcacctggctaattcttttgtagagatgggagtttgtcatgttgccttggctggtcttgaattcctggactcaagcgatccgctggccttggcctcccaaagtgctgggactacaggtgtgagccactgcacctggcctattactatttctacttaaacctaaacatgctgaagaatgacaatttggtcaccaggtgagtaggatagaactaccttcacctctgatgtaaatatatggaatctggatatgatgggcattataccctcgaattgctcaggcctaagtaacaccgtgtatgttgacagagtggttttttttttttttttttacttttaccaacagtatctttatttatttatttatttatttttttgatggagtctcactctgtcgcccaggctggtgtgtagtggtgcaatctctgctcactgcaacctctgcttcctgggttcaaacgattctcttgtctcagcctcccaagcagctgggactacgggcacacgccaccacacccggctaatttttgtatttttagtatttttagtagagacagggtttcatcatgttggccaggctgg

SEQ ID NO: 232950 - DNA, 348 bp, Homo sapiens
atttaagtttctgtgtgaataaatttcctcttccaaggaaattttattgtgtggtgacaggaaatttatattttattttatgctagggatggtggtcacattggttgcattgagactacaaaggggagagagtctgagggctctctctgaatgacatagatttcctacagtttatgggtctcttccatgtcatatatatttatacagggctaaggccgagagtttggtagatttaggttgccttgctatctcaggtccaggtagaataactttgattcccctaaagcagccatctccctaatattttttttcttcccaactcacagcagtgtctagacagatgttttg

SEQ ID NO: 232951 - DNA, 445 bp, Homo sapiens
gcatgttttgggcaggaaggatctgtcagcctccagctggtggaagaggaccagggcgggagctgagcagtgccttgactccgaaggacttggaagaggagggagagggagtggaggccggagtggagaggatagactggccctgaggcctctgcgttcccagcccggggcctggacttcctgtgtttggctgctgtttggagcttggtgatgattaatgaggaaatacgcactctgaagagcttatacctccctggactgtgaggccacatctgcatttataacacagtctgtgatgtgacagagccatttcttgaggaactttggttctggtgaggcagcatcaggactctctagaggccagacaagagtgtgtttctacatttgtatggagagaggacaagagccacgaagaggcctttaggaaatgaagcacccttgctga

SEQ ID NO: 232952 - DNA, 361 bp, Homo sapiens
gccatttattcttttgctcattcaataatcattaattgagtatccactctgttaacaggtcctgcctccaaggaactcatatgagatgggaaaatcagggattacaaatgtgtctaagacctcagacacagatggctgtagggaagggtggtcaaacagacaaaatggggattaattgtgcccagcactacttccaaaatggaccgaagactgaaaaaggattgtgaaggatggcaggaagtgaagttggagtgaggtgcagaggctaggtcatggatagcagggaatattaggactttgctggggtaatgaggaagtcatgagaaggttatgggacatgacaaaaatttgtgttttattt

SEQ ID NO: 232953 - DNA, 333 bp, Homo sapiens
aataaggatgtttcagtcatgtgctagaaactttgttgtcacatatgtataaatcaggggtgtccctggacttcggcctccctggacttttggcttccccagattaaaagaattgtcttgggccacacacaaaatacacgaacaataatgatagctgatgagctaaaaaaaaaaaaaagaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatg

SEQ ID NO: 232954 - DNA, 451 bp, Homo sapiens
taaatatctctggaaaatctacatgtcatgtttaagttcctttcccaatctttgcagataatcagagagtcactagctgtcaactagaaagcttggtgtctctcttcctgtctttcccactttcacctgggtacggaataggagagaagaaatgtaagtttttgtttggtacaatcaatgaatttcctaaatccctccagacttcattgcagccctgtctctccctccctaggtactggacagtccactgtagcccctcattcatatactcagagtcactcttctggctgtggcgaggacatcctgtgacatgatgcctagagagtctggaagaatgttctccagaacttttccagccctatccaacagaattcttgggtgggaacttggaggcattggatattatctttaaatgaagagatcaaattaataaattatttttaaaattagt

SEQ ID NO: 232955 - DNA, 413 bp, Homo sapiens
ttccattctgacttgagtcagaatttaccatagttacttggttttattttatatgcacccttgtaggctgacttaaatacctccttttaaaaaataagacaaaaatgtaacatacattaattcatttattgctcacacctttttttttaaccatttgcctttatttttatccccattttgtaggtgagaaactgaggaacagaaaggttttaaaacttgcgtaaggcagcctagctccagagttcatgcttttaaccacgatgctagcttaatagagtcactaagctactcatttgtcccttcatttcctttgatgtttcctgtatgagacatctctgctagtatgtatttaagtaaaggagcattctccactctttaaacatatttttgtgataacccttccaaagcaaatg

SEQ ID NO: 232956 - DNA, 272 bp, Homo sapiens
tgaaggaattgagggaaggagagctttgtgttgaaattgagccttgggctcaacaggcggtgtgggaggaagagccgggtgtgggtcccagctcgacccttcccctgtgcgctccacatctccgagccttggtttcggaggctcccgaagcccaattcgcaggagagttggaaacaagtgggcgcgtgctgttaagggaggtcttggcatgacagaatttgcttggaatgattagcgttgcccaagggctgtcgctgtcagaaaaacaaaac

SEQ ID NO: 232957 - DNA, 681 bp, Homo sapiens
accaatcttgaaggcagaaagatagcaaaaagcctgacaaaatattttaaaaattcttatttttaaagcagtatacatatttttaagacagtttttcaaacacatttttaagtaaaactaagataaatttatgagtcattaaaatttatcttaaatattatgtttttaaacgttaattttgagttacattaaaatgttaacaaacgctgtattacttaacgtgatgaaataggaatgctaacaagaagccttgttaatgaatagagtttctatttttctaatgacagtacacattcgccaagctgttaactcattctaataattgcagatcctttgtctgttcatatgattgtagagaaaatatctgagaaagatattaatgaagttacataatttaggccaggtgcggtggctcacacctgtaatcccagcactatgggagaccaaggcaggtggatcacttgagcccaggagttcaagaccagcctggccaacacggcaaaagcccgtctctactaaaaataacaaaaattagccaagcgtggtgttgcatgcctgtactcctagctactcaggaggttgagataagagaatcacttgaacctgggaggcagaggctgcagtgagccgagatcatgccactgcactccagcctgggtgacagagcaagattctatctca

SEQ ID NO: 232958 - DNA, 411 bp, Homo sapiens
agtatgtccagtggaaggagggagcagcttatctgccttcagctccagccccttctgtggctccctagtacctccgcccagctgtgcactggcccgtcaacctcactgcatgccagcctgagagctgattcactccaggccaataggtagcaatgactgcagtttctatgtcaccaagcagaaagcaaaggtatcaggttctagtggattctttttgttcacctctgaacttaagccaggtgtatgtgttgacagcatcaggaagtaggcagtgcaggtacgggacggtgctgtgtgcaccaatcaagatctctagctccatggccctgatttttcctgttacgatcatggcataagagtggccactccattctacttctttttttttatttttttttaatgcatacttga

SEQ ID NO: 232959 - DNA, 436 bp, Homo sapiens
ctccaaccagagagtttccacaatgaacgtcaaatcctaaaaatgccgttttttatgaggtccctggaatattttctagggcaacatttctggggcaacatatacatacggttatctatccagttacctatattaagagaaagagatctggccaggcgcagtggcttacgcctataatccaagcactttaggaggccgaggtgagtggatcacctgaggtcaggtgttcaagactagcctggccaacatggtgaaacctcatctatactaaaaatacaaaaaattagctgtacgtggtggctcacgcctgcagtcccaactactcgggaggctgaggcaggagaattgcttgaacccaggaggcagaagttgcagtgagctgggatcgcaccactgtactccagcctgggcgaaagtgcgagacgactctgtctca

SEQ ID NO: 232960 - DNA, 414 bp, Homo sapiens
ccatattttggggtatcattttctgagccctaatactgtgacaggagaaaagtatttatccagcaagtaccatctgtcaaccttgttctctgcctgccagaagttgatttgctcagcataagggaaggagagaggcaggaccctagagatgtgggagggggcttctggattctgtaggggactttaggaactagggggcaggacagaaacgtctaattaggatgttttattaagtaattttgtgtgactccaaggaaaagctctcttctaactcctttcaaaattctcagaaaaattacctgttcactgatacttgaaatgtggatttggttttggggatttaagtctggtctcaagatggcaaccaggtcagcttactggggccagccacatgtaacagtttggttaaaaaaa

SEQ ID NO: 232961 - DNA, 422 bp, Homo sapiens
aatgccatgtctatatgcagaaatgccagcgtgaatgtcctccacaatgttagcaatggtcaggttggggatgggctgttgcgggtgatttctttacatggtatttgcttatagtgcttggattttttttctttctttttttttttttttgccaatgtatttaaattttcacaaaaacaaaagcctttttaaaagcaaaaagataggtcaggagttcgagaccagcctggccaacatggtgaaacccccatctctactaaaaatacaaaaattagccgggcatggtgacgcgcacccgtaatcccagctacttaggaagctgaggcaggagaatggcttgaacctggcaggcggaggttgcagtgagccgagctcacaccagtacactccagcctgggtgacagagtgagactccgtctaaa

SEQ ID NO: 232962 - DNA, 407 bp, Homo sapiens
tctgatgtggccccatgtgcaagtcccagcaagaccaccatctgcgggatggctcctccatggcccctccattcctgcccacctcctgcaggacgtggcttcctccctgccttgagcatccattccttccacctgggacttgtcattctagccactgcagccccgccatggtgcagtgccaaactctgctgtctccaagcagccccctcgtggaccttgagcctcactcagatcacctcctttctcctgcactcacctcccccgtgctcggcctcctcgctgacccagctgaaagtccatgggcacggtcaccccctcactatgccctcaagtcttcctgtcccctctggctccaccgtactcacagctcaaccctgcccttacctgcatcccactctccacctact

SEQ ID NO: 232963 - DNA, 514 bp, Homo sapiens
agtagctttccatctctgaaaaatgatgactgactcctagtattcctgcccacaccatgcatggaggaacattcatctctatttgttattgaggtgacttccatggctattgaatggaatgagtcgagcaggtgttctttcaggggtgctagggaggcgaggggtccagaagtctgcagctccggtggaagaggttaggcactagggaaggcagactggagctcagtgtctgtgacctgccggggcgcccactgcccgctcacttgagctgtgacctttccccaacctgattgatttatctactttcatgcctggtcccctgaaaccatttggggacgtggcctctgctagaaagtgtgaactgataactgcttatggtgttattcctcccagagtgatctgcacttatttacagtggttgaaggcagaaaatctctgaagactaaaggcatgaccctctaatgatcaatgattagtgtaacgatcaacgattagagctttgcaaacagtgagg

SEQ ID NO: 232964 - DNA, 519 bp, Homo sapiens
atctctaggggagaattcatttctttatggtcttctttcaggctgtcacctgagggctgttccaagtttctaaaagacatgcaaattcccagccttgtggcccccttcttccacctgcaaagccggcaatagcgggttgagtcctcctcacatcacatctctctgacccatcttctaccttcctcttccctgttaagaactcttgttattagattaggcccacttggataatccaggataatctctgcatctcgaggtccttaactttaatcacatctgcaaagttaacttctgacatacaaggtaatatattcataggttcctgggatgaaggcaagcacatatttaaggggccatagttctgcctaccacacaactcaaaaaattgtgcaaatgcttttcctctacatgagcattctatttggtatgccattcccattttctcatgtattatatttttaaaaatgtgttctcaaaggttaaattttaagaaactgaataaattctactgattcaata

SEQ ID NO: 232965 - DNA, 407 bp, Homo sapiens
catgattgtaagtttcctgaggcctcccgagtcattcagaactgagtcaattaaacctcttttctttataaattgcccagtctttggtatgtctttatagcagtgtgagaatggactaatacaacagttttgtcagtccccagttccgtccacacctttccctattcccttcatgcctggctatggaaggtcacacacacaatcctaactgccatctctatgcccagccaggctttcgctgctgctcatcagcccttgtgtagtgaagagaacccagcggcctcaaactaccagtgccctcaaaactacaaacttcccattccctttgcctcggtggactcactccctctctgctttacagaggagacagcagttatccaggggcacatccccaaattcttccttct

SEQ ID NO: 232966 - DNA, 429 bp, Homo sapiens
ctcggatgccacatcttccctcccactcccagaccaaatcctggggtttgaaaagggggttggtaccaaacctttgccatgtttgagagaaagacaggaagagagcctcacttttctcactggctttcccatgcatcctagaactcgaactctgatgaaagcatttctttagttccaagagctctctggatgaatagggtaatgggtttctttttattttctgcatcttttttttaactatttaatgtttacttcatattgatttataaacaacaacctctttgtgaatttccttcataatatagaaaatgtattttgaccaaatgtataatgcatttttattgtcttaattaactggaattccaacattcccttcccccatttctttgcttttaatgaaaagtagcaaatgaataaaaaccatacaaa

SEQ ID NO: 232967 - DNA, 800 bp, Homo sapiens
cagctattcgggaggctgaagcaggagaattgcttgaacctgggaggcggaagttgcagtgagccaagatcgcaccactgcactccagcctgggtgacagagtgatactctgtctcaaaaagaaaaaaaaaattcattatcaatctctaaaaatagaactcttttaaaatgtaactacaataccattatcacacctcaaaatatttttctatacaacatttacttggccaggcatggtggcttatggctgtaatactagcactttgagaggccaaagcaggagaatcaattgagcctaggaattcaagaccagcctgggcaacatagcaagatcccgtctctacaaaaaaatacaaaaattagccaggtgtggtagcacatgcttgtagtcccagctacctgggaggctgaggtaggaggattgcttgaccccaggaattccaggctgcagtgagctatgatcataccagtgcatgccagcctaggcagcagagcaagacctggtctcaaaaatgaataaagtataaataaaatatgtactcattacaacaaatcagaaagtacatggttgggtacagtggctcacacctcccagtgggaggccgaggtgggagggttgctaagactaggagtttgagacaaacccggcaacacaggagaccttaactctacaaaaaataagaaaaattagctgggcatggtggtgcacgtctgtggtcccagctactgagcagtgagctgtgattgtgccactgcactccagcctaagcaacagagcaagaccctgtctcaaaagaaaa

SEQ ID NO: 232968 - DNA, 545 bp, Homo sapiens
tattaacactttttaaatgtattcagtcagtgaaaccaatgattattatagcaccaacactttcattcaagaaagcatttgagtcttataatttgttttgccatggtacaatggttctactaaaatatacttgtgtaataggtactagatgatttaaaaacaaaaccggagaaaccatttaaaaagttccatagcttgttatacaaaatatgcattgctaatagtagaagccatatattgccattgtactgttgtaatacttaacagtgctcatctggtgctacctgtagactatttggtattaacgtctgctagacccttcttcctatttcttcttgaatgtataatgtgtgccttttaagttacttctagtgttgaatggtaaaatctttgtggtatttttgtattatactctgcactttacactttcttggaaaggaaaattccagactatccagtttaaatagtcttttaaaaatatttataatgtttacaataaatattttacatattttaattcaacatctgcaaattagaaaaaatat

SEQ ID NO: 232969 - DNA, 356 bp, Homo sapiens
aaagaaacaggaaagtatgacttataagcagaaaaaaaaatcaggcaacagaaactgcttataagaataacaaggtgttagattaacaaagatttcagatcagccattataaatatattcaaagaactaaaggaaactatgattaaagaatacatttgatgaatgacaacaacaatacaaagaacaggagggaggaataggaaccttttgatattataaggtacttgtactgtaccttatacactgtaaagtgatatcatgttctgtgaagatgggcatggattcgttatcaatgtgtattgcaaactccagggcaaccactataaaaagtaaaaatagaagtgtaattaatatgc

SEQ ID NO: 232970 - DNA, 449 bp, Homo sapiens
ttccatatctgtaaccattagatactgctagtttccttattcacaattacataagccaagtgaagtattaagctcaatttggtggttccaaagagagtaagagtctttgctgtggtttcctaccatgtctatcgccagagattggtggctttgcttatgcttgtgtcacttcctgatatgtgtggcacctttcttgaaaggaatgttagttttattccctgacttccgaaataaccgtcagcaacagagccaactgggcccttgtgtgtgctgaatgcttttctccagggagtcagtaagtagtgagcagtggcatggtttccttctccatttatggccttggaagggtgaaagggacatggttgggactctccatttacggtccttggaggagttgaaaagagtggttggggtgttcttggaggcagaaactagacattgtgagataa

SEQ ID NO: 232971 - DNA, 457 bp, Homo sapiens
tgactggcacttagagtccagcaccctgctgagaaaccagcaacccatgtgaggattccatggccagtaagcatgctctgcttcttgactttatgtagaggctgttggttaactttccagtgcaaattttgttcatttggatttccctattttgtctgtttttccttttcattcatgcacattttacagtccaccactctgtttcaccatgtaacgtgcctgctcccccttccctttctgccatgattgtaagcttccagagtcctccccagaaggcaagcagatgccagcaccatgcttcctctaaagcctgcagaatcatgagccaattaagcctccttttttaataaattacccagtctcagatgtttatagcagtgcaagaatggcctaatacagcttccatcctgtcacttttgataaatgtggaacaataaacaactcttctcctgcagcc

SEQ ID NO: 232972 - DNA, 529 bp, Homo sapiens
tgtgttgactttgtttattgtctgtctccaccagaatccaagctccaggaaggcaggtatttttgtccccggggcctagaattgtttcattggatgcatactgccctcggaaatggcatgaccttgggtgacatggttgtctccagctgggacagtccctaaggagggctgacagctgatggcagtcgtccaggggaactccttgcagccgatcgccagcacatggcagtccccagagccatatgtatgtgctgcacagttttaacctacacctaagggtggtctggtgccctgtttgagagtacacacacttgaggtggttagctagcatttcatcaaaaagacagagacagctagtacaagcacgtcgacaatcttaaatcaacagaagtgtcttcactaatggacataatagatattagaaatagtttttcactggtgaaattagtggtgtccaagccacctggattggagataatttttttgaaggcatttcctctcttgctggaacaggctataataatctaga

SEQ ID NO: 232973 - DNA, 237 bp, Homo sapiens
tgtttgtttggttagttttctaaaacaattgctcatttttattttattttgagccagcgttctctctctgagtggacctagacgtgcattccggggctgtttctatttgcagtctgaagtcaggcctggggcttgtggctgtttttgccatctggtctggggcgaaagggcaaatctgcaaagtctctctgttgtggccagcgagggagtcccatccccatgaagtctgtcttttgc

SEQ ID NO: 232974 - DNA, 603 bp, Homo sapiens
gaaagaacaataaagagtgtgcatcctctcctttcaaggagtgcccccaaagtcccatgctgcaagatgtgcaaagaaacataatgttttgggctaagcacattacctagagttcgcttgctaaggaagaaggaaacacatccagctctatgtcactttgataaagagataagcctaaatttacaaggaatggttgaaaataaagaaatgcacacccagcactttgagaggccgaggcgggtggatcacctgaggtcaggagttcaagaccagccttgctaacgtggcaaagccccatctctactaaaaatacaaaaaattgccaggcgcggtggctcatgcctgtaatcctagcactttgggaggccgaggcgagtggatcacctgaggccaagagttcgggaccagcctggtcaacagggtgaaaccccgtctctactaaaaatacagaaattagctgggcatggtggcatgcgcctgtaatctcagctacgtgggaggctgaagcaagagaatcgcttgaacctgggggagtggaggttgcagtgagccgagatcatgccatttcactccagcctgggcaaaaaagcaaaactccatctc

SEQ ID NO: 232975 - DNA, 206 bp, Homo sapiens
ggtccatgctccactcccacctcagtgcttgcccagcaaggaagggcccagagaacctgtctggacttcttccttctgagggttccaagggactggggccaggcccaccctggcacacggcagcactccatgagtcgctagggtttttgttcttttcaattgtggaataaatacaatttaccgaaaagtacataaaacataaatgt

SEQ ID NO: 232976 - DNA, 388 bp, Homo sapiens
atcttgctttgtgtcaaaatcaagctgtaaaattaatatttatgcccttacaagtccataaattagatttaaattaaataagtgaaacaaaagctatatggttgcctaaatcaaccaactgtaaagtcatgagtcataataattcccaaattccttttttttaaatatacttggcaacagattttattaagggacagtaaccattgtattcctagagccgtcatctttcttttttttattattattatacttgaagttctagggtgtacacatgtgtacaatgtgcaggtttgttacatatgtatacatgtgccatgttggtgtgctgcacccattaactcatttacattaggtatatctcctcatactacccctgccccctccccca

SEQ ID NO: 232977 - DNA, 513 bp, Homo sapiens
aatgagaaaatattttatgaatgcaaaattgggacatagagtctgaccaaggtttcctatgggagtttcagacatggtaattagaaaccaggaagactgagaaggaatcaaatttgcagcagctcagtaagtggtagactgggaacaagaagccagttctctgggctcttgaagcaaggccctgccacgttgtctttccccaggagaggaggtcataagacattcattccagagagagtcctgccccacctctgagaaggaaggaatgtacactcaagagagatcaagaagaatctaaacaaacaggcccttctgcgttttcccacaagagaaaatgatctaattaacattcgatcataactttttgtccaattatatttctacactgctgttcatactttatttaacctaggcataaaaattgacaatttttattgtatttttggctcttcattctgaaggcttccatgtatacatgttaaataaatttgtacaccttttctccaattaatc

SEQ ID NO: 232978 - DNA, 673 bp, Homo sapiens
gttaaaaggacaggggctagcttgaagggattcccactggccaaaaatggggcagagcatcaaagtaatgaaaataatataatcaattgaataaggatccatgagtccaaactcatataaatatataaatggatgagaagggaaagtttcccttacagtagaatgccaactaaaatataagaggagtgctagaattagaaaatcactttttgttaactgttgtagtagtaattgatttagtcagtaatcattaatagatcctcatactagtgggtgaaaagtttgaggaaataattggatagttaaatggtctcaaagtgtgtccccataataattagagaggaaaaacgaatacggtgtagaaacttggcaggtagcttcttacctaggtaataaaagttaacattaataatgggacaaattgccatgtgcctcttgatgtgatacactgaagacacaacatcacttgtagggtattcctgccaaaaagtcacgacctgaatcgagttgtgaagaaacaccagacaaacccacatgggggagcattttgcaaaataactggcctgtactctttaaaatgttaaggtaatgaaagaaaaaagagacaagctgtttcaaataaagattaaagataagaaaaatattgtttagagttggaaaaaaaagactaaaa

SEQ ID NO: 232979 - DNA, 378 bp, Homo sapiens
gtccagatcagcttcttccacatgggagggaaaatggctgctgacggctcccaagcctcaatcccttcacccttgccactggcaaactgcggtttaggttgctgccttggcagtcctggctgtcctcacggaagagcatgtgaaccacggacctggctgtctttttcattgggttggctctgcggtgcaggctggcagatgagcatgtgatgagcccgcccttgctggccgtgcaattcggctcctgtcatgctcttggccattgaatcggcctaatgcagcccctcagcagccagcctggtgttccctggggctgaggatctaatgtcagcagggcatgattcgattcacattaaagatggatattaagtcttttta

SEQ ID NO: 232980 - DNA, 564 bp, Homo sapiens
cagtcagaggtcaaaggtacacgcaggccacgtctcagaagatgaaatcatggacggaagccacacgtggtccccaccaagctttcacctggcatccagcccttccatacctccgtgcagtgagggcatctccagcgctgatggaggctggccagctgtgtacctggatttgttgggttccgagattagctgtgcatggttgttacattttgtcagtatcttaggaaaggacgctgaagtatgttagcatgggaaggaaggacagcgctcagtggctctttggttataaattcagaggctcagcctcagaactggaggcttccaccagggaggacacgcaggagtcctccgagcctcacagctggccctgtgcgtggcactcacagaggctggggaaagactgggccttgcctgaagcaaggttatcacagttccgtccctgtgactgtgggagttaacggttgagaaggactggccatggagtcccggctacttgggagactgaggtgggaggactgcttgagcccagaagttcaaggccagcctgggcaacatagacagtga

SEQ ID NO: 232981 - DNA, 625 bp, Homo sapiens
agagtgagaccctgtctcaaataaataaataaacagaattgaaatgaaattgcttccacttccacagctctattaattatggtttttaacaccaaaaagggagggagggctaaaaagtttaacattttgctaattacaaagaattctctccatacaatttaagtaatttgagtattttctctacagaactacttctttctagtctcattccaatctattaaaatccaatggtagagacactccacagtaaaaatgtcaattcttcccaaatttatctatagatgtaataaaatttttaccaaggatttttatagacataaccaaacttattctaaaacttacatggaaagacacaagaccaagaaaagctaaaacaatttttaaaataataaaattggagaaattctaccaaatttaaagacttattatatagccacagtaatcaagattgcgtggtattggtagacggacagacacagagatcgatggagtagaacagagaagccaaaaacagatccacacaaacatgtccaactaatttcttagaaaaatgcaaagcaattaaatggaagaaggatagccctttcaacaaatgcagctagaggaattagacatcaataagaca

SEQ ID NO: 232982 - DNA, 389 bp, Homo sapiens
taaggttttggcactagggatggaaaggagggggtggatgtaagagctatttggaaggtaaaatcaacaactattgataattgatagtgagagagaaagagagagaggtgtctaggaactgagcttaaccaagggcattcatttgttattgtgctgtatcttgcatttgctaacgtacattcatccgtagtagacaggacctcaaaaatctaggcggatgactttttactttgacagcggaattacccttctaaaaataaggaaacccagctaggcacagtggctcacatgtgtaatcctagcactttgggaggctgaggcaggtagattgcttgagctcaggagttcgagaccagcctgggcaacatggcaaaatcccatctctacaa

SEQ ID NO: 232983 - DNA, 462 bp, Homo sapiens
tgccagggaccagcgtcctcctcgtcagtgaaagccccacttcctgactctcaaaataaaaataactcgatgtcctgccagtctgagctgcagtcaggcagtggaagtggaactgggttgctgttgaaaacatatgttccaccagcatctgaattcccctaaggctgtggttctgaaacaggcttagcaggtacaatgctctgtgggcagcactgtgaaatactgataactttcctttcattatgtggagcagtagcagtttaactggtagaaaacctgtgtgttttaactagcataaagtaagaccctgcttcagagtcctactgcagcagggctgtggctgctacaggccttaagccccaaagcagatgtccacacacaaactggggaatggtttcttcaaagccctggggtcctcatcactgcccccaggcaaccctgcaacagtcctggttaaaagga

SEQ ID NO: 232984 - DNA, 477 bp, Homo sapiens
caggcatactaaattacagcattggaaatcaaaataggggttatgtttagggcagatggagtgataatgtgactggaagcaagcatcaggcggctctgggagggttggctgattttctgtttttttacttgtgtggcaattattatggtgttcactttgtgttcatttattgagctttgcatttttgttttgctgtggttttctgtttatatgttatgcttctcagtttaaagaatgttgaaatcttctaatacgaaattttttttcaatgagaaggattttaagcatccagaatcaattttaaaatctccaatttgctttatatgtaggtttatggactgcttaactgctactcattttttccttcatttatcaatagtgaaatatgaaattaaaataatgactatttgtggcaaaattagggactatgtagcatattaacaactttataaataaaagaataaatcaactcaaaag

SEQ ID NO: 232985 - DNA, 427 bp, Homo sapiens
cttgtttatccaatgaagctcaaatctcagtgtgtgtcagaagatggacctatatgcaccagaaggaaatctggtgcatacacacacccgcaaaaaaaaaaaaaaaaaaaaaaaaaaaaaaaaacatatctttcaatggatatatccacttaataagattcctctactctgggtcttccagaattggttgttacgccaaataactgaaataattaccatacataattaacaatacaagatgggttaatgtaagatagtcaacatttaactaataattgaaggacacgcacccaaggacaaacagcagaaataaaaaacaaaaacaaaaacaaagccatgccttggtcctttgtttttagatacacacttggatactcatccactgaggtcctaagcagtctggctcccttccagttgacctggtcaa

SEQ ID NO: 232986 - DNA, 431 bp, Homo sapiens
ccatttactcagctgagtgcctgctttctgtcaagtattttaccaataaatctctactccacaccaccgacaagaaatattttggagccatttaaaaaggaggaaacggaagcttctgccgctgcctgatcctccattgctccgagccgcgcgggtgcagcgggctgtggagccgcgggccgagccccgccggagcgcccgagagcccgcgcgtcccgggcgtccgtcggggtccgaggtccctccctcagggagtccccgctcggcagcgctctcgcgtttcacgcagcggccggggatctgggacaggcggggccccgaggccgagcctggcgctgcccagcggccggtgcaggcctcaagctgggccgggcggaggggaaccggcgagttgaagccccggggccgaaagccggagcctgtggcggccg

SEQ ID NO: 232987 - DNA, 656 bp, Homo sapiens
ttttccagaaacctgagcctgagaatttgcttatggattgtatatgatgccaggaaatggaatagaggactgggaagagtgagagaaggaagagaagccaggaggagagtatgttacgagctgtgaataattgggacttgattccactgagctcctttgaagtatctgagaatttgactgcagaattgtgaacctgaaaatcacagaaaagagaatatttatctattgaaccttctcttcatcttgcattggtcaagagttgtcctacgggatattaagacacttgcactttcaagtttgcagaagtatgggaacgaaagcatccaaaaagccctgaggcaggaagcaagctgagacaaggtgttggtgatgatggtacacctggatgaagctaacttcagcagcaatagttgctgaatgaatttttcatttcatctaagttgccacattcatcagcataaaattgttaatgatattcttttagaacttggagggtggtaggagagagaggagcagaaaaaaataactattggatatgagccttaatacctgggttttgacataatctgtacaacaaacctccatgaaacaagtttacctatataacaaaccttcacatgcacccccaaatctaaaataaaagttgaagcaacaaa

SEQ ID NO: 232988 - DNA, 457 bp, Homo sapiens
tctttctgctccccccatccttgtgccaagagttattgaggccttaccaggtgccaggctctatgctaataagcatttgtgtagactgactttacacatactatctgatataacaatgaatcgaggagtaccattttctgcatttatttgtatattctatttagaaatctgtttggtggccaggcgcagtggctcacacctgtaatcccagcactttgggaggccgaggcgggcagatcatgaggtcaggagatcaagaccatcctggcaaacatggtgaaaccctgtctctactaaaaatacaaaaattagctgggcatggtggcaggcgtctgtgatccaagctacttgggaggctgaggcaggagaatcacttgaacccgggaggcggaggttgcagtgagccgagatcatgccactgcactccagcctggcaacagagcgagactgtctcaaa

SEQ ID NO: 232989 - DNA, 442 bp, Homo sapiens
acagaacaaatatttttaattttgatgaagtccagtttattcattttttaaatttatggattgtgcttttgctgtcatgtctgagaactattctctaatcctgtatcctaaagattttatcttgttttctttcaaaggttgttttagttttgccttttacatttaagtctatgtaatttttgtgagttaagttttccattaataggtgtgaggtttaggttcaggtttttgcttgtggctatccaattgctctagcactacttattgaaaagtttatccttcttccatggagtcccttttgcacctttgtcaaaatatcagttggccatacttgtgtgtggctatttctgggttctctatttcagagagaaattttaagcccaagggtggctttggtgtctgggtgaattttaataaagattttctatgtgaaggaataatg

SEQ ID NO: 232990 - DNA, 523 bp, Homo sapiens
aatgctgtccactaaaactttttgtaatgatgaagatatcctatagccaagctgaccaatacaatagacattagtcatatgtgactgttgagcacttgaatatgggtagtgaaattgaagaactgaatttttatttttagattttaattattttaaatttaagtagctgcagatggctaaaattgaatggtgaacttccaggacaaaggatgtttttgccttcaacaatatcggaaaagcaggggtgagtggaatgtcagattgcaatgcaattgcttgtgtttctgcggagttcatggaagaaactcattatactcatttgtaatgcttgatggtaaatttgattttctctttagaatgtagagattaaatcttggtttaaaactgcctctctgtgagcagtttctccatcagtgaaacgggtgtaatttcaactcgttgagagtgctcagttatgcaatatatgcaatgtttcttatctgtgtctgaaaacagttaataaaaggttgctgtgcttgacgct

SEQ ID NO: 232991 - DNA, 497 bp, Homo sapiens
ttccttccattggtatcctatctcagttcaccactggtgaaagttttgacaattgcaccactaccacatagcaggttatcagtacttcctttaccaatagtgatgtagttcccatttctagccacctggcaggtaatcaagctccaaaatccaattttataatctgcctcatgaccaccgctaacaccaagtattaaactttaagttccctcagaaacagactctcatgaacaacacttgtaatggagtgattgaagtaggatccagcagagggagaatttatgaagacacatacagttacaacagacgcctcacctgatcccacgggatatctaaagttgggacagccattcagaaatgttctaatttgagaccggacacagtggctcacggctgtaatcccagcactttgggaggcctgggcaggatgattgcttgaggccaggagttggagaccagcctggacaacacagtgagaccctgtctctacaaaaaat

SEQ ID NO: 232992 - DNA, 761 bp, Homo sapiens
ctcatcaacactacaaatctaaagctgaaagctcagggtacggtaatgacagatggaaacttcattacagaaagcaatgaagaacacccaagtggtgtagaccagacccatgacttgctcctaaacaacagaatatgacaaatggaatggcacgtcactcccatgattatgtgatgttatatgactgtgtcttgctagctggctggctccacagacgttctctctcccttgctggctgtgaagaagcaagctgccagaactcctaaagccacatggagctcattgctgccaaaaggaattgggaagcaaatccttccctagctgagcctccagttgagagccagtcctggccaacaccttgaatgtagccttgtaagaccttctgaggaggaccaagctatgccgtatccagatgtgtgacctgcagaaactctgaggaatgttgaaaagctgttctgaaaaatagagctgctccccgtgccaaaccagttgggctggaatgaacaactgttgttataaatctccgctcctgccttcttcaacagccccagaaggttcaaaatagaatgtttcatgagaccagccagacggattgaatcagacctgcccagaagagcgctgtgccttaagagtatggaaacacccctttctctcctccctcctcccactctttttctttcagacaatttctgggactgctgacgagaggagggcatgtcagggttctctgtgttcataacaaattcttttgtgtctttaag

SEQ ID NO: 232993 - DNA, 145 bp, Homo sapiens
gaagataaatcggaaagggatgtgaacataaaaatttacaccaggataactcactttagcaatcaaccgagtgtattaatacttcactgcaaaaatcattacagttctgtagcaataaaattatgccattgagtttattttatta

SEQ ID NO: 232994 - DNA, 368 bp, Homo sapiens
ccctcattatcaaaagtatttccctgaaaagaatactgcctgttgtctctctgtttctccctgtcatcaacaacttctcccatttggccacgcagactccccacattgccagcttctatctcaggacatagggagtgaggcttgcttaggcatatacaggcatgctgcaggatgaatgaggtcaggaaatactggtccttttgagcctcggaggtactgtgtcttctcaagcccagggaaaagcctagcttctttgagaaaatccagaagtggtaactggacttcagtgaatagccctttaattttggttgataaatgtttactggtaaaagcatacttgagattaaaaacaaaggtaaatattctta

SEQ ID NO: 232995 - DNA, 439 bp, Homo sapiens
caaacagacttagtctacctgccgactaagatggggcaatcctgaaaaggtgaggaggacatggccggaagtggggcctgtcccctgcatatgctgagcatggagcttccccattgagctcagatgcaggctcaagagtcattcccagcacagctctgcagccagccacaatcaatcagtcagcccgtagggccaatccgtttgcaccctacaccccacactatccagtgaatgggccgagggctgcgggggacgcaggccaggagagggccgggcgcagcaaacagtgtgcgctgagaccctgggctgtccccgctgtggagcccacgtgcaatcgatttgagcagggccacgaggcaggcagagagggctggacatgcagaggccacagaagctgggtggcgtctatggctcgaggcggtgctgccgagcgaggcca

SEQ ID NO: 232996 - DNA, 169 bp, Homo sapiens
cagtacatgcttgaggactctccagacctcctctttccctcccccaatcatgtactaaagccagaatccacccttgaacattttctaataaaaatactgccttgaaggtggcaccaggagacagatttgagctggactcctgtctcctttttggttgaccttcaataaa

SEQ ID NO: 232997 - DNA, 112 bp, Homo sapiens
agggccatcccggctgggcagcagagaccgcatgggagggattcggggactggaatctgcaccagggtcactccctgctacccggatcccggcccccttcagacccttcggc

SEQ ID NO: 232998 - DNA, 452 bp, Homo sapiens
gagagtgattttttttttctatgaaggaatttatcttgtagcttcttccattagtactcaaagtatgaccacacgcttaagatctttgtagatgtgtgtattgtgcatcagagtgtgtaagtctaacccatctcaacatttgaaggcacttttaggttactctttaagagtgagactaggggaaaaggctgaaggttggggcaggatggtacaaggtattaataaaaagtggccacaagcaccaaatgtaaaactaaagtaatcatacaagtgttcaactacatacaaatgcatatgtaagaagactaatgaggccaggcgtgttggctcatgcctgtaaccccaccatttagggggactgaggctggaggatcgcttgagaccaggagttccagatcagcctgggcaacatattgagacctcatctcaacaaaaaagttaaaaaaaaaaaa

SEQ ID NO: 232999 - DNA, 315 bp, Homo sapiens
ctccttgtttacagcttcagagagctcaaggcacataaatcttgagggttctacagagcgcagagcacatttgtatgcatcgttaggactcgctaatacctaagcccattaaggagcgtgtatgcgcgtggtttccggtgtgtattaacttatagttaaattctggaggaaagggcattgtgaattaacatataccaaatccatcatgggcttttgtcatatcagattagtcagtcatgggtttgggggagcaacttgcctgggttggtgtgtacccacccttcaaactttgtggagcaggcccaggggtcttgg

SEQ ID NO: 233000 - DNA, 216 bp, Homo sapiens
ttccctagaaaagtttaaaatatggtaagctttgtgaactgacttctcctatttaattgcacacaaaattatataatttttcatagaaaataaattgtaagtaaataaaacatttctgagcattcttcagcttcacattctcaactcctacacctctgctgtgttttcttggtttaggtatttaaagtgtgataataaaagtgagaaacaatgtta

SEQ ID NO: 233001 - DNA, 470 bp, Homo sapiens
acttgtgagagtgtttccctctccgtaccaaaagagaaggatgactaaatcagaggaaactattatcaatggagaaggcacctactgaaatctgcataacaaacattactcttatttaccatacttgtcctgttcacctccccataactggcttcgcccacaatcttctctgtttttagttgaaaatgctttagaagctggagttctagatcacctctttcagaattactcattttcccctgggtatctcctatgtatacatgaagcatacatgttaacaaacttctgcttgtttttcttttgttaccctgttggtttgttatagtggttccaacccagaaattagaagggtagagggaaaatgattttttttctcccctccacttgaaatatgtattcttcctgctctatgaagttgtttggatgttcattaactcaccactctcaaatacataattagtttctgccta

SEQ ID NO: 233002 - DNA, 588 bp, Homo sapiens
accaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccccatctcaaaaaaaaaaatatatatat

SEQ ID NO: 233003 - DNA, 480 bp, Homo sapiens
tgaggacggaatggtgggcaaaagcagacagggtcctcgccctcctggggcttacagcggaaggcaagagatggcattcatctgatgatctccacaaacgtgaaatgtcaactgtggcttagaggtgcacagttatagagagccgcttctgtgaaggtgtttggcccagtcagggagtaagggaaggttttctggagatgtgacattttagccaagacccgaaggatgagtaagagcagcccaggtgaaagagggaaggaagagagttcagggcagagaaacccacctctgcaaagggaaggaggctggcaaacaggggaaagaaaagaaggtcattgtggctggagccgagggagcagagatgagtgagggtggtgtacggtggatgggaacacacacagaggccggacctcagacacccttagagagcttttgtttttacaggagatgaataaacagaagccatggaagcattttaac

SEQ ID NO: 233004 - DNA, 984 bp, Homo sapiens
gcaggctggacatatgtgagaagtgctcagtactaatctgtccctctgctagttagttctgtacagttatccccacagtcctcttcctaaagtagacattactttcttgttcaggtctagagttggttgccttcgcatgtagttaaagttctgtagcatggtgtataatatccataacactcaaccctgcttacctctcaagaggcacctttacctgtcaccccacagtctatgtgttaaatttctgttccctagataccttgggcctctttctaaatacacactttcatgtccattatttccccctgtctggaatactctagagcctttcattgacaattcacttgttctttttggtgcccctcctcaatgtgacccttttagaaccttcatcacagaaatagttgttctgttttttcagcatctgtgattctttccctccctgtcatagaataaaatgtgtatttatagtcatcaccaagaactcatattgcctcatggggattgtatctcagcatctagaatactgcgtggcacaaagtaggtacttgctaaatgtttctaaatataaatgattgtccaagcttaagtaagtacaggagagattcatatatattcttaaatgatttgcatgtttaaagagaataatataatgctcaatagatggaaaataacaatgagactgatctatacctgcaaagaatgaaatgttctgaatgtgtatttaaaagagagaggaacaccaagacagttcactggagaaaagaataatcttttcaataaatggtgctggaaaagctggatatccacatgcaaaaagagtgaagttgaaccactacctcacatcatatgcaaaaattaactcaaaatggactataaacataaatctaggaactaaaactataaaacttgagatacaaaattttataaccttggattaggtaatggatttgtatatgtaacaccgaaagcatgagcaacaag

SEQ ID NO: 233005 - DNA, 145 bp, Homo sapiens
gcaggctggacatatgtgagaagtgctcagtactaatctgtccctctgctagttagttctgtacagttatccccacagtcctcttcctaaagtagacattactttcttgttcaggtctagagtgatattagggggatcctctatg

SEQ ID NO: 233006 - DNA, 160 bp, Homo sapiens
ctatgatcacaccactgtgctccagcctgagtgacagagtgagatttcatgtctaaaaaaataaaaaagattttcttctaaggccacatggctggtcagtaacatttcagaaagaataatgctagtctccctattgcaaatgtaaggaaatttccattgt

SEQ ID NO: 233007 - DNA, 424 bp, Homo sapiens
ggttgccacaacagatgttgccaggtgtccttggatagtgacctcccatatgaagccactttcctctgatcaggcctgacagcttcacactgtggagggagctgagaacaataatctttcaaggaacagaaaaccagacgccacatgttctcacttataagtgggagctaaacaatgagaacacatggacacaggggggggaacaacacacactagggcctgttgggggtgtggggtcaggggagggagagcattgggaaaactagctaacacatactgagattaatacctaggtgatgggttgattggtgcagcaaaccaccatggcacatgtttacctatgtaacaaaccttcacatcctgcacatgtaccccagaacctaaaagtaaaattaaaataaaaaaaatcttgagcattcaatgt

SEQ ID NO: 233008 - DNA, 380 bp, Homo sapiens
gtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcag

SEQ ID NO: 233009 - DNA, 211 bp, Homo sapiens
agcccaagttatgcttgtttgaaaatgcgtggcatttcataatcctgccggaacacactcttcttgctgcattaggatccaactggaaaacataaagatgaattgctgtaggctggaaaatcaattaggaaaaagaggtaaaacatctggtgttactcttagaatatgaaaattcattttgcacatttaaaataaatgtgttgagttgatt

SEQ ID NO: 233010 - DNA, 501 bp, Homo sapiens
gctataaatttctctcagagaaatgatttcgttgtgtcccacaggttttgacatgcggtgcttttattttgttcaagtccaagtatttcatatttttccctgtgatttccgctttaaccaaaggattattcatttgtatgctttttagtttccaggcatatgggattttcctaaagctatccttttgttatcgacgtctaattttatagcattatggccagagagtatagtctacgaggtgatgttgactctttggaatttattgagcctcctttgtcacccaagttcaatgttgacttttgtgaatgttccatgttttctttaaaataatacgcattctgtatttattaggtgtgaaatatatttgtattagttcaagcttactaattgtgtaattcaaacctaccatttgttttctttttgttggtttaattgattagtttcacagagaaatatgttaaaattaccaactataataaatgatgtatctgcttattccta

SEQ ID NO: 233011 - DNA, 453 bp, Homo sapiens
ggggttaccacactgcggttctcagtgtgtgcaccggtgggggtgggatgggtctatagccccaagggaatgggaaggagagggaggtgtagggggaggaaggtcagagaagggtgaaaaggagcagaaacatagatgagaacaacaccagaagctgcagatcaggtaagggctgctcctggcccaactcctcctgactgccccccatcccactccacccctcaggagcggaagctgctggaagatcgtctggccgagttctcatcccaggcagctgaggaggaggagaaggtcaagagcctcaataagctacggctcaaatatgaggccacaatcgcagacctggaggaccgcctacggaaggaggagaagggtcgccaggagctggagaagctgaagcggaggctggatggggagagctcagagctgcaggagcagatggtggagcagcaa

SEQ ID NO: 233012 - DNA, 1081 bp, Homo sapiens
  misc_feature (26)..(26): n is a, c, g, or t
  misc_feature (58)..(58): n is a, c, g, or t
  misc_feature (61)..(61): n is a, c, g, or t
  misc_feature (94)..(96): n is a, c, g, or t
acgacgcgtgacctatgtacaggagntccggcagcgatacgagatcctgacacccaangcnatccccaagggcttcatggatgggaagcaggcnnntgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacctggaggaccgcctacggaaggaggagaagggtcgccaggagctggagaagctgaagcggaggctggatggggagagctcagagctgcaggagcagatggtggagcagcaa

SEQ ID NO: 233013 - DNA, 1139 bp, Homo sapiens
taagagagatgtaggcattatactggttcatcttttacctaatgcatgaccagtatactagaggaagttgtgatggaccagagtctttttgttttgtaatcaaatgaatagttccttcataaccaggacagctagtgtgtgcttgagaatgtctccctcaactatatgatctgggatattctgcattaaaaggactcccttcccagtattgggagaaagagagataaattgacacatttttactctgactccttcatttatcttcccacatacaagatcattttgtcttttaaaatgtacaaggttacaataagttaaatgttattagtggccttctacatttgatcagtaatgtagatggctacttttatttacttgatgttgcattttgtttttttaactataagtttcaatacactaatctgactggcacaagttgcatatagttcccagtggtccacagggttcatcattccaaaaatatttattcataacattgaatggctcagattacataaaattctatctgttgtgaacaggtcacctgattgtaactattatctacacagttggccttcttcatctctgggttccacatccatggattcagcccactgtgaattgaaaatataaggagagagcgtctgtactgaacatgtacagacttttttcttgtcattccctaaacagtacagtatagcaactatttacattgtattaggtattataagtaatcacgagatttaaagtatgcaagaggatgtgcacaggtaatatgccatgattttatttttcctccacctcttccccctccctgcatcatgttatataagagacttgagcatctgtggattttgttatctgcagggagtcctgaaaccatggatactgagggaaaactatatgatttcccccaagaaggcagtgacatgcacctgtaactctttttcccctagacatatctgtgacatgcttaactacttttatttttccgatgtcaccttaatcagagaaaacttcccagaccaccctatgtaaaataaagcacctctgctgctgctttattctccttaacactactttttttctatagcacctgtcaccagttgacaggttaagtttaacaacttctctcctgt

SEQ ID NO: 233014 - DNA, 392 bp, Homo sapiens
tgtatgtctatgagtatcagaagagaatgcagaagataaaaacctgcgtgaatgctggagatgcttcatccctctggtccatctgtatcaccctgtgatgatccaaggaaactctggaagtgtagtgtggagagaggaacatggtgagaggccatccaggtatgctagagctgaacataaaactgggaattcttgactaaaagcaaagaacaggctcacccctaacatttgtgtggcttgagcatttataagtcataaatcaactaccttaaaattttaccttcataatgacaaatttaaaaatttatgtaaagttattgtttttacatagctttatgtaacttaatattcatagttatgaactatatttaaaataaaaaatataaattgca

SEQ ID NO: 233015 - DNA, 141 bp, Homo sapiens
gctgaaagacaccacacagagtgttatcagtccccatgccccacccaaaagggaccctaagacaggaggtgctccccttacatgccacctatcaaatgggtgccctgggcctcatctcaatcctgaaatccctggggatct

SEQ ID NO: 233016 - DNA, 375 bp, Homo sapiens
aagatttttgggagagaagaagtgttgcggggaggtggaggtggtaattataattactaaaacaggaaagaaagggcccctatgcagaattcagccaccctctgtaagtcaactcagatgggaaggacctctcgatctgtccaggaattcttttctctctgaggccaccactgaagaaagcagagcctggggccccaagaagaccctcccctagagacaatgagggagctagcaccagaagctgcccatgagtggacctgagatccataaaatgtagtggcccaaactgtacaataaccaagactcaatctcacctttctacctggtagactgaactcaaaccatagctacaggggagaaggtgtgaatttctag

SEQ ID NO: 233017 - DNA, 360 bp, Homo sapiens
ctactgatggcgaagtgtgtctctaagctgctgagagccgcagagaaactcgggaggactgagcgctactgcgaaaatgctcgttgaaccaaaacacatagacgatgacggaagaaaaccaaaaacgtgtaccttatctctaaacactgcccgagtgtgttattcaaatggttgatgtgaagaaatacctcaatctatctctgcatgtatgtttatttaaatctcgatccatcagtctattgtccttgtgggtaattttgcaagccagtgtcccgcacattgccagggatttctggagggggctgttacctgtggttgggactgaaaacaattttaaagcatcccatcatgcagttgtgg

SEQ ID NO: 233018 - DNA, 241 bp, Homo sapiens
cagcgtgggctcgtgggcccgtgggctcagctggacgccaagaaccacagaaacagctcccacccgcctaccccctcactctgcaagtgactcattggggtttggagtgggccaccctaggggtggctccttgttggaataagacagtcaccctctaacagagcaggcaaagatggcatgccaaaccccttgcttggcaaggtttctgaccagagggcaccaaggcatctccttccagcca

SEQ ID NO: 233019 - DNA, 474 bp, Homo sapiens
tgctgagtgaaagaggccaggcacaagagagtacctgctagatgattctatatacaattcttaacaatacaaactaatttgtagtgacagaaagcagatcagtagttggggtaggaagggtggatagaaaacaaaaggacataaaactttttggggtgatgggttatctagactgtagtaatagtttcaagataggaatatattaaaacacttcaaattgtaccctttatattaggtgtatttatgtaaatcagttttacaacttaataaagctataaaaaaattggaaaagaacacatactataattccattaatataaagtcaaccaacaatagtctagagtggcagaaatcgtatcagtggttgtttttcaggtgggaattgattgctgagggccacaggggaattttctgggtgatggaattttattgtgtgtaaattgtaccacgacaaagttgaattaaaacataaaa

SEQ ID NO: 233020 - DNA, 310 bp, Homo sapiens
cccctcccacgacacactatcccgctctgtgctccacctgcattgacctttccttggtccttcttgccacaggccatttgcacatactgttccctctttctagaatgttcttccctccccctccttgctctctcctacccattccttagagctcagctcgaatgtcacttccttaggaaatccctccaggactgcatccaattctaggctcctgtggcattacacacctctctctcctcattcttgctgttgttttgattttaaattatcttcaactttttgatgactgtcagtctgtcccactagactg

SEQ ID NO: 233021 - DNA, 273 bp, Homo sapiens
aagctatcttcttggtcccagagagccttattacttaataatacatagatatctgaccatcaaatctaataattttcaggttcaaaggatttggaatttctaatttgggcttgaagttggcaaggagtgcaaataaaagagaacacaaatgcctaaaatgcttatctgtccttacaaacattcaatttctgttgtgtatcagagctggtctgaagctgtaattacagtagtgctgtaactaacttgtgcttgctggttctggaatttgatgat

SEQ ID NO: 233022 - DNA, 403 bp, Homo sapiens
gcaccttctcggcctctgtctgggtccccaccttagtctacggtgtcgccttttctaactgcgagtgctaaggaagaggcgaggggcgggctccgaggctaggcgggcgctcggggttggagccgagggtctgggcaaaccggtgggtccctccccactgcgggagcggccagggtgggaaaaccgcggtcgggcgggcggggtagggccctcccgccgccgtggctcctggggaggccaggggtgaggagctgtcgccgcctttgcctctgcctcgagggccgcgctgaagagactggtaggagagcgccgcgggcggatggaggcgactcttcgccccgcctgagctcaggaggggctagcgcggagcgcgggtcccgcctccagccgcgggagcggccgc

SEQ ID NO: 233023 - DNA, 468 bp, Homo sapiens
gaatctctttcagacctagtgaaaaaaagctcaatcagtgaaaaattattgattttcctatcttttaatccaaaataagcctgcaaatacctcataataatgatgatgatgattgttttttcttagtatcatttcttaacagatgcctgcctccccaacacttgtattaaaaattatactaaacttatttcatataaataaaataagggtgtgtcatagtaatattttaggacatcatacccatcagaattgaattatagggtctattgccacatattggggatgccttcttaaaagctcctcatgcatataagttaaatcattcttttattaatcttaaaattaccaagggaaaagtttttattcaaagatttggaattgctggtgattgaagagttgaaaaagaaaaccagaagggaaaatgacctaaataatacttgtaagagtttccaaattaaaaaaaaaaaa

SEQ ID NO: 233024 - DNA, 410 bp, Homo sapiens
tgcgctactggaccctcacctatctggcgctgcccacagtgaccgaccaggaggccagttccatgccctccacaggggactctgaggccactcccgtctcccccgacaggcaactccgagtctgcccccgtccctgcaacgggtgactctcaggatgcccccgtgtccccctcaggtgactctgaggctcccccgtaccccctacgggtgactctgaggcccgtgcccaccttgggtgacactgaggctgcccctgtgtcccccacagatgactccgaggaagctcagatgctgcagtcattagtttctagtgtcccatcagccttggtctcaagaggccgagagggtgcaaccccaggggctcccctcccatcttgagctcttcctgaataaaacctcattcccctgtc

SEQ ID NO: 233025 - DNA, 788 bp, Homo sapiens
gagcccggtgcccccgtttacacttcagcaaaaaaaaaaaaaaattgtttacttgtcaaattgaactaggtcaatttgaatatgtgtattgctctaatgtatggaagttcttagtataagagctgaaggatcatgactttcggttaatagatgtttgaaatagatgtttagaggttactgatacacatgtcaagttgttcattcccatcatttaaaatatcaccttataattccacagaaaagtaaatggtatgtggacgtcataatttagaatgtgtaatcttttttaaaatcttataaaaatacactggactcagtggtacgtgcctgtagtcccagctacttggaaggctgaagtgggaaggtcactagagcccagaagttcgacactgtagtgtgcaacaatcatacctgtgaatagctactgtactccagcctgggcaacatagcaggactcttatctctaaaaaaaattttaaatcttataaaaatgtaggtatatctggccaggcatggtggctcacacctgtaatcccaacactttgggaggtcaaggcgggtagatcacctgaggtcaggagttcgagaccagcctggccaacatggtgaaaccccatctctactaaaaatacaaaaattagctgggtgtggtggcgggcgcctgtaatcccagctactcaggaggctgaggcaggagaatctcttgaacctgggaggcagaggtggcagtgagctgagatcgcaccactgcactccagcctgggcaaaaagagtaaaactccatctca

SEQ ID NO: 233026 - DNA, 2346 bp, Homo sapiens
  misc_feature (1511)..(1511): n is a, c, g, or t
  misc_feature (1916)..(1916): n is a, c, g, or t
  misc_feature (2290)..(2290): n is a, c, g, or t
ctctctggccgcctctgcctccatctctgtgtgtctgcgtcttcgtccctgtctctgagtttcggcttgggtgtctctctcctaccccggtctctctgtgtcctgtctgtctctgcctctcctgtccctctctccgcagcgccctccccgtctctgtctctctgagtccctagctcgctccttctctaaatctgtgtccctatagccccctgcgtctctctgactctccctgcatctccctcccctgtctgtgaatttctctgtgtccatcttctgtcctctccctccggtccctggctccctgccgtgcttcctctggtcccgagtctccccttcatctcccgcctggccctcctccctgtggccacctcctccctgcggcctctcggggcagggtgggcgcctgggcgtgctgcgcgcgccctcatgtggccggcagacgctgcgtgtgagcgccaaaaggggagtgctggggagcgggggacgctggtgttcgcggtgacactgggaaatggcgtgtgacacctggaggctgtgtgagtgtgtactgccgggagacggcgtgagacatctggagagtgtgtgagtgtgtactgccgtgatggtgtgtgactccaggagatctgtgagtgtgtactgctgtgagatggtgtacgacgccaggaaactgtgtgagtgtcgactgccgtgagatggtgtgcagtgccaggaccaggacaccatgagtgtgtactgccatgatggtgtactggtgagatggtgtgtggtgctgggagtctgtgtgtgactgattgatatgagattatgtgcgacaaggagagactgagtgggactgcatatgtcagagatgacatgtcgctgactgtgtgtgacactgagattactggtgatgctgagagattgtgggtgactgtgtgtgctgatgaaaggttatgtgtgatcgggtgtgggagagacactctttggggctctgtatgggacattgagagaccgtatgtgggagtgagagaccgtgtgtgacggtgcgtgtgagggggcagtgtgtgtggctgtgtgcaacatggtgagcatacggtgctgtgtgtgtcacagaagtagattctgtgtgagagagagtgagactgatgactgatgtacactgagaggtggtgtgggcaggtgtcatgagaggcacatagggggcctgggtgggacagacacagtgagtgtcagacagtctgtgttggccactctgtgtatggcttgtgaaaaagtgcgtgatccgggcacattgctgtaatcccagcactttgggtggctgaggcgggaggatcccttgaggccaggagtttgagatcagcctgggcaacatagggagacccctccccccacccccgccgtctctaccaaaataaaaataaaagaaattaaccaggtgcggttatgtacctctgtggtcccagctactgggaggctgaggttggaggatcgcttgagcctgggaagtggaggctgcagtgagctaagatcgngccactgcactccagcctgggtgacagagagagagaccttgtctcaaaaaacaaaacaaaactgcgtgactatgtgtgacactgagctggtgagagatggcagcgttgtgacagtgcatgcgagagtttgcggctgtgcagggcactcggaagcgagagcgtgagggaggccttgtgtgtagaaggcaagagatgatggagaggtgggagtgagtgtgtgaaacgctgcgagcttgtgtgggactctgtgagacactgagccatcgtgggtagctaggtatgacaccaggagatgggttgcgtgcgtgtgtgtgacagggacagactgtgtatggagggaatgtgtcagatgcgtgtgacaccaggagactgtgagagaatgtatgtgaccttccatggttgtcnctggacaggcgactgggtgttactatgaaatactataaaacagtgtgtacttgacaggttgtattgggtaattgcatgccaccgtgagacacagaaagtgtgagactgggacagggtgtgagattgagagagtttaaatggcatgcaaggccaggcgcggtggctcacgcctgtaatcccagcactttgggaggccgaggcgggtggatgacctgaggtcaggagttcaagaccagcctggccaacattgtgagaccctgtctctacgaaaaatacaaaaatcagacgggcgtggtgtcaggcacctgtaatcccagctactcaggaggctgaggcaggagaatggcttgaacccaggaggcggaggttgcagngagctgagattgggccactgcactccagcctgggcaacacagggagacttcatctc

SEQ ID NO: 233027 - DNA, 747 bp, Homo sapiens
cgggagtccagactggagagcagtggcacaatcatggctgcagccttgacctcccaggctcaagtgatcctccaacctcagtcttccaagtagctgggactacaagcatgcaccaccgcacctggctaatttttgtattttttgtagtgatggagtttcgccatgttgcccaggctggtctcaaactcgtgggctcaagctatctacccgcctcaacctcccatagtgctgggattacaagcatgagccacggtgcccagccaggaaaattatttttaataattccaaaatagtaagtttataacaagtattaagtttttgtctttcaaaagacaaaacctttttgtggaagaaccctctaacaactgattagtctgatttttttttcaaacacttatgaaatgatacatgttgtctccaggaatatttaatttgtattttaagattaacgcatttaataaaaccataaacaaccactgacttttatttcaaacaggtccccatttactaaaaccttgacctttgactgtgttatattctattaaaagtaacaacattctacatatgatttaattctccctgtaatctaataaaggcattccactaaatatatatatatttttaatttcacttaaaaatatatataaaggcatttcacttaaaaatatatatatatatttaagatatatatatatatcttaaatctcccacatattcagagcatagggaaagaaatgtgtatgagct

SEQ ID NO: 233028 - DNA, 508 bp, Homo sapiens
acaggctacaagacagcattgttacatgttcccgcttatggaaaaatcatacatccctgtgcatatatgcataaaaaagtctagaagaatatttatcaaaatgtcatgagtgatcatctcatcaggtagctggacctaaggggccttttaatctcttatacttttctatactaacggaaaatttctaccattagcctctattatgcttgcaaacaggtgaaaaataataaagagcagtaacagaaaaaaaatgactctaagaaaggtgaaataatttaatgttaggtaaattgagtttggaatgccaataaaatatcccagtgaaagtgcccctatgcaactgaaaatgcaaacagaaaagcagggaggcgtgtagatcatttaccattttcggttcctctcactaacctcatttccattttacttacattccagttttacctatatttatcctctaatgtacatcaattttactttccaaatacataaaaaacactaggttcttcca

SEQ ID NO: 233029 - DNA, 285 bp, Homo sapiens
ataaaagcgttctttcttatgcatttgcaaaacaatgattctgtctgctgtggattcctcagttttctaggaggtgaggaaatactgaagagcaaacagacccaccctctgctctcaggccaccctattgtcccttacagtgtgtgtgctcctggctcatcctcactctgctccttaaggctctgtggggtcccaggcataagccttctctcagttccttcagtgccactcaggcctggctgccacgatacagatggtatatgtgaaatacaaataactatatgc

SEQ ID NO: 233030 - DNA, 500 bp, Homo sapiens
  misc_feature (447)..(447): n is a, c, g, or t
cggggtttctcttccacagccgtcccctctgtcattgcccacccgcccaccattcagcacactcatctgagtgccttgttcctgccggtaaacactggctgtctctgggaaactggttcctgctgaggcgttaatgggtgaatgtgttcctcctttgagaagttccaatttttaagaagcaggaagggagggagggaggcaataattagcttgaagggttcagttactgagaagaaaacttaaggccttagccacaggctagttggagggaaaggggccatggtgagtatcttcgatgggttaggaagtcttctgtgctctttccacactgcttactacccagagtggctaaatgcatggattctgaagtcagacgaaactgttttgagacccaactctgtcgtgatctctgtgacttttttttttttttcgaaacggagtcttgcntgttgcactccagcctgggcgacaaagggagactccgtctcaaacaaacaaac

SEQ ID NO: 233031 - DNA, 559 bp, Homo sapiens
ggttttatgattaagttttaactcgtttttagtaacagaaacaatgtagtgagttattcacaaaactatatagtatatttcttcaatttattctgagattgtattattttacttttctttgatgatccagtgttgataataaatgatagttttattttcagtgcccgtacttagctaaacaacacttgaaaccctgtattgtttcccaaattatgtttcaaaatcttacctaagtaaatccaaatgtccatgagcttatgctttagcagatactggtgttctttatgtgcctattactcactttcactttaagttatttgacagcatgtgtcactatttccagtcagtttttgatttaactaaaatctttttgtcttcaaatttatttcttttttaattttgagattttatagagattggtaaaaagtttaagaaatagggaaggagatcatttataaaactagaaagtaatcttaatgttagtgtcactgtataaacttaatataagtgataataccagtgcattagtcattattttttattacactttcaaatgaca

SEQ ID NO: 233032 - DNA, 169 bp, Homo sapiens
attatttatatgccatagctccttcaggctggagacattggagtcccatctgtatctcattactcaggtctgagtctagcacgaggtaggccctcagggaatatgggtggaattaacttttttgtagaactgtgatttatgatttttgaaatgaacaatcttaaagata

SEQ ID NO: 233033 - DNA, 256 bp, Homo sapiens
tgcctcccaggttcaagtagctgaaattacatgcatgcgcctccactcccaggtaattttttgtgtttttagtagagacagggttttgctatgttggccgggctggcctcaaactcctgaactcaagagatccacctgcctcggcctcccaaagtgctgagataacaagcgtgagccaccgcgcccagcccacttcaccatcttcaaaataaggctaactaaaccattcttatgtagctcaggggactgttgtgat

SEQ ID NO: 233034 - DNA, 186 bp, Homo sapiens
ggagacaaatgttcaatttatttaggaagaaatgcccccaaaagctttaatgaacaaggccaagtgctcaatcccttttgcaggagatggcttcaagtgctttaataaagaaccatgtactcaatcgtcttcggaagaggggtctccaaacggttgactggagggatcccttctggagggagtctc

SEQ ID NO: 233035 - DNA, 587 bp, Homo sapiens
gggcaaggaccattcgtgtggggctccaggacctcagacgcctgagtttagagtgtctgcttcctaatgcatttcaactggagtgcactccatagccatgatgcagttatccctggtgctctttttgtgccctcacctcacctggcactttgggaaatgggagaggcaaccttcattgaatatgtgtgctctggtattgacattaggttagaaagaagctagcatatttctgttgcttttccctttcacattggtctggtttgaatttgtgtccctacccaaatctcatgtggaattgtaatccccaaggttggaggaggggcctggcgggaggtgattgactcatgggggttgactcctctcttgctgttcttatgatagtgagtgagctctcatgaaatctggttgtttacaagtgtgtggcacttcccccttcacacactctctcctgcctcaccatgtgatgatgtacctgcttctccttcaccttccgccatgattgtaagttcctagaggcctccccagccgtgcttcctgtacagcctatggaactatgagttaattaaacctattttcttcataaatta

SEQ ID NO: 233036 - DNA, 465 bp, Homo sapiens
aatcatcaccagcagctattaaaaattgggctccaagtgttacctcttgggaccgtgactgggcatgacagtgggaggcgcttttgctttgcattttatttatacctttgatattgtctggattttttgtttatgtcttacttttgttatatgtgtgtgttaaaaaactaatttaaaaaatgacactcttttctagatcaaagaaatgaattctgtggagcagaatatgtagtactttggaaagatgatcaaaataaattactaagcaaaaaatgatacttttgggggtatgattccattttgattaaaatgtatccatgtattaaaaaagtctggaacaatgaatattaaaatattattaacattttcttgttttagcctatctttatcttctattttgtctagtgtgaagatatattactattgtggttagataaaaataattattgattttaattaaaacag

SEQ ID NO: 233037 - DNA, 117 bp, Homo sapiens
cagaggatgagaattgtttactccctgtgtgctctgtgcatgtgagatgaatgtcacactccacacacacttgcagactcccagccgggtgccgttcctgcccttctggggttgatg

SEQ ID NO: 233038 - DNA, 938 bp, Homo sapiens
agacggagtctcgctctgtccgcccaggctagagtgcagtggcgcgatctcggctcactgcaagctccgcctcccgggttcacgccgttctcctgcctcagcctcccgagtagctgggattacaggtgcccaccaccacgcccggctaatttttgtatttttagtagagacagggtttcaccgtgttagccaggatggtctcgatctcctgacctcgtgatccacccgcctcggcctcccaaagtgctgggataacaggcgtgagccatcgcgcccggccgagaggtaccttttatgacaactgaaatcattcagtttcaagaggagttgggtactgaaaccaaacttgcttactccaaagcccaaaatcctttccaccatgcctgtgtgtctgtaaggctacactagaaatgcttcctttcttatagtgggaagcatgggtactaagctcttttacgaacaagtgttctgcatattcctggttcctttttattttggactgaggagatttaggtcaaaatttctgggttctgggttggaattccagcttctttcttcaaattaaactggggggtagcaagacttattcctagatttgttagaaggccacagcttttccacatctcattttagtcatgaaaaagacacatgcccagagtttgaaaaacataaaggcaatttgactagtggcttgattggttctatcttctttttcttgtccctctttcctatttatacttctacttttgttacagcatttgacaatagttggaaaaattttcactgaccttgaaatgtctttgggatagggtgacttaaaatataggttaagtggcatacacaaacttcttagtgagatcctaagggcctacagagacaggctgacaccaactcaacccttgaaactgtgcaatgaagagcctgtgggaggctaaaaa

SEQ ID NO: 233039 - DNA, 1064 bp, Homo sapiens
ctgagagacaggacagagggagacccaaagatctggtctgtagctaagtgaattttctaaaactcattgattcacacgccatcccttgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttgaggtgtaagagggtaaattgaggctgtgttggggctgcaggcgggggcagaattgggggctgggtggtttgggccttcctatccctgtctgcccacaggcctcctccggagtggagctgggagactgcaagatcagctatggatcaacgtgttcggagcagaaacaggcctacaggccccaggatctgcctgaagataggtataaaggggccactgcgggcacggtggctcatgcctgtaatcccagcactttgggaggctgaggcagacagatcatgaggtcaggag

SEQ ID NO: 233040 - DNA, 223 bp, Homo sapiens
tatatttaactttttaagagaataccaaacgatctttcaaagtgcctgtgccattctgccttcccaccagcaacgcgtgagggttctgtctctgcacatttttgccaatacttgttatggcctgttgttgttgttttcttttgtttttaattatagccatcctggtaggtgtgatgtggtatctcattatggtttcatttgtgtttccctgatggcatttctc

SEQ ID NO: 233041 - DNA, 348 bp, Homo sapiens
ccatatcattcacctataaagcctgctggtcttaatatttctctgtagtaagacagctcatgtgcagcttatctaaaaatgataccagatcaagtttacttggggagaaatactctgtaggtttttttgtttgtttgtttttatgagaaaaaagcagtatatactaatgtggaaagatgtagcgcgtcaagcagtgagcccattacttggtgtaacagggccaagggaaaacttcctctgtgccccctgaatcctcgctgaaaaatccactgacaaatagcagattaatagaaaaggcatacagatttgttaatgtgcacaaaagtcttacaaaatataagatctcaa

SEQ ID NO: 233042 - DNA, 313 bp, Homo sapiens
agactgttctttcccccattgaataggcttggcacccttgttgaaaatcaaatgatcatagatgcgagagtttatttctgggctctccattctattccattggtctatgtgtctaccttaacgagtactgcacttttatgattactgcagcttcatagtaagttttttaattttgggggaacagggtcttgctctgtcacccaggctggcgtgcagtggcatgactatgactcactgcagcctcctcctcctgaggcaggagatggtgtaaccagagcggagcttgcaatgagcagacatcatgccactgcac

SEQ ID NO: 233043 - DNA, 445 bp, Homo sapiens
acacataggaattgtgggagctacaattcaagatgagatttgggtggggacacagccaaactgtatcactcctgttgttccacatccttgtctgtagtttattttgtctgactttttcagttttgtcattttggaggttgtgtcatatcttattgtggctttaatttgaacttcccttattagtaatgatgttgagccacttttaatatatttgctatctgttttgtcttctgtgaaggacctattaagtttctggcctttttttttttttaattgacttgtagctgttctttctatgtgtggattgcaatcctttatcattatgtgttgtgaatattttcttccagtttgtggtttgttttttttacctgtgaggtggaggttgcagtgagccaagattgcgccactgcacaccaacccaggcgacagtgtgagactctgtctc

SEQ ID NO: 233044 - DNA, 551 bp, Homo sapiens
ggaaaggaacctctgcagcttagaggcagcagtctatcacccttttgtcagagaacctttgtagaagagtcaatgttttttgccatttgaaaatctctgtttctgcaagatgccatgctaggcactgtacacaattaaaatgagttcccatctccaaggaatttgcaaccatagacagcacagtgaagacaggtgttaacttgaaggctgtacacaaacagtgaattctcaagtctcctccccttccctcccctaggcgctgtgcacaattaaaatagcagagttcccatctccaaggaatttgcaaccatagacagcacagtgaagacaggtgttaacttgaaggcagcgcacaaacgggaggcaattgaagttgtcacctactgtacaacacagtggcccttgtatgaagatccaagacacatatggaaattaaagatttaattatcactcctttggaggatttgttggccatcagcaacttgggcttaacttgggtccaattttataattttagtaaattataataatatttatgatatctataacta

SEQ ID NO: 233045 - DNA, 501 bp, Homo sapiens
cagttacacaaaaagaatttgtatattttcaacttctagcagtttgtaattactcagctcctgaaattaaagaaatttaatcagttttagtcatcttgtcttggttgccatggtttggaaggaaataccaaatagatttgaatcagtagactagaaggctgctgtttaaacacatgaaataattttttaaaaagctttctgggttgggcgcagtagctcatgcctgtaatcccagcacttggggaggccgaggcgggtggatcacttgaagtcaggagtttgagaccagcctggccaacatggtgaaaccctgtctccactaaaaataaaaaaaattagctgggcgtggtggtgcacccttgtatttccagctactttgggaggctgaggcaggagaattgcttgaactcaggaggcactctcatgaggcggaggttgcagtgagctgaaattgcgccactgcactccagcctgggcgacagagtgaaactccatctcaga

SEQ ID NO: 233046 - DNA, 486 bp, Homo sapiens
tggacaggacattccaggcaggcacttggtctagaggtgggctgatcatttctaaatggcagaaccctgacaaacgtgagactgagagtccacagaggggcacgtggggctgagctgagaggcccccagggccagcatcctggcccatgccttatggaaggccagactagaagccctgggccagccccaggaaataggaagtttccaggccgtggacctcctgtgcccctcagggtgggggccatggaagagctcctctttgttgcagggaggggaagtctgtaccccaaaaaggtcttcccataatcctggagctgggagtgtgctcgatgcaccaatggcaaatggtgtgcagcaaacgcgctccgttcctggcactcttaccactgtcaagagagggaccccagaactcaggaggcagccaccagcaatcagcaggagctggcaggggaggcagacgggcctccgtctctctcccatttctta

SEQ ID NO: 233047 - DNA, 518 bp, Homo sapiens
ggataatggacctcagctttagtccttggtggcctcttggcatggaagctggaactttctcaattctgatataaaacccttgagcaagagagaaactcatgtgtgatggggtagggagtggggaccctctggtagctgtgggcaagcatgcccaaggacttggaagacagaagcctgtggaaccccatctcctctttgccttctttctcctggcctttcattaagggctggtaattttgaagtcggcaggggcctgagagaaggtgagctaatgcaaggcccagggtcacacagccagggaatggcaggcggagggggccagaaccaggccttctcactctgccagtgcccattctgctggcccaccctccacagcttggctctccctggcctgccctcagttagacttcggactgaggcctccagtggggtgtggggtattgctggaagcagggcctgaataaagtctggggctagcgggagggcatctgtcctcccggaggctcccaggactgtga

SEQ ID NO: 233048 - DNA, 1481 bp, Homo sapiens
aagaaaaagagagagaaaaaaagaaagaaaaaggaaaagaaaagaaagaaaaagaaagaaagaaagaaagaaagaaagaaagaaagaaagaaagaaagaaagaaagaaaggtaggcaggcattggtggtattttgataggaactctactgaatctgtagattgttttgggcagtatggtcattttcacaatattgattcttttaattcatgaacataggaggttttctatttgtttgtatcatctatggtttctttcatcagtgttttgcagttctatgtgtagagatctttcacctctttggttaagtatattcctagggttttttctaaaattgttatggtttcaggtcttacatttgacccttttcctgttttcaaaaaaaggtgtggcttgctgccagcgctcatttaattttacataaacacgttctttgaggctgaagcaaatctgactgatagtcaatgtgaaaataaaatataaaaactgttcttggagttatttctgaacagaactaacattagaattgtctgaatcatcagaataatctatttcagaaaaactgaattcatgaaactaatccttggccaacaacttttcatgaacaatgttagcatcatgtgtaggaatgctgttttctaagatttgacattttcagtggctgagattttattttgtaagtggaaataccgctactaaaaatggagtgctataaataggataatgtcttttgtttccaaagttgatatactagagcaatgcaaacataataatcatagggtgctattttgtggcaaatttactttggggtaaatgatgcagccgcaagtgccactggcgagtattctcagagcaaatggggaaagggttaagtctttaatccatcttgagtaaatttttgtagacggtgagagatagggaaccagtttcattcttctgtgtatggctatccaattttccagcaccactgaatgaatagtgtgtcctttcccccattgtatgtttcagtctgctttgtcaaagatcagttggttgtagttatttggctttatatctgggttctctattctgtttcattggtatatgtgtctatttttataccagttgtcatactgtgttgattactgtagccttgcagtataacttaaagatagctaatgtgatgcccccagatttcttttgtttgctcaggactgcttttgctattcaggatttttggttttatttgaatttaggattttcttttctaattctgagaaaaatggtgtttttggcaggatatgatggcacacacctgtagttccagctgcttgggaggctaaggcaggaggctgaggctgaagtaagccaagattgcacaactgcactccagactgggtgacagagtaagatggaaaggaaagggaaagggaaagggaaatggaaggaagaagagatagagaaagagagagagagagagagagagaaatagagaaagaaaaa

SEQ ID NO: 233049 - DNA, 320 bp, Homo sapiens
gtctgcggatggcacagcccggcgaccccgtcccggcctcttccccggcggtgcacgcccagggccaggcaggcgagaggcgcgggagtcgcgtcccagcagggagcccaggctgcgacgagtcctcaggggacgccttcaacccaggctggaagagatgatactaacgtcagacggggagtctcgggtgtcaccggacgccagaatgagcggcgaggtccgcattgtttggaggggatcacgcggaatccgcgctactccgcgggacgctgggtccgacggctagcgccgcgcacactggaggcctggaaaagccgagc

SEQ ID NO: 233050 - DNA, 433 bp, Homo sapiens
aaggaaagttaggattttcctttcaatttacttctaggaagtcggcatggaaagccttaggttccctgcctccagaccctattctcctgcctcagcagcactgccgtgcctctcgccaccctccaagacacgccccgtcctgtccccttccgcggccattgccctgctggccacaccggatccctccccatggccttattcctcccctgccccccagtagagccgtgtcccctcacacaccctgagacacacccctcgttcgcgtcctccccggagagcacagccacgatcccccaacactaagacaccacctatccactgcagttcaaggactgcttgaatcaatcctcccacctcagaatcaggcagaggttgctgtaagccaccatcatgccactacagcctgggcagcacagcaagaccccatctcaaa

SEQ ID NO: 233051 - DNA, 382 bp, Homo sapiens
atacatatctattaagtatcttctaaggcctgccactgttgcaaagctcttttggaaacttaaaatctgatccctgccccaaggaggaaagatggcatatacacaaataacctccatgggaaacagtatttggaaatgttgtaagagtgacataaagaagaaggatttgctctccagatgcagctgtgccttcctttgaaatatctttcgtatctgttctttccttcccatccttgctgctacctctctagttgcgggtcttaccacctaaaggaaggcatggtcagagagataggcaaactaagaggttgcgtatcaagaaagggagagagttgattagcattatcaagtgctacagaggcagcaatgaatgccaggttca

SEQ ID NO: 233052 - DNA, 364 bp, Homo sapiens
ggtggggtatgtgaaggttctaaggtggaaggccaatgactgcaaggaagtcattgttgctgaagagaagggataggtaatggtgtaaaagaaagttctggagtcccaaagatctgagttcaaatgatggctctgctgtgtcaccgtgtgcaagttatttaaactttataaccctcaaattcctcatttgtgaattaacagtattcctgtggcctaggactggtcatggaaaaaccttcgacacattaaattacacagagtttaactgagcaaagaacgatttacaaaccgggcaacccctgaaccagaataggttcagagagactctgtcgcagctgcattgtggaagtagatttgtggacag

SEQ ID NO: 233053 - DNA, 202 bp, Homo sapiens
tagcctgtgcctgcagcccggagtcccctcctgccctggaaggcaaggagccaggccacggggccacagccgcgggggccaccacactggcccaaatatttcctgcaggtatgaccattcactgggtattggggttgggtcccttggacccacaaactgaacctcgtgggtacagggaaaaattaaaatatattcctcctta

SEQ ID NO: 233054 - DNA, 1439 bp, Homo sapiens
gctctgtgtccccacccaaatctcatctccagttgtaattttgacatatagagggagggacccagtttcaaatcaaatggcaggaaaagcttataacaaaaactgtagttttctctcccatcccttctaatcccctgcccagaggcaaccacttgagctatttttttccttcatattttcaaatatgctcttatggctatttcttatcaattttaaacactgcccattaacttcattttaaggtagatgaagatttagttatcttatgttcaccctttctccataccctccactcccaccatcactgccacatcatctgtcctcttccccattctcccagtattgtaatatagtttgatcagaactcttggttaagtcactagtgtttacattactatggctgtgtcactatttctctctgctgacccaagcatgacactgattaggtttcctttctcatataactcttgtccttggattcagtggccctcatttttttcttttgctttgttttctgttactgttcatcacatattttatacagctgtcgatgttatttattcaaacgatgtaccagttccatttgtttgttgtttctggagacctccctctggagctttccaccttcctggctctaatctggactggttgctttaggcctgtggtctaaacagctgttatttcaggacttccttgactgttctcctttgtttgccctttttttctgatctcatgggtttttgtgtgtgtactttttttatcttgcttacaccctcattttgctggtacttatctttcagtggcttttctaagaaagattatgtaggaagtagatttttttgactgcttgtatatttgatttgtttttccaaatgtgagaccatcccccatagttcttttatatttaaaaatatctttattccaccctaattttgattagtaacctagctgggatataatttgagtttaaaattatttttcttcataatttatagacattgctttttttcttttaaggttccatgtcattctcattccttctagtgactttttgtttgtttgtttaatttgtgtgcttagcacttggatcttaaaccctcctggactgatctcctaaatgtcctcttttttcttatttttcatcttcttgcctttaatttttttcccaattattgaggtattaatgcttagaaagtaaatgaaaatactgtcctctcaccattccacctttggttattctgaagaactgggacagccctcttcttttatttaatttatttatttgtatttttgagacagggtctcactctatagcctaggctagagtgcagtagtgcaatcaccactcactgcagcctcaacctcctaggctcaagagatcatcccacctcggcctctcacgtagctgggactacaggcacgcaccactacacccagct

SEQ ID NO: 233055 - DNA, 1445 bp, Homo sapiens
gctctgtgtccccacccaaatctcatctccagttgtaattttgacatatagagggagggacccagtttcaaatcaaatggcaggaaaagcttataacaaaaactgtagttttctctcccatcccttctaatcccctgcccagaggcaaccacttgagctatttttttccttcatattttcaaatatgctcttatggctatttcttatcaattttaaacactgcccattaacttcattttaaggtagatgaagatttagttatcttatgttcaccctttctccataccctccactcccaccatcactgccacatcatctgtcctcttccccattctcccagtattgtaatatagtttgatcagaactcttggttaagtcactagtgtttacattactatggctgtgtcactatttctctctgctgacccaagcatgacactgattaggtttcctttctcatataactcttgtccttggattcagtggccctcatttttttcttttgctttgttttctgttactgttcatcacatattttatacagctgtcgatgttatttattcaaacgatgtaccagttccatttgtttgttgtttctggagacctccctctggagctttccaccttcctggctctaatctggactggttgctttaggcctgtggtctaaacagctgttatttcaggacttccttgactgttctcctttgtttgccctttttttctgatctcatgggtttttgtgtgtgtactttttttatcttgcttacaccctcattttgctggtacttatctttcagtggcttttctaagaaagattatgtaggaagtagatttttttgactgcttgtatatttgatttgtttttccaaatgtgagaccatcccccatagttcttttatatttaaaaatatctttattccaccctaattttgattagtaacctagctgggattacatcatgcctggacctaggcttctattttttatataaatgtggtcattctgtcttgatgactttctcatgtacgtaataacttaaaaatagatattgtataatagtctggatacagcagaatttacataataattctcctgttttggacatttagattgtttccacgtggtaaatagaactctggctgaacttgtgtcacgtattctggtgcacctgtgatgggactatatgagatagatttggaagtgaaaaatcagggtgaagatggtcatatattagatttgaaaacttatgctgtatcatcttcacaaaacgtcagttacatgtgccccaacagtgtgtgaaataccttcctattcacagggttatccggctttaacttcgccactatgcaaccattcattgttcatttccggtcacgagggcatcccggtgattggtattccaccttgctgcggtcttacaaggcacgcaagccttccgggac

SEQ ID NO: 233056 - DNA, 426 bp, Homo sapiens
cagtgagcatgattaggtcatgcaggattgtgggtgccaagtttgggggtgctcaaactctaccagagacattggggagccatggcaggttctaggcagagggaggacagggtcaggtttggctttagaaagatcccttggcctcggctgggcacggtggctcacgcctgtaatcccagcactttgggaggccgaggagggcggatcacgaggtcaggagttcgagaccatcctggctaacacagtgaaaccccatctctactaaaaatacaaaaaattagccaggtgtggtggcgggcgcctgtagtcccagctacttgggaggctgaggcgggagaatggcatgaacccaggaggcggagcttgcagtgagctgagatctgccactgcactccagcctgggtgacagatcgagactccgtctta

SEQ ID NO: 233057 - DNA, 631 bp, Homo sapiens
aaagactgactgtttcagactaaagtgctatggggccctaaataaccttgaaaggcagtctaggccacaaggactgccactgcagttgagtcctggtgctgaattggacccagaaacagtggatttgcaggtggcgcagatgacctactgagaaaacagccatggtagctaaaaaagtgctggcatcactccttccataactccaggctaaaaagcttatggctttcttgcattttgggtaccaggtcagccatggcaaaacagggcaccatgggtcagaatcatcaggcctcctttccaggccctagctcctgggtgaaatttctagacactccctgataaaaaagggaactgacacccacgaagggaaggatgcagtcctggcagaattaaatgtctgttaactaaagagccctttgacctgaataagaaatagcaatatccaggtactacatcaagagtcttgggtgagactttgagacttgcttttttctggtgaaactcagaacattctaagctgtggtggccatggagccaagactctgttccccttgataaaagtggaagaaaaattaaagggaattttgtcttgtacctgaggtgccagttcagcaacaaaaggaaaaagtac

SEQ ID NO: 233058 - DNA, 514 bp, Homo sapiens
atacggtccagggtcacctacagctctccccatccttccactcagcttatcctggaagccccaagagacgcagctctgctgatgcagctagacacagctccgaagacaccacaggaagctttggaagcacaatacactttgtgaagaaatttgaaaacttcagtgctacttagcaagtttcttggcattagcagttatccagggactcccagcgggtatctacccagctggagaaagaaatattccaacaggaaggaagaaactctccaatctcactgcaggcctggatatttggaaagatctcatcaccagacagggtgaaggacactggactttgacttttggactcacatagccaatggcttgcttggcgtcttcacaaagatatctaacaagcatctcaaccctaacagaactctcggttccttccctctcatccccaacatacgcccccactaatgttccccatttcaataaaataaatggttttggcttaagccaaaagcctagactc

SEQ ID NO: 233059 - DNA, 684 bp, Homo sapiens
taactcgtactttccctagagctcttgcgagaaagaactattgagaaagtagcccatctgaaagtatatttcttgctgtttatctgcttccagaactggctgaagtttactttttggttctccagagacctagcttcttccaatgtggtctatttaatctcctgtcatgtgggaaattatattcaaaatctccatgatcctctgtccatagtaagttatgcatgtagtgagaagtacatgccacaaggtcttgagattatatctgcaatgtgttgctgctggctgttgatcaagataggctgggagaaaaacattattttcaggtgtgaaaatctgtcacctttatcaaataactcttcttgcatatttcccaagacgttgtagcctatttaaactcgggaggttaattttgtagcattcattatgaccgaaaatgagttcacacaatcatgatgctctctttattaggtgttactgttaaacaatattaaaatacacacaatgtggctggtcttttgtaagctacatggcatgtttacttctttgtcaggtttcttaattgcatttcttcatctttccgaataccagtgtcactgtcacccacaatatttgctgttttgagcacatggtttacattttattttgcccaataatagaatatgatggggacatcttatctgagtg

SEQ ID NO: 233060 - DNA, 330 bp, Homo sapiens
caaaaaaaacaaaaacaaaaacaaaaaagatatatatatgaatgtaaattctggtaattggttacaggaaattggaagtcaccaaagccaagccttcccaagacatcttgacctctgcctgtcagccatccagcagcgatgggtctttgctccctacagaactctgtggattctatttcttccataagaaataaaatgctatatgctgaataagtaaaatagggtgaagtagacacaatgacaatgtgtctatggaggagtaattggaaagaagctatccacactagcttttttggaaaagcctcaaaaaatctgtgaaattccaccctc

SEQ ID NO: 233061 - DNA, 563 bp, Homo sapiens
atattttggcagagggaatggtagaggtaacgttcctagtaggtattgggattaaattatttaaaacacagttcttgtaagtagatacttccgtatcaataaaaccagtgctgtaataggggcatgtacaggttactattggaacacaaaaaagggccacttagtaccaaatgtagggggagctacttcaaaagatggcacttgagcagtactatggtgagcagggactggtcaaggaatgattctgaggagggaagaaaatggttcagatcagaggaggcagcacatgcaaagtggtgccatcaataattcagaaacccataatcaatctggctaaatggaaccaggtcccagaaaaggttagaaaagataggattgaaattaaagttggcaagattttatactaattgttcaaagttcacagataatattgctattaacaattttatgtccttagctccagctcaaacttttaaaaatttgctgcagagcacattggtgtaactcaagattttaagaacttgcctatcctttaataaataccctgcaaatttaaaaagtgc

SEQ ID NO: 233062 - DNA, 534 bp, Homo sapiens
ttagtctccatgacattacggatctactccagatattttacataccttaaagatgaggagctagaaaacctccaaggccctttctgactccaaaaccttataaaagtatggaggtagaatttatgaatttgtctaaatcttaaatttatttaaacatctataccaatgaggtagtgagcttactgtgatataaagatattactcttataaattctaagggatattgtttggttttggtattataaaatctggtaaataaatttacacaagcataccttgtttaactgtgctttcctttactgcgctttgcaaatactgcattttttacaaattgaatgtttgtggtaactgtgtctgccagtctgtcagcaccatttttccaacaaaatgtgttctctgtgtcacagtttggtaattatcatatttcaaacttcattattatctgttatagtaatatgtggtaatttttgatgttactgttgtaattgctttggggtaccatgaaccaagcccacataaaatgtcaaacttaaa

SEQ ID NO: 233063 - DNA, 536 bp, Homo sapiens
attaatatatttgcttatgcagcatatttagggatgatgggtaaaattcagtctagctgtccacagggtttgtttatgagaatgccaaaaaataaaacttgaaaggtatcctgagtaaaatttgtagaaagctaatcctatgttaacatttaaaatgggatttcatttcttatgcctctactctcaaaagtcaaagaagacttgaatgaaactatggtctagggtaacatctgtagaagtgtcttaactttataatgatcaagaatttaaagctcttccaaaataaagtacttcaactagtgagagcttctatttattgtattaaaacatgtatacacggagaatactgacattttctttttaggtgaagcagtactcagtgactttttttaatgctgttgaaagtgctctgggaatactctggcagaagggtttcaggaatggacaaaaaggaaaacatttagaaaaatttcagactgaaatcttacttgtagaagggtatcactgtcctggcaatcaaatagctttgtattctt

SEQ ID NO: 233064 - DNA, 301 bp, Homo sapiens
gatcacaagggaagttactgcacagccaagtatgctgcatttgcaaaggtcaggctttaattacatgcacagttaaatggaaatactgtagagaggtcacactcatatttctttggctttcattaatgttattgctctgtcactttccctctccttaggtttgtaaatgaaagttcctttagtacatttaaaagcattatttatttttaattgtcttacctctggagggagaggttacttctttttggggtgtttttggttgttgttgttttttttttgttttctttttttgaatagactt

SEQ ID NO: 233065 - DNA, 313 bp, Homo sapiens
gatagattaatgaattttagtgtaatattatgaaagttcaccgacgtagtttcagatcccacactgcaattaactcgtaagaaattaccaatcgttgaattttggtgcagtgtcaacgatgaatatttgcaattatttgaaaagactattaaaataccttttcctgtctcccattgcatatttgtgtaaggctggattttcttcacataattccatgaaaacaacacattgcaacagattgaatacagatgcaaatagaatctggttttcttttagtaagttgaacattaaaaatatttacgaacatgtaaag

SEQ ID NO: 233066 - DNA, 298 bp, Homo sapiens
tttaaaatccaaaactggaacaaaatgaaagccgtccgtgaatcttggctgagtttgggccgtaattcattcaagtagctcattacgcatcggaattacccaactgccgaagcttctgaacagcaggcaattctagagcttcactttcaactttctgctcttattgatttatgaaaccttactaccttcaaaatcatgaaatattccaggcatgcaaagaggcacagagaatattttaatgaatatcgtgcacccaccacccaaccgaggaaataaagcctgacagttacaatcgaaa

SEQ ID NO: 233067 - DNA, 441 bp, Homo sapiens
gaggatagcgtctagtttttcactattaaaatatgttagctataggttttttccgtttcatgtttttatcagattgaagatcccttttattcctattttgccaagagtgtcatgaatgcatgttgaatttcaccaagtactttttcctgcatctgttgagagaatcttgacttttctcttttattttgttaatgtagattctttaatgttaaactgatcttgcattcctgatataaaccatacttagtcatgatatgttatcccctttatataatgctggattcggtttgcaaatattttgtttgatttttgcatctatgctcatgagacagattggtctgtgattttcctttcttgtaagtcttgtcaggtgtcagggcttggttaattttgacacatttacaaacatatatttttaagataaaaataaacttcaaaaaa

SEQ ID NO: 233068 - DNA, 173 bp, Homo sapiens
tgttctagagggttctttgccccaaacttttcaaacttcctctttactttcgtctcaatttagcaaccaaaggcttccatgtcttcccattaacacatgcgtgcccatgtattcttgtttcttacacaggaaaacggcaggttcctaacaaaaggtcaacattttcacctgtg

SEQ ID NO: 233069 - DNA, 145 bp, Homo sapiens
caaacacttcttgttctgatacgttcaaacatcttggtgtttaggttggggaagctgagttgttgtttatgagttatctccagtgctcagatatccggcagctttttcctaggaagtcagctttgcacatgagagaaaggaaaaa

SEQ ID NO: 233070 - DNA, 811 bp, Homo sapiens
gcaagactccgtctcaaaaaaagaaaaaaaagagaaagaaatgaacaggacttggaatactaggaaaactctgtaccaacaaattaggtgaaactgacaaactcctagagggacacaaatcacttaaattggctcagaaatctgagaaatttaatagaaaatctaaatagacctataacaagaaattatagtaatgaaaagtcctgagtcttcctacagaaagcctgtgcccacgtggctgccactgtatactgtcaataacaccaaccattcacaatcttcagaatgtggaggatgagacacgcccatctgagtctaagaggctaaaggcagcgaaaggcatcataatccgtgcccccaccccacagaacaatgtccatcatgaatacagacataaagatccttaacaaaatattagcaacccaaactcggcaacatcatacaccaagaccacgtgggtgtatcacagcaaagtgaggttgcttaaacatctacgaagcacttaacgtcataagccacattaatagaaaaacagatgcctgtaatcccagcactttgggaggctgaggtgggcggattgcttgagcccaggagttcaagactagcctgggcaatatagcgaaaccctgtctctaccaaaataaacaaccaaaaaaaccaaaaattagccaggcatggatgggagtgcatgcttatggtcttagctactcacaaggctgaaaccagaggatcatttgcgcccaggaggtgcaagtccagtgagctgagatcgtgccactgcactctagcctgggaaacagccagagcctgt

SEQ ID NO: 233071 - DNA, 757 bp, Homo sapiens
gcaagactccgtctcaaaaaaagaaaaaaaagagaaagaaatgaacaggacttggaatactaggaaaactctgtaccaacaaattaggtgaaactgacaaactcctagagggacacaaatcacttaaattggctcagaaatctgagaaatttaatagaaaatctaaatagacctataacaagaaattatagtaatgaatgtcaataacaccaaccattcacaatcttcagaatgtggaggatgagacacgcccatctgagtctaagaggctaaaggcagcgaaaggcatcataatccgtgcccccaccccacagaacaatgtccatcatgaatacagacataaagatccttaacaaaatattagcaacccaaactcggcaacatcatacaccaagaccacgtgggtgtatcacagcaaagtgaggttgcttaaacatctacgaagcacttaacgtcataagccacattaatagaaaaacagatgcctgtaatcccagcactttgggaggctgaggtgggcggattgcttgagcccaggagttcaagactagcctgggcaatatagcgaaaccctgtctctaccaaaataaacaaccaaaaaaaccaaaaattagccaggcatggatgggagtgcatgcttatggtcttagctactcacaaggctgaaaccagaggatcatttgcgcccaggaggtgcaagtccagtgagctgagatcgtgccactgcactctagcctgggaaacagccagagcctgt

SEQ ID NO: 233072 - DNA, 510 bp, Homo sapiens
ctataactgttcaaacatagttgattgagaatccatcttttcctcactgatttgaaatgccactttgtcacatactggattctcatatgtatttgtgcttattttctgaatgttctatgctgatccattgacctggctgattaggcataagtaccacacagttttaattattgtggctttaatatctggtggtggctcattttttttttctgaatttttctagcattattacttattctttcaaatgaactttaaaatcaccttgtctaaaaagtaaatatttttcataggattgcattaatttttctagtgatctggtgggaaattggcatcttcatgacattaagtctgcatatccaagaagcaagcaaactctgttctgggtagctttgtttttatgattttactatggctggaagcagctagaaagtgttgtgtctcaaatctaaaaacccacatctggtgaagttctaagtttgtttaaaataccagatatttcatagtcaaata

SEQ ID NO: 233073 - DNA, 155 bp, Homo sapiens
agaaaagtatgtcaaggataacataatttagcacgtaaccatctcttatcttgtactttggtgttgcttcatactcttcaagtagatgaaagctcctggtaggaactgagcgcagcattagtgcctaataaacatgtattggtttatttattttt

SEQ ID NO: 233074 - DNA, 501 bp, Homo sapiens
catttctaggtgcagacgaggcatttggggcatagaagatcacactcttcttccgccatgtcttaagatattactttatagtaatttatcttagtccaggtgcagtgcctcacacctgtaatcccagcactttggaaggctgagctgggaggattgcttgaggctggcagttcaagacttcttccattttaaggggccttgtgattacagctggtccatctggatattctaagatattctccctattttaaggagagaaatctgaaatctgaggtgcagttgatttgaatccaggaaatctaaggaaaaagttcaagctcttaatcatttcatacccttcttgttgctaacttaaactttttttttaaaaaagttaatcttgtctatgaagcatgaatctataatactagggaaaaaactggctaacttgaagaaaaaataaattgaaatgaaaagcaattaattcctcttaatatgaataaaggatgatctaaatgcttt

SEQ ID NO: 233075 - DNA, 615 bp, Homo sapiens
catttctaggtgcagacgaggcatttggggcatagaagatcacactcttcttccgccatgtcttaagatattactttatagtaatttatcttagtccaggtgcagtgcctcacacctgtaatcccagcactttggaaggctgagctgggaggattgcttgaggctggcagttcaagacttcttccattttaaggggccttgtgattacagctggtccatctggatattctaagatattctccctattttaaggaagatgaataagaagagggagcctcttccaggaagataaatgccgaaaaagctaccttttctccatctggggacggatgataccaaaatgatgcccccttccaggctgataaggagagaaatctgaaatctgaggtgcagttgatttgaatccaggaaatctaaggaaaaagttcaagctcttaatcatttcatacccttcttgttgctaacttaaactttttttttaaaaaagttaatcttgtctatgaagcatgaatctataatactagggaaaaaactggctaacttgaagaaaaaataaattgaaatgaaaagcaattaattcctcttaatatgaataaaggatgatctaaatgcttt

SEQ ID NO: 233076 - DNA, 383 bp, Homo sapiens
cagtgtgtccgtgggattctgcttctttgttcattgctctccgcctcgctcagtggcagactcccgtaagtggccagaggttccccgtgttcccgcgatgtcctgcaggctgacccccattccctagctgccacgcagactgttccagccggagggaggatgagacccagcaaggtgatgaacctgcaggaagaagacacaacagctgtgccttccctcatctcaggacaccgaaacaagacgccgagaaaacgggcctgtgaaaagcaaaccgctgcatacttacgtagaaaaacctttaacaattttaaggatggagaatgatgctgtaagaataaaactaatgaaaaaagagaaaaaatataaaggaaaatattaatgga

SEQ ID NO: 233077 - DNA, 1432 bp, Homo sapiens
ttggaaatccttccagagactttcgcactttctataagtacactctacaaggggaagtggggcactaatggactgggagggcaggtcaggagtagcccaaggtatgcatgtgcaagaggaaaacttgataaactcaagtttatcaagaaattgttgatttcttgttcaactgttgatttgaaccaggcttctggttcaaagggccaggccatagctacagctgctctggtgggccaaaccaaaagcatcactgagtttgggcacttgaagtttcagacagctgggagtctccatagaaccggaagggaaaacacttccaaggatatgagcatgtcttgtccctgcctttgggccacccatgcacaccagctccacagcagctgaagcagagcagatccagaggaggctgtcggagggaccactgtccttcctgctgaattcatactgaccctctggattctccagattttctccaaagttcttccattctagcctggccaaacatttgggctcagcaaactgagacaagctccccacccatggcgacacttcctatgtccatagtgtgaatgtagtaatgggatatatgtcttggaacccccaagcatatgtcacgtgcaaaacaccgtgggaagcagtgggggtgtggtaaagagatgggctggaaaggctctttgtcctcaataagctggccatctgatggggagatagaggagtgaagcgagtccgaactaataggcatgtgtatttggaggcaacaaggaagagagaaccattctgactgggagctccctggaggaggtagcggacatttgactggggtttggcatattcaaaaaatgtggatgagcaaagaggacagagcagcagatattccaagcgagaaaacataacgagcatagcatcctcccatgtcctaccatttataagagaatgttaatgtgagaactgctcagtctcctgacagacccgggggctgcaggcacattttccctaggggtaggtctgttagcttttcaagatcatgaagtatttttaggtccaagttgtcaccagcattcaaagccaccgtgcatcctccagctgttcccagtgcataccgggctcttgcttgtcatagcttggatgtcccctggatcatcagatacagactgactcctgcacttgttttcccccgtaagcagatcacgtgtcagtgtgtaaaatgtatatcacgctggtcttcatgtaggtgttgcaagtttcgttcattttatacacatccattagcaccacacatgaatgccatcctcttcaagaagtaagcagatagggctgggcgcggtggctcatgcctgtaatcccagcacttcgggaggctgaggcgggcggatcatgaggtcaggagattgagaccattctggctaacacggtgaaaccccatctctactaa

SEQ ID NO: 233078 - DNA, 742 bp, Homo sapiens
aactcatgaaagacacggcacgtggccagaatctatccgaactaataggcatgtgtatttggaggcaacaaggaagagagaaccattctgactgggagctccctggaggaggtagcggacatttgactggggtttggcatattcaaaaaatgtggatgagcaaagaggacagagcagcagatattccaagcgagaaaacataacgagcatagcatcctcccatgtcctaccatttataagagaatgttaatgtgagaactgctcagtctcctgacagacccgggggctgcaggcacattttccctaggggtaggtctgttagcttttcaagatcatgaagtatttttaggtccaagttgtcaccagcattcaaagccaccgtgcatcctccagctgttcccagtgcataccgggctcttgcttgtcatagcttggatgtcccctggatcatcagatacagactgactcctgcacttgttttcccccgtaagcagatcacgtgtcagtgtgtaaaatgtatatcacgctggtcttcatgtaggtgttgcaagtttcgttcattttatacacatccattagcaccacacatgaatgccatcctcttcaagaagtaagcagatagggctgggcgcggtggctcatgcctgtaatcccagcacttcgggaggctgaggcgggcggatcatgaggtcaggagattgagaccattctggctaacacggtgaaaccccatctctactaa

SEQ ID NO: 233079 - DNA, 241 bp, Homo sapiens
tgaccttgttaaggtagccacagaaatgactgaagacttagaggtgggagtacacaagcttggaacaagattttgttcattcattcctacagccattcaaccagcatattctgggcacttctcatgcacactggccatccaccagggagacaggccatgcttagacataggcttattgcaaatcatgttttatcctttcttggctctaagactggacaagttctgcctttcagcttcacct

SEQ ID NO: 233080 - DNA, 616 bp, Homo sapiens
actgcaaagcagtctgcaatcagaagaaattacaattatggcaccgagcactaatcccagaaaatctaaacacagacaaccactaaatcccattataaaatataataatcattattagagctttttttttttctcccagaaaataaagagttggagacattatgccgttgcttaaccattttccatagcaggtcattattctttatgatgctactaaatatactcatcatcttacaaatcccaagttcaccttccaaatacatgatctcgtccttctgtgtaaagttaatgaaagttgtaaaagtgctttattccgtatctttatttttccccacagggacaggggaataaaaatgtgatgcattggaggagaatcacaggactcaacaaataaaccttgagatgtcattgtcacctgtgtgtactttatgagaatacacgtagagattaaccctttcctggaaaatgaacgtctattgcttcttttggggacagcatgctttatagttaggacattcttctttatatccagcctgacttcttcatgctgtactagccttccaatccttaactaaaaattttttaaaaatgaataaacactgggcaatgtgttcta

SEQ ID NO: 233081 - DNA, 531 bp, Homo sapiens
aaccacaacatttggagattaccaacatggttttcagccctcagctttggcgagacttcttccttttcattcttttctgggcaaatctaaacctttggagaagtagatgagtgaagtcaattgcaaagggactggatctctctctatcacccagactggagtgcagtggcacaatcgtggctcactgcagtcttgaactcctggcctcaagagatcttcctgcctcagcctcctgaatggttgcgactacagggacaggggaataaaaatgtgatgcattggaggagaatcacaggactcaacaaataaaccttgagatgtcattgtcacctgtgtgtactttatgagaatacacgtagagattaaccctttcctggaaaatgaacgtctattgcttcttttggggacagcatgctttatagttaggacattcttctttatatccagcctgacttcttcatgctgtactagccttccaatccttaactaaaaattttttaaaaatgaataaacactgggcaatgtgttcta

SEQ ID NO: 233082 - DNA, 452 bp, Homo sapiens
tagttgtgaagttagatgggataatatttttaaagcttacattgcatgaattgttttgcctacagaatgtccattgccatccagaggaatctcatgttggtagcaagaacttgcactgtctttgttgcagagcaacaggttattgggctgtgggttaatgtgaggctttctttggatgagtggggttggggggcagatcccctgacatacctcttggaaatttgaggggttgggagctttggagcagggctcctagaagcctgctaaacccagctgctcctattcagtaatttccatgtgctgttgttgattttggcttcaggcatggagagccctgccttgggagcttccttgaaactggatgccccaacccagagggtgtgggcaggagggaagcctcaatgaacactggagaagcagacttttttttctctctctaactctggcttttt

SEQ ID NO: 233083 - DNA, 853 bp, Homo sapiens
gtctcatctccgccctcaatcatggcctccgctgatgccaaagtaaacccattcagcttcaggaggcttttcagcaaacaaagcataatttgtacgacggatctgtgtgttacagtagaggatcacgggcatttgaaatgacacaactggaagctaaatccaacagcaggggagacccttaccaaggcgaggtatgacgctccacttggtctcactgcctcccgtctctgctccatccaatctatcttccagtccagaagtgaaggttttgtgccaaaatgcattcacccatccaaacattcaataaatatctactaagtacccactaaaggttaggtgtgcgtgaagccctggtggcaaagaaataaacagacccgacctcttccctcaaacagctagtgaacagtgcaaaccatggcatggtttgaaaaatgagcatgaggactgcccagggtccctttgggaaatgctgaacagagtgtgcatggcacattcaacagttccttggagcatggagtacccacgggcaagagtgggagagaaagcgaggaggcaggcaaaggccagggcaggaaggccccaaaaggccatgtggacctcaccacgtgatttctgtttagaaactttcaatggtgccccattccaaacccttaagtatggcctctgtgcgtcctggtgtagcccccaagctacatttctgatccattctcaactcctagtactgtgctacacccatctacacctcactcctcaaagactcgaagtaaactcatgctcttggcctgattcaaataattcccttaggccactctggaccccaaaccgtctcctccacatctcggcctgctgaaac

SEQ ID NO: 233084 - DNA, 418 bp, Homo sapiens
gcactccagcctgggcgacagacagaccaagactccatctcaaaaaaaaaataaataaataaataaaaataagtcaggcacagtggctcacgcatgcctgtaatcacagccctgtgggagggtgaggcatgaggatcgcttgaggccaggggtttgagactagcttgggcaacatagtgagaccctatctctacaaaaagtaaaatgaacaaataaatatagcaactacatatcagaacttggaggcacttattagctattagtcctgagtacttgtaaacactgaatagaagctagccaaatttttaattctaataatagctaatactgattactgaaggctatgtgcaaggcactgttccaagtgttgttttttttttttttgtattaactcattaaatcctcacaatcaccctgt

SEQ ID NO: 233085 - DNA, 2061 bp, Homo sapiens
ctcttcggctggagctgagaaaggagcgcttccccggactcggctcggctccgaggctctgaagccgacgccgccagctcagccccgggggcgggagcaggactgcccgcacagcccgcacctaggaggcgccgatcccgaacgcctcatgggacgcccccgggggctctctccacgccttgctgccgcgtcccggtcctaggcgcccgggatccacggcccaccccgcccgcagcccgcggcctgtctggagaggagtatgaggcccggggccccgcggacgccggccaccgggcggcaggggcctagctgcggagccccgcgcccgagagcggcgggtaaggagccgcgggagccggcgaggcgtcggggcgcgcagaggagcgcccctgcccgggcacccgctgggccacgggactcgcgtgtggcctgagcgccggggaggaggcggaggcgcccctctgtccgggctctgggaaggcgacgaggggctctgcgaaggcggcgaggggctccgcggcggccccggacccctggccaccatcctcacgctcctgctcccgccggggggatgtcgtggcccgggccccgagcgccgccccggccccggggctgagctccggaccatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaagaaatactat

SEQ ID NO: 233086 - DNA, 2498 bp, Homo sapiens
ctcttcggctggagctgagaaaggagcgcttccccggactcggctcggctccgaggctctgaagccgacgccgccagctcagccccgggggcgggagcaggactgcccgcacagcccgcacctaggaggcgccgatcccgaacgcctcatgggacgcccccgggggctctctccacgccttgctgccgcgtcccggtcctaggcgcccgggatccacggcccaccccgcccgcagcccgcggcctgtctggagaggagtatgaggcccggggccccgcggacgccggccaccgggcggcaggggcctagctgcggagccccgcgcccgagagcggcgggtaaggagccgcgggagccggcgaggcgtcggggcgcgcagaggagcgcccctgcccgggcacccgctgggccacgggactcgcgtgtggcctgagcgccggggaggaggcggaggcgcccctctgtccgggctctgggaaggcgacgaggggctctgcgaaggcggcgaggggctccgcggcggccccggacccctggccaccatcctcacgctcctgctcccgccggggggatgtcgtggcccgggccccgagcgccgccccggccccggggctgagctccggaccatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaaaaaaaaaaaaaaaaaaaaaaaaaaaaaaaaaaaaaaaaaataaaggaggggccgaatcgcacaaaagaccacattatggggggtcgcccaatactcatgttggccgtattacaacagcgagtctgggtgaaaaaaccggggctctaacctaattaacctcgtagcacatcatccttttttcaccaggtgtagtagcaaaaaagaggcctctaccaatcttccttaacagcaggtggccatccctgaatgcggatggctaattgggcgcgatattatgttggaagtgatgtcgtaaaatgttggattcaggtgatcttttagcacccagtggggcgatattcacaatctctattatatatagaaatttcccccatatgcggttgattgttccaccaggtttccaacaggggtctcttttagaccacggtgtcccccactttaaggggttatttggggg

SEQ ID NO: 233087 - DNA, 655 bp, Homo sapiens
gatgaagggccatgtctcctccatcagtttaggggctgccaagatcaggaaacctattaagtgccaccaagggagataaatgactaagtgctgttcttcctccacctgagtggtgccactcgagataggagccgcgcaagcacctgcatgcccccgcccccacaccccccaccctcgcccagtgaggaccacctgcgcggccaggaccgcgctgaccctgccctgtctccacaggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccg

SEQ ID NO: 233088 - DNA, 320 bp, Homo sapiens
catcattagtgccattgaaggtacgacagtgttaagtcaccttactctttttttactcctccctccatcttgcagcttatacatgacaataagtgttcattatttaataatgtttaaatatgcaataccatttctatgttgaggtgtgtactttccagagcatattgaaatgcagtgatgtgtaacaaaacttaccttctgtgattattaatacataaacatatctgaagaccatagtaaataattattataatctaaggtgtggccaacatatttgagaaaacaggaatttaataagatattctcttcagttccatgga

SEQ ID NO: 233089 - DNA, 538 bp, Homo sapiens
  misc_feature (297)..(297): n is a, c, g, or t
  misc_feature (497)..(498): n is a, c, g, or t
actgtactcgtttctgcaagcatagcattgtaggtaatggctttataagtgtctgttgtggcctcatggtacaatcgaatgacatagccttttgtaataaagtgaagcagcactggggtgatcaccgtaaagcttcccatgatgccatagaatatgatttgaataggcagaggcacactttcagaaatagcattattttgtgtaaaaatgtatggcagaaatgtaaggccaatcagactcgtagaataagagaaacatttcacaccacaacactcgctcggcgccatattgccacgntataaatagcccttccattcttctcgatcttgtcagatggcgtgatcttacagacatcgaactatatccctttcccaaataaaccaggcgatcctgcgctcgtatcccgcgacgcccggatgaagggcgctgcggcttccgcgaaggccccccgctactcacagtccggcctcaccgcgcccccgaagtggccccgctgnnctggaggaaaaagctacgggcagaccagcagggcccaggg

SEQ ID NO: 233090 - DNA, 490 bp, Homo sapiens
gagatgcagacatggaaacgtgcccttccggtccgggtgttcttggacaagtgacttactgtttctggaatttcagcttcccgatgggtaaaatgagaagaataacggacttctctccgaaggtttgtgtgaggatgtgactcagtgagccacatggtacagcactcagcctgggacacccgcagaactgagatgagaaggagccaggatttaaagtcaatttaattgtcacttctctggggtctaccatgcctcccactaaagcactctcttttgctattagccacaagcacgacatgcggtttcccaacactgctgggtgcacacctctcctcctgacccctctccccacttccccggcaaggacacacaggcggctgtggactgggggggctcatgtatccatccatttcatgtggatgccattggggggctgcactgggctgggttattttttaactcctgttattagtcactgcccgtcatgaga

SEQ ID NO: 233091 - DNA, 564 bp, Homo sapiens
tttttagacacccaaaatgtgttggctcatgagcatttagcctaaaggagaaaataataatttcactaattatctataaatatgtgatggcttattttatgaaaagctcattctgagtttgcaagacactaaccaaagaccacagtgagaaagtacagaaagtaccttaggtgaacacacaaagagcccgccctagtaaaaccatctcatcatgggacatcagtgtcccagaaactatccagacagaagggaggaggtcaagtggagatcctacaagaggattccttcatttagtgagaagttgcacaagcttttgttctaagatctccaccactttatacttccataattttatataatcaacagtatctagagacatccagctgtgtagttaacaagtactatttgttaacttgtattactcagacctcagttgtcttcttatactgtccaagcaaattaagaaaagctgaggtatagttgaattatttgggtaatagtagctataaaaactcaagtagaaaagggggtagtcacaacttcaaatttgcaataaaaaaacaa

SEQ ID NO: 233092 - DNA, 673 bp, Homo sapiens
gcagtgagctaaaatcgtgccactgcactccagcctggcgacagagcaagactccatctcacaataataataataataataataatcatcatcatcatcagagaggttcgatattatgaccatggtcaacaggtaataagtggtagatcctggagacaaattcacattatttcagttatacactgcttctttacatactggagaggtagtaagaaggaagtaaagctacagttatcatgacattttctatggaattctctttggttaaccaaaatactcctattattctgggttttatgttggggagtaggcaataaagatttttaaaaagctgacaatgtagttgaagaaataaacaatctcagaaattaacagagaaccattcgaaattaagacatcaagaatgcaaaatgatactacaaattgaataaataatttccatggaaagtattgaataaatttattcattttaatgcagtatttattaactacctactatatactaggattacattaagcactgaggatctaaaattaattttaaaaaatagactgaggttagggactctgagggagacaacacaaacatttatgtataaaacaaaatgataagcactatgtttatataaaacgttacaggaacagctacaggagaaaatggggttagtcaaag

SEQ ID NO: 233093 - DNA, 310 bp, Homo sapiens
gattttgtattttattagaggtgaggcttcaccgtgttggccaggctggtctcgaactcctgacctcaggtgatccacccacctcagcctcccaaagtgctgggttacagtcatgaggcactgtgcctgccctacttttttataataaaaaattataaataacatattttagagccaggagtggtagctcatgggtataatcccagcaactcaggacaatgagttgggagtatcatctgagaccagttctagaccagcctgggcaacttagttagactccatctgtaaaaaaaaaaaaaaaaaaaattaa

SEQ ID NO: 233094 - DNA, 477 bp, Homo sapiens
tatcatctctatataatgtgatcttttgaatctacattaaaaagacaaacacatctgtagagaaaaatgagaaaagaacatgagttgggtatttcattagagagaaaatccagtgggcagtaagcatatgagcaaatgttttacctcattaataatcaaataaataggctgggcatggtgagtcacacctgaaatccacgcactttgggaggctggtctcgaactcctgacctcaggtgatccacccacctcagcctcccaaagtgctgggttacagtcatgaggcactgtgcctgccctacttttttataataaaaaattataaataacatattttagagccaggagtggtagctcatgggtataatcccagcaactcaggacaatgagttgggagtatcatctgagaccagttctagaccagcctgggcaacttagttagactccatctgtaaaaaaaaaaaaaaaaaaaattaa

SEQ ID NO: 233095 - DNA, 476 bp, Homo sapiens
ctagatgtggtggttcatgcttgttatcccaacactttgggaggccaagacactgcctctacaaaaaatttaaaaaatgaaagtttcaaaacagtatatccattagttaacattctttagtgtccaactatcaattgttagtgtacatacacctctcattatacattaagcatgattcttatttattgaaatattcaatacatataagaactatatcttatatgctaaatttctgaaaaattattttagatatttttaaatttgtacattccagttacttttttcttgtttgtttaaagagaaaacagaacagggctacatagcagacttactttgcgataactttgacatagtaaatcttctgatacttagtcttatatttttcctctttaaacatatcttaaatttatccttactgaatttcactttatgctgacttgggtacctgaaggtatgaagataggaagaagaagata

SEQ ID NO: 233096 - DNA, 953 bp, Homo sapiens
ggcaagaataattcaggggaggcacagcaaagcacacaggctttgccaatgggccccaggggggagaagcatggaagcaggagaaaatgtaattttaaaaggactatatcccaagtgcatgaaacccaaacagcattgcagtagacaagccacagggcagggaagtacaggccgtttgtaatctatgagctattaataagtcatccccaggagacacagaacaccaaatggggaaccatagttggcccccagggctgcctgtctccatggcccatgctggctgtctgtgtgagccgagactcaaaagtgctcaaaatctcactgttaaaaaagagtgtgagcattaaacaaatacagccctggaaagtatgagaaaccactgtcctgaaacccatcattccaccttggcttcctggagagctggccaggtgcagagcatggtttgaccccagggagaagcccagagttttcatgctgtctaccaaaaaggcatctcaatggcaaatccttctatctccttccaagttcattcactgtggccttaaaatatactctacaaacatagaaccagaatgtctttgggttcctagacggggccactgcagggttatacaagatcatcgggcaggaatctgcccccttctgtgcagcaactgtcccaaaccagagtacatggcttggtgagcagagaatcagcagggagactttgtgactcagactctgtccccagaaaccctgtccccagacaccactcaggcctcaccctaaatagactatgactgggcagaagggaatcaagtcctctttccggatattttccttccaggatggaagacttgactgcagatcaattatgatcagagctgcctaaagatatcgcaaggttattgctaggaaaacttttccttttagcaagatgatcctggaaaaataaacaaacaaacgccaacaga

SEQ ID NO: 233097 - DNA, 461 bp, Homo sapiens
ccatctcaaaaaaataaaaaataaaaaataaaataaataaatgcagaaactggagtcttggcccctggatctatagccctctattgaagtgttattataccagtcatttacttactggaattaactagtagtaagttaaatttggccttatttattacccaaaacaagatagtggtgagaaactcattacaggatgcccttaccaccaaactggtcttatggaaattgatacactttttttttttttttaagaccaagtcttgctctgtcacccaggctggactacagtggcatgatctcagctcactgccacctccacctctcctggttcaagtgatttcccagctactcgggaggctgaggcaggagaatgacgtgaacctgggaggcagagcttgcagtgagccgagattgcaccactaaactccaacctgggtgacagagcgagactctatctcaaa

SEQ ID NO: 233098 - DNA, 392 bp, Homo sapiens
ggtaatggagggacacagaactcttcctaaggggtgagagggatgggggagatggttccaggaggccacagcaaatttacttggcatatgtgtacacatggaagagtggaagggccagaagagaaagtccatttcagagaggacaggtggccactcttagggtcaccgggtggccttcctgcgccatccggattcccaggacatgactgggaggacggactttccccaccacaacctttagtgactaagacacttttctgagcaaacagctgtctcaggctccctcaattggcccctctgctggaggggactggacaccgtggttccctaccctcctccttccctctcccacctgttcccctgaccccaccctcagcagtttcctttccacc

SEQ ID NO: 233099 - DNA, 244 bp, Homo sapiens
tctttatgcttgaggggaaaatatgtaactcacgcatacacatgtgtgagcacatgagtgcacactcccacacacgtatatgtctttgaaattctgctaagtaactagatattttgaaagcacttaaaactatgtctgctttttaaaaaatcgattgtctgaattaggtccaattaaaatctatttgtgaatagagttttcattagaattcacaaatggtagtggtgaagagtgacagctgcca

SEQ ID NO: 233100 - DNA, 448 bp, Homo sapiens
tgtttattttaaattgttttagaaaatatataactagcggctgggcgcggtggctcacgcctgcaatcccagcactttgggaggtcaaggctggcagatcacgaggtcaggagatcaagaccatcctggctaacatggtgaaaccccatctctactaaaaatgcagaaaaaattagccgggcgtggtggcgggcgcctgtagtcccagctactctggaggctgaggccggagaatggcatgaacccaggaggcggagcttgcagtgagccgagatggcgccactgcactccagcctgggtgacagagcgagactccgtctcaaaaaaaaaaaggaaatatataagtaactcatgaaaccaaagatatcatgggtgatattgactagagtaagggcagaaaaatgagtctatatgaagttgatgcaataaagtctgctggtttcttcca

SEQ ID NO: 233101 - DNA, 478 bp, Homo sapiens
atagatagataaaatgtgtatgtacatacagtggaatattatttagacttaaaaaggaaggaaattctgacatattacaacatggatgaaccataagcattatgccaagcgaaatatgccagtcacacacaaaaaaatactgtataattccacttatacaaggtacctagaataggcaaatgcatagaaacaggaaaaggaataatggttgccaggggatagagggaaggagatagggagttgtttaatggatgtagtgtttcgtttttgcaagaccaggatagttttgggagatttgatgcacaacaatatgaacattcttaatgctgccgaactcactttaaaatagttaaagtggtaaagcttatgttatgtgttttttactacagtttttctgaaattttctaaattttaaagtggttaagatagtaaattttattgttatgtatatattaccaccaccaccaacaacaacaaa

SEQ ID NO: 233102 - DNA, 126 bp, Homo sapiens
tggaaattctttttctgttcttttctccatctcctctccttctggtactctcccattatgtatctgtggtgtacttaatgtcccacatttctctgagtctgtgctcatttaccttcattctttcac

SEQ ID NO: 233103 - DNA, 461 bp, Homo sapiens
tccctgtaggtctgcctcttgggtaaacactctgcccagaaccagcagaaccgtccattatctcccccagcctattaaggaactctatgcaaatgtgcactaattgacccaagacacagcagctcctggaggagaaggatgactccagatggcttaatgatagggatttagaagtcccttcagaagtccctcttggggaagaaagtgatctgcacttggagaagggctgccagctgcctcatggggtggccagtggactgggtgacctgcaccttgggtccctttcatcaaaccactgtacaagggagactgtcagctcaccccttcatctctctccaatcccctgacccttcctgcaacatggccccttccccagagcccacagtttggatatttcgttgacatgtacctcagtgggtctctgccttttcaaataaattattgtcccccctttttaaata

SEQ ID NO: 233104 - DNA, 524 bp, Homo sapiens
aggttgtggtgagctgagatcatgccatcacgccactgcactccagtctgggcaacagagtgagactctgtctcaaaaaaaaaaatgtccagaataggcaaatctatagagacagaaaggagattggtggtgtcaggagctgtggggaagtgggaagaggaagtgctaatggggtcaggatttcctgctgggtggtgaagatgttctggacctagatagtggtgaagtttccacaacactgtgcatataccaaatgctactaaattgtaccctttaaaatggtgaattttatgttttgtgaattttacccaaacaaaaaatgctattttatctcaaatttttgttaatttgggctactcacacgatatgctgttaacatctttccatgacatcaaatcattttatgaaacattattttgtggttttaacaaatatttgggttatgtattcaaaccactctatttcttaaaaatggcgtgatgttacaaaatgatataaaagtgctttgtctcacgttgcaagaa

SEQ ID NO: 233105 - DNA, 389 bp, Homo sapiens
ctaaggaccaaactagtagctcagtcattgtaggcctcaggctaaacaaagaggctccaatcaagacgaagagcatgtggcccccaggtgagcacattgccactgacgccatctgtgagatgtgtaagaccctggcagggactcggcctgtcagtctgctccagacatggcgcagtgttctgaaactcttctccaagcaaaacctgagtaccacaaaggtgccttagagaagaattcattttcacaaactgttgcagaccagtctagtgctgggcactggaggttccagagaggagcgggtcacaagccctccagtgacagctcaccatctctctggggtgtcagccctagggaccatcaccatcagtgacaaatgctttgataaagta

SEQ ID NO: 233106 - DNA, 613 bp, Homo sapiens
agacggagtctctctctgtcacccaggctggagtgcagtggtgtgatctcaggttcaagcgattctcctgcctcagcctcccaagtagctgggactgcaggcgtgcaccaccacgcccagctattttttttgtatttttagtacagacagggtttcaccatgttagccaggatggtctcaatgtcctgacctcatgatccgcccccctcggcctcccaaagtgctgggattacaggcatgagccaccatgcccagccagtttgtgctttttatacatgatttctactcatcagaatattctgcaatgctacctacattttcatatgttgtttctgcccagtcctaggcttaaatactttataagttagtagtttactaacgggagctgtttgatttggattctaggaacctgcctcattccttagccaactatgagttgctaatgctgataaaacacattgtctttgagagacacaaagcgtactaggtttttcccccactctcttaagtatttttggcaaaacagagaagcatgaaaaggtgagacccctttgccctgaaccaattatgagggtgactgggtagctgatgaatgacagcccctcctgcctga

SEQ ID NO: 233107 - DNA, 279 bp, Homo sapiens
gaaatgagatgatactgtctgcccttaagaagcttactactccctggataaactagaaatttttaaaaatgaaaataatgatatggccctcttgagggaggagggtgggaagagggagaggatgagaaaaaaaataattgttgagtactatgcttagtacccaggtgacaaaatgctctgtacctcagactcctgtgacatgagtttgcctgtattaacaaacctgcacatgtacccctgagcctaaaataaaaattaaaaagtgaaataaagaaaata

SEQ ID NO: 233108 - DNA, 463 bp, Homo sapiens
cagttattccagcagagagtattctgaagtctttgagcatttattgtctgtagtattgtcttgtcacttgtaacccacatggctttaaagtcattagttatctttttacttacattctctgagaacacaggtcacagcacctagcaccattccttgctcaaaaaattagctatcagccagtcacagagtctcatgcctgtaatcccaacactttgggaggccatgtgggtttgatcacttgagaccaggagttcaagaccagacagggcaaaatggtgaaaccccatctctataaaaaatacaaaacttaaccagccagacatggtggtgcatgtctgtagtctcagctgctcaggaggcagaggtgggaggatcacctgattctggggaggtcgaggctgcagtgagctatgatcacaccactgcactccagcctggacgacagcatgagaccttgtctcaa

SEQ ID NO: 233109 - DNA, 272 bp, Homo sapiens
aatcagaacacatcagaagcatcccttttttcctccactgtaaagtctcccctcttcccgattgcttttgagtctctgccaaactcaagtgtggtcgctgcccctattgctatagcaagctctgaatagtctctgttctcacttggcaggtctacatttcttgcgttaaataaaactttgacacatattcactatctcttcccttgagacttagaaatctaacaattagagaatctttacagaattaaatctttcacaaagaaggtgctcaa

SEQ ID NO: 233110 - DNA, 501 bp, Homo sapiens
cagtgcattcagggaatgagaacactgaaatggctgtcttgttctcccagtgatggtaatgtcctggtaacacaaaggcaacaaagccagtccacaaaagtccacagaagtcacctctccctcctcatttgttttgacccacagctcagagttcaagctacctgggcagctccttcagtgcagtgcattcttctggtttctcacgaatcctttgtcaaatctttggcctctccttccaccaaaacccaactgtgttttcctgctgctgatggggaggtacttcaaggctcatattagctgtttcatatttgcctcattatgttcccccctgagacttattaatatggctggtgtatgtcagaagctcgtgttactgtctgttgcgagcatcccatgggatgatatgcagtcccagcattgagtctggtggcttctgtcacatcctttattcctgatacttccaaatttaaccatgacaccattgcttctgagaaggaattt

SEQ ID NO: 233111 - DNA, 1845 bp, Homo sapiens
  misc_feature (1665)..(1665): n is a, c, g, or t
cagggaagcttggttaaaaacagttatggcagtgggagtcgaagcgagggtctgaagttcacgactactagaaggggaggggagtggaaaggctctcagtgaaaaaggtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcngcatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaa

SEQ ID NO: 233112 - DNA, 476 bp, Homo sapiens
ttagtgttttaatttatcatccagtcttctcaggtgcttgacctgcttactgtgatttgtcaactgttactaagttaacagaatctaaaaatagcaaacagtttctcagacatttttaaaaaccattaagatgatgcttcagtttgctaacctcagtcttcacttcagaaattagaaaactaaaaatagctgaaatgaaggtagcatcagtaaaaaccaagtttgtttgcactttgaggatatatagaaggagccatgaccaaataacacatgtattcttccacccagtgtctgtcttcaccaagaaggacgactttgattggctgtaattggccactgttgctaatggagtagagagagtcttgctacatgcgggaactagaattacatcactgcgttttttggctttgtttcttcaatgggttgtagtgtatgaatattattacaaaataaaatgatttaaaaatatccatcta

SEQ ID NO: 233113 - DNA, 768 bp, Homo sapiens
cagggaagcttggttaaaaacagttatggcagtgggagtcgaagcgagggtctgaagttcacgactactagaaggggaggggagtggaaaggctctcagtgaaaaaggtacagtaaataaatgtccagggatattgggggctgggaagttgaataaatggtctaatctaggctggaggccataagggggaaaacagttgattctcggaagttctgccttctccccctctctagtgcgaatcactgaggcgccatttgatttctcgtttcctgcatgttttggcagtttacagtgcaaataacggtaccttggatgtctgtagagttttgtgtgcatatacaaattctcttaactaggtttaatttcatttgctttttaccaccctactccccagagaataataagagccatcatgtgttaagttcttaatatgtgtctggacagcatttgcataacacgatatcatttgatcttaaaaaataaccttcttaggaaacaggcccagaaaggaaatgacttgctaaagttcacgcagctgataagtgagtggatagacattcagatctcaacctgtcttctttttacagatcaggacataggcaggaaaggttaggcctgtattacatagaatagtaactagcatttgcttactattgccttatagtttacatatttaataatatgttcacatgtatcatctcatcctcacaccagtcctgtaatacctttaccaggtggtgttgacttcatttacaatcagggaaactg

SEQ ID NO: 233114 - DNA, 542 bp, Homo sapiens
ttaagtgacttgcccaaggtcaagtcaccagttatgctggatcccaatctcaaaccttgagagtgatttttacgctgctgcccaccgcgcccagccgagttactattaattttaaatggcaaaaccaaacaaccaatattgttggagcagaagaatgcttatcactgcaattctattacctttgcctgttacctgtctttattttccctttatttagaacctgaagggtgcttttagggtggaagaatataaagtttaagaatttgcttaagtgaaacacttgttatatcttcattctagtaacattctagtttttgtagaagggcctgatccctctctctgacccatttaactcttctgtcttcaccaagaaggacgactttgattggctgtaattggccactgttgctaatggagtagagagagtcttgctacatgcgggaactagaattacatcactgcgttttttggctttgtttcttcaatgggttgtagtgtatgaatattattacaaaataaaatgatttaaaaatatccatcta

SEQ ID NO: 233115 - DNA, 521 bp, Homo sapiens
  misc_feature (341)..(341): n is a, c, g, or t
ctggatcatgcattgcactctgttgtgtatctttagtctccttcattctgaacacttcctcagtctggctttatctttcctaacattgacgttttataaaaatacaggccagtttttattttttttgagatggagtctcgctctgtctcccaggctggagtgcagtggcccgatctcggctcactgcaagctccgcctcccgtgttcgcgccattctcctgcctccgcctcccgagtagctgggactacaggtgtgatggctcatgcctgtaatcccagcactttgggaggccaaggtgggtaaattacttgaacccagcagttcgagacttgcctgggcngcatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaa

SEQ ID NO: 233116 - DNA, 1027 bp, Homo sapiens
aaaaatcagaataagaagtacctgacatactttctacatctgtagttgcggaagacattttaataggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgatctgtcttcaccaagaaggacgactttgattggctgtaattggccactgttgctaatggagtagagagagtcttgctacatgcgggaactagaattacatcactgcgttttttggctttgtttcttcaatgggttgtagtgtatgaatattattacaaaataaaatgatttaaaaatatccatcta

SEQ ID NO: 233117 - DNA, 537 bp, Homo sapiens
aaaaatcagaataagaagtacctgacatactttctacatctgtagttgcggaagacattttaataggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtgtgtattttgtggtgatctgggatgctgatagaaataattggatgttagtgccctaagccacctctgcactattttttttatttatttattttttcgagacttcgtctcaaaaataaaaaaaaaacccattggaaaaattcatcctctcataaatgacttgaaatgccacctccgtaatacactacgttaaaaattttacatactcaaattgtttttctctttttgtgccaggtcatactttaaggagcccaagagctttataacataacaaaagaaactgaaatgtctaataaatgtgtacataacaata

SEQ ID NO: 233118 - DNA, 263 bp, Homo sapiens
aggttatgtgccatgaattctgtggatattagtaggcatcatgttgaaggaagggttctgtagtcaaatgcggactaaattagttttattctttttccactttaggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcga

SEQ ID NO: 233119 - DNA, 1962 bp, Homo sapiens
  misc_feature (1782)..(1782): n is a, c, g, or t
aaaaatcagaataagaagtacctgacatactttctacatctgtagttgcggaagacattttaataggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcngcatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaa

SEQ ID NO: 233120 - DNA, 1703 bp, Homo sapiens
  misc_feature (1523)..(1523): n is a, c, g, or t
cagggaagcttggttaaaaacagttatggcagtgggagtcgaagcgagggtctgaagttcacgactactagaaggggaggggagtggaaaggctctcagtgaaaaaggtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgcttgcctgggcngcatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaa

SEQ ID NO: 233121 - DNA, 457 bp, Homo sapiens
aactcagcattaatcttatttcattcttttgttgccattaaattgtaataagcttattttaaacttcagggtgctttctgagcccttattagcatcataaattttgttcccacatttttaaagtaccttgacagacacacaggttggctgaactgacaggccgccccatgagagttgtgggctggtatcattcccatcctcatataactgtttggccttcacatgttggtaagtatcatggggttgcaatgtttattgttttcagaaattaatatcatgtttccttttccattacatagggtatggttattttaaaccaaaatttgactgtcctttagcagatgtcattattttgatttattttattatgtattaaaagtaatgatttatgtcatattgattgtttttaataagtctgtcagttgatataaaaaaattaaactgttaactgaaaatt

SEQ ID NO: 233122 - DNA, 638 bp, Homo sapiens
ggttgtttaaccatgtacctgatttaggacatctggggtgtttccagttggggctattacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctggtgatactgaataaagtctgtagtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaata

SEQ ID NO: 233123 - DNA, 3068 bp, Homo sapiens
cgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctggtgatactgaataaagtctgtagtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaata

SEQ ID NO: 233124 - DNA, 2839 bp, Homo sapiens
  misc_feature (2806)..(2806): n is a, c, g, or t
cgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctagantacagactttattcagtatcaccagagtcgtcc

SEQ ID NO: 233125 - DNA, 2464 bp, Homo sapiens
ctgatcgaattcgactcgtaccctccaggatgagaattgtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctggtgatactgaataaagtctgtagtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaata

SEQ ID NO: 233126 - DNA, 2384 bp, Homo sapiens
ggacgcgtgggtcgacccacgcgtcgcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctggtgatactgaataaagtctgtagtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaata

SEQ ID NO: 233127 - DNA, 2854 bp, Homo sapiens
atttagtaattaaaagcaatgaggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctggtgatactgaataaagtctgtagtctagatagcagt

SEQ ID NO: 233128 - DNA, 2798 bp, Homo sapiens
actatatacctaattatgggcacgcctcaacaaacgatcgatcgctaatagtctaattgcgaggaatcggacgcttaacttgttatagcatacgttatatcgataggtcgtcatttccaacggctatactggtacagtattgccgcgggaaatgttctgaaccatttatagtgacggtagtggcctttcaccaatgttgattgttcgccacacccatgcatgatatgcacactcatggactcaaggtcgtttggtacggacgtgtagtattcttatccgtgtcttcattataagattataaaacacaatcgacatgggcggccgatttaacacgctgtttccgagtccatacaggccctccacgagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgaatctttacctgtgctgaagttgtatggacctacatacacacaaatgaatgcatgtaaaatctggtgatactgaataaagtctgtagtctagatagcagtataatattattgtcaatgtcttggatgtgaagttgtgctatagttacaaaaccgtaccactggaggaaactgggtaatggatacatgggactctgtactatttttgcaacttcctataagtatataattattgcaaaatgaaaagttgtaagttttaagtaaggaactgggacgtatggtacctattttatgaaataagaaaagggtgctagaaaatttgaggggaata

SEQ ID NO: 233129 - DNA, 666 bp, Homo sapiens
atttagtaattaaaagcaatgaggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttggtaagtatcatggggttgcaatgtttattgttttcagaaattaatatcatgtttccttttccattacatagggtatggttattttaaaccaaaatttgactgtcctttagcagatgtcattattttgatttattttattatgtattaaaagtaatgatttatgtcatattgattgtttttaataagtctgtcagttgatataaaaaaattaaactgttaactgaaaatt

SEQ ID NO: 233130 - DNA, 565 bp, Homo sapiens
ctcatgaatagattaatgctgttatttcagaagtggtttccaaaaggataagtttggctctctgttctcaatctctctctctcttctctcttttttctctttctttctctctctcttttttctttctctctctctctctctcactttccttctctctctccctctctcctgccctttctttctgtctccctccctctcatcccaccctttgcccttcctccctaggatgatgtagcaagaaggcccttgcaaggtgccagcccctcaaccttgtacttcccagcctccagaaccatgagccaatacatttttgttcattataaattactcagtctgttctattctgttacagcagtacaaaatgggttaacacaaacagttaccacaccaaacctgtaaaaaatacctctcaacttttaaaaaaaaagagaatatgccaggtactatggcacattcctgtaatcccagctactcaggaagctgaggcaggaggatggcttgaacccaagagtttgctccactgccctccagactggggggcagaaagaggccctgtctcctgtaa

SEQ ID NO: 233131 - DNA, 647 bp, Homo sapiens
tttttttttgactagagactttgtactgaccaaagtgtcactaagcctgaattaagtccttattatatatctaagtaaatgaatggctattaagaaacaagtcagtagcatatgaagctggcgattcccctattaagaatcccaaaggatttgttcttaagtttccagaagacatattacagaagatggctgaaaccagctagccgagctgatgtgattagtccctaatctgaagcattaaccttcctaaccagttaggggatgatttttagccagtgactccatttatagaacttttttttttttttgagacaaggtctcactctgttcccaggctggagtacagcacgaatgatcatagctcactgcagcctcaacccactgtagtcagtaacaactgcagtattctggccttctgagagtccctactaggtggttccgccatttgcttctagttctaaattttgcaatttttttctttgtattcctgctcattccctgtcatctctctccccaccccagaaagtgttacatggccaaagagtgaatcaacaaatatttttgagcccttaatacgtgctaggtaacatgctagctgccgtggacacagcagaggcactggatccccttttccaggcatgcctttc

SEQ ID NO: 233132 - DNA, 933 bp, Homo sapiens
tttttttttgactagagactttgtactgaccaaagtgtcactaagcctgaattaagtccttattatatatctaagtaaatgaatggctattaagaaacaagtcagtagcatatgaagctggcgattcccctattaagaatcccaaaggatttgttcttaagtttccagaagacatattacagaagatggctgaaaccagctagccgagctgatgtgattagtccctaatctgaagcattaaccttcctaaccagttaggggatgatttttagccagtgactccatttatagaacttttttttttttttgagacaaggtctcactctgttcccaggctggagtacagcacgaatgatcatagctcactgcagcctcaacccactgtagtcagtaacaactgcagtattctggccttctgagagtccctactaggtggttccgccatttgcttctagttctaaattttgcaatttttttctttgtattcctgctcattccctgtcatctctctccccaccccagaaagtgttacatggccaaagagtgaatcaacaaatatttttgagcccttaatacgtgctaggtaacatgctagctgccgtggacacagcagaggttctaggagcaatctacctgaactaaaactctttgatcttggcagtgccgaaggcatttttccaggatgcaatagtgaacaggtttaaagcgaggctatgcccttgtttgttcatgccctgactctggtatgaggaaaaaaaaacccaaagtaattaaagactgttttcagacgagttcaacaaaacaaaggaatttaaattgtctgaatttgtggtaaagcttcaaatgtgactctaagcaatgacctttctatttctgccagaagttaacctattggtggaaaagctgtgtaactaaagacattgttccccaaac

SEQ ID NO: 233133 - DNA, 223 bp, Homo sapiens
agaaaaacctaagatttgtggaggcattgatctcgctactgtcaaggcttattagcatcttgaggagaaggaaactgaaaaactgccaattccctgtcagtttaaggctaatcacagttagatgctatggaggaaggtgaaactgagttctcacttgtctctcggtatgaaaccgaattagatatgattaactcccaaatatatacaaaacaaaaacaattaa

SEQ ID NO: 233134 - DNA, 480 bp, Homo sapiens
agttaagcctccctaactatatgaatggaccccttctcccttttggagttcaggaaaagccaaccagcattaatatcaacatagaccttaagtctgataagaaatatttgcaatctattctctctgaagacctgctacctggaggtctcatctgcatgatgaaaccttggcctccaccaccccttattattacccagacatttatttatattgataataactcttttaaccaattgccaatcagacaatttttaaatccacctatgacatggaagccccctccctttctatttgttccaccgtttcagatacaaccaatgtaaagcttacatgtattgattgatgtattgtgtctccctaaaatgtgtaaaagcaagctgtactccaaccaccttgggcacataccatcaagacctcctgaggctgtgtgatgggcacatctttaaccttggcaaaataaactttttaaattgattgaga

SEQ ID NO: 233135 - DNA, 541 bp, Homo sapiens
aggtaagagatgagacaaagaaaaagacactagagaaatctgaaacctctggctatatttatatttgtaacatacaactatagcaaacactaaagacaaacgaacttctctgccagacgaccattaattcttatactaaatgcctatttacttcacttcctagtactcgatacattgtatctgactttcaacaaaaaattataagacatgtcaaatgacaagaaaaaaacattctgaagagacaaaacaatattaagaactagactcagatatgaaacatatgttgtaattattatggaatttaaagtaactgattaatatattaaggtaattaatggaaaaaatagacatgaaagaacaggtggataatgaagtagagagatggaaactctagaaaagtatcaaaaggaaatgctagaaatgaaaaacactaacagaaatgaagaatgcctctgataggctcattagtggattagacacagccaaagaaagaatcagtgagcttgaagatagatcaatgaaaactttccaaactgaaatt

SEQ ID NO: 233136 - DNA, 412 bp, Homo sapiens
attgataatcaaaaaaacctcccaaaaagaaaaacccaggatctgatggctttattggttaattctacccaacatttaaacaaaaattaatgccaattgttttcaaacccttaaaaattcaagagcagggagcacttacatcatgagaacagcattaccttgacaccaaagctagatagttggacactataagaaaagaaattataagccaatatccatgatgaacatagatgcaaaaatccttaacaaaataccagcaaactgaattcaattacacattaaaaggatcatacgccacaatcaagtggatttatctctgggctgcaaaggtagttcaacacatgcaaatcaataaatgtgatacaccacaataaccaaatgaaggacaatcatatgttcagttcaatagatg

SEQ ID NO: 233137 - DNA, 387 bp, Homo sapiens
gcagctgggacttgtgccttctgtccagtgccttccactcctgtagagcaccccaccttcctgccggtgctgcataagcacaggctcctgcagggctgcgccccctggaacggcttcccagagcctccacaagcacgggctcctgcagggctgcgccccctgaaacggcttcgcagagcctccactagcacaggctcctgcagggctgtgccccctggaacggcttcgcagagcctccactagcacaggctcctgcagggctgtgccccctggaacggcttcccactgcagggctgcgccccctggaacagcttcccagagcctccaccagcatgggctcctgcagggctgcgcccccggaacggctttgcagagcctcccagggtg

SEQ ID NO: 233138 - DNA, 496 bp, Homo sapiens
agaagcaagtcagttgggcacagtggcttccacctgtaatcctagcactctgggaggctgaggctggtctcgaactcccgatgtcaagtgatctgcccacctcggcctcccaaactgctgagatcacaggcatgagccaccacgcctggcctcgactttgttcttttgcatgtggatatgctgttttcccctcaccatttgttggagagaccttcttttccctattgagtagtcttggcacccttgtcaaagatcatttgagcatatacgtaagggtttatttctgggtctttgtcctgttccattggtccgtatgtctgtctttatgacagtgccacactgttttgattactgtagctatgttttgaatcaggaagtgtgggtcctccaactttttttttcctcggaattgtttttgctatttggaggtctgtatgtattcttttttgatgtacctataaatatattttagtgtggataaatatgtgcatgtaaa

SEQ ID NO: 233139 - DNA, 139 bp, Homo sapiens
caggaaatttaaaaggaatatgtttatataacgacactcagtataaggtatgtagcccaggaaatgactggccagatgtgtgttatgacccctttgagcctcccatgtccacagtttttgaaataaaattaaggactga

SEQ ID NO: 233140 - DNA, 952 bp, Homo sapiens
ttcaggagataaagttgggctttttgaaaactaatacttttgtcctcgcctcagcatcaaaatgggtgcttttgggaagagacatctagggacttgaccaaaaccaggattcttcctaaaaaccagagcttaaatgttttaaacaaccaaaataagtttcttccccctgagatacagaagaacaagcaacaagaaaaaaaaaagaaagaaattaggacattagatttcaatgtcccagtgaatgccttaccaataacgattcccttttcctgccaaacactggtgacctgttgtttctcctattttctccctggacagttgagaaattattgcatgatttatctttagtgcaggtacaacaaggatatggccacatattaccccaaatgagggattcgtatcacattattttccattggtgagtaatcgacgggaaatgggaaatgtcacttcaaggcgggctggccatctggtggaagcatctccatgaacacagcagctgatctacatggaaatattaaagcaacaaagtctgaagctgttttgcttctccagggaacttcagttcatgcatggaaggaaggcaataaagtccaattattctggacgcagctacacaaggcatatgaaaattatctcatggagggtagcgctaagctaagtattttttaaaatagccatcagtcactcccggcaacaaaatcaaataaaccaatcaatctctaaggaactcctcattaatcaaaagacggtggtgagaagttggcaatttttcattattctacgtgtaatattttaaatctgacatgctgacagggtggtctgaacatgtgaaattatcacgtccgagaggaggaacagttgagcttcacagtgttggacccctcacgtgttacctatttattgtgaatcttcaagtttgcccttttaaggtgtttgctttcttcttatt

SEQ ID NO: 233141 - DNA, 356 bp, Homo sapiens
cccgctgggccgtggaggggcggtggccctttgtgcagttagaccccccagggagtgcagttgtgaactaatcaccgcctggagagcctgtgtgcctcacacttcctccaggactgcactaatccccactcccacccccaactgccagcccctggccttggccccctccttccaaggtgcctctgctggtccaggaacatgccacctcctctcccagctgcacatgggctttccaaaaaggcccatcctgcctgctagtcatttttggtttgctcagtttactttaagaaaacccatttgcttgccagtgtttttggttggctagcttgtgataaacacttatcaaccacttatat

SEQ ID NO: 233142 - DNA, 738 bp, Homo sapiens
ggaacatgagtcagttatatcagggtgatctttcttaatatgtttattttgatttaatatagtctgcttgttttatcctatttttttcatagcagcaattcagatttcttattaaacatttctaactaaaatttgagtcagtatttttttactgcttgtgcattcaatagtactgtaactatacaagcaatttttgttgggttttttgttttggttttacattatatgtaaatataagtgaaaagtaaaatgtttaacattttctcgtttaaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaagtaagtatactgttttacagctaacttcatgaggatcagagagtagtttttcaattccttaatgatatggtcattttgtcaccttctgtcatatcttaattcagcaaaatagtttatcatttgtggaagtgacagtattctgtttttgtgtatatgaatgtcaaatataatataaatcgtcttgcttttctgtagctcaaaactactcatttttttctttctcaattgttccagca

SEQ ID NO: 233143 - DNA, 710 bp, Homo sapiens
ggaacatgagtcagttatatcagggtgatctttcttaatatgtttattttgatttaatatagtctgcttgttttatcctatttttttcatagcagcaattcagatttcttattaaacatttctaactaaaatttgagtcagtatttttttactgcttgtgcattcaatagtactgtaactatacaagcaatttttgttgggttttttgttttggttttacattatatgtaaatataagtgaaaagtaaaatgtttaacattttctcgtttaaaagccattcctagggagtagtgactgtgttaatcaaatatcagggaaacttaaactgggaaaagaagtcctagctactttggaaggtcattgggtaagtattttgtatatgagctttacaaaaagaattttattctgtgggaaaaaaaaaatcacatttaaaatttaaaacttattccgttgctgaaaacatcactatttaacataagcttcatcttaatagcagatattttggtggtgttctgttatcaacagtagttaattttgtgtaatattttatttccaaaacttaaaatcagtagaaatagctaacacttatatatgacttactgcattatttaagaatgttactcatattaactgatttaatatttataacatataacgctatgaggtgagtatataggtgccatgcccattttattattgtttattattg

SEQ ID NO: 233144 - DNA, 7204 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaa

SEQ ID NO: 233145 - DNA, 7241 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaa

SEQ ID NO: 233146 - DNA, 7263 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgggggaaaaaaaaaattttcggggggcctttctgggggcccaaaacaaaaactttttaaaaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaa

SEQ ID NO: 233147 - DNA, 7532 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaagtgacagaactgacaatctgtggagcaatacacacagttttccatggccccaaattcggtcctaagcaatttaaatgtaccccttaaaaaaattcttttggaaaattggggggccccgatcattttacgcccttaattaggaaaccaccccattattaagccccgcgtcgtgaggaagcccaaaaaacgataataagaggaaacagatagaaagacacagcgacgatacacaatagcgggactatagcaagtaaaaaaaaacgaggggcgccaaaacaaagagaggagcaggagggacaaagaagaccgcacgcaggtagtaaacaaa

SEQ ID NO: 233148 - DNA, 7146 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaa

SEQ ID NO: 233149 - DNA, 5687 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaa

SEQ ID NO: 233150 - DNA, 3903 bp, Homo sapiens
ggagtaacggattcgtcgaccacgccccgggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaa

SEQ ID NO: 233151 - DNA, 1693 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggtaaaagtctgctatttttagaggttctggattttcatattcttgggaattcttaaatgaaattgaagatattatttgcttga

SEQ ID NO: 233152 - DNA, 1144 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaaggtcagtgtgttttgaatcatgaattcagattgctggatgtttacctactggaatggaaaagcctggagtatacctaacgcctacaagacaaaaacagctcctaaaatgattgtttttcactggcaaagaaactattattgtattcccggaggttctgtgttcccatcttaatgaagagaaggaatcttaatgtctttcttaacaatagcatcaattacatacagtatagttct

SEQ ID NO: 233153 - DNA, 7647 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaaaaaaaaaaaaaaaaaaaaaaaaaaaaaaacccgggggcccttttttggggggggggaaaaaggggtttgaaaggggcccggggccaaagcttttttcgttgaacccagttctttttgtggtcatccaggggtggaataattcggcaaggagatcccccataataagggagaggccgctatatatttccgcgaaaataacgccaggggtgttacccctgctgtaatatctctccgcgagacgaacagggacggagacgaaggacaagcaccgacctacatagcacagagacaataaatgataatgaatcaccagagacgcgcatcagctggaacaaccattctgtaagagagcagcaagtagcacaggtgcagaacgaacaaaagacacaccgacgaccacggagattagtaagcgacaacaagacgaacacaatttacaaaga

SEQ ID NO: 233154 - DNA, 7213 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctacatactaccgtcgacttcataatagttcggcgtgcttgcctctgcgccttgggg

SEQ ID NO: 233155 - DNA, 5209 bp, Homo sapiens
ggaacatgagtcagttatatcagggtgatctttcttaatatgtttattttgatttaatatagtctgcttgttttatcctatttttttcatagcagcaattcagatttcttattaaacatttctaactaaaatttgagtcagtatttttttactgcttgtgcattcaatagtactgtaactatacaagcaatttttgttgggttttttgttttggttttacattatatgtaaatataagtgaaaagtaaaatgtttaacattttctcgtttaaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagaaaa

SEQ ID NO: 233156 - DNA, 1131 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatcacatcctttggatttaaaatgtcttttgagcaacttgaacaagttttcttggtgagaggaggcggtgggcggtcaggtggaactgtatatccagtgaggcacagtgtggagcagaatagctgagtagaccctttcctctggtgggtcagaacat

SEQ ID NO: 233157 - DNA, 563 bp, Homo sapiens
tgcagagataggaatgttctgtacctgtgccatccaatacagtaggcattagccagatgtggctcttgagcacttgaaatgcagttagtataactgaggaaataaagttttaattttacttaatttaaatctccacatgaggttggtgtttactgtattggacagtatagctctagcttctgcttaccttgtgatgaccactctcttgtttagacagactagttgcaagtcagggtctatgatcagagctgaccatgattagccatttcaaggtgacacccaccaagaagaatataatttcccaaaataataatgttctaaacctaggagaataaaaagtgggtacaagtactatcattgctaaggttttaaaaattattattattatattcagtaactgagaataaatagcatattgctgaattataggtataattttagggagagtcagtgaccacataaaccacgaaagtaaagattagaatttaatttcagccaggtgattatgcaggacttggacggtaggtactaagggatgacttggcttaggatcaaaccatagc

SEQ ID NO: 233158 - DNA, 466 bp, Homo sapiens
tgccgatgtgcctcagggtttacaggagaggactgccagtactcgacatctcatccatgctttgtgtctcgaccttgcctgaatggcggcacatgccatatgctcagccgggatacctatgagtgcacctgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacat

SEQ ID NO: 233159 - DNA, 367 bp, Homo sapiens
ttgcaggaagaaatggtgaaggcagacagctttgtagatttagaagggtgcttctttcttccctttctattggttttccccagagaagactacgtgtggatatctactataaaacatgtgtgcatggaaaattgtagggccagatgcttctggattaagagaacatgaccagttttatcatgatgaggatatggattttatccacagaacagggagggcaaaagcaagcctgtgggcacagtatgtgatgataagcactttggaaggatttgtgaatgatacaacggagttatacaaatctttggaagctgacaatggtaattaaagtgaccattggaatattaaaccatcatttgttattagagta

SEQ ID NO: 233160 - DNA, 749 bp, Homo sapiens
tctgtttatatcaacttcgccagctgagcaataaaagatggcttgggtagctttctctcaggagcaaaagctcacaccctttcccccgcatttcaacatttaccaaaatgtcatcaccaagggcaaaaatgaaagtgtatggctctgagatggagcaggatgtttccagatgaactatggagggcctgagtgatgttctcaaatcccaagactccaggaggccaaaaagttgtgttctacttgccaaacaccacataaggaagacatcaatcccttagcctgaccatttttgccagcattttcaactccaagagtttttttttttatcttatccatatgtgttcataaattcttataccaatttaataaagaagtttcactttgataggaagcatgcaccatgaggctaaacatgaaagggcttcttttctgggtgaaatgaactttgttacaataaatcaaaattgaagctcctttgaatggaaagcactcaattgttggcctcttcactattcctgaggctactattatatttaccttgggacaagctagaggtgtgatgtgactcatacatccatatgcttgggggtggggaccaggtgccagcacagtgtcaaacttggacacataaagcgtggtctgcagtgacctggagtttttactccatatatccttagaagaaaaaaaactggttatcgggccaggtgcagcggctcacgcctgcaatcccagcaccttgggaggccgag

SEQ ID NO: 233161 - DNA, 381 bp, Homo sapiens
attaagattggtttccttccctcactgtcatatcacatcattaaaaaaacttgcttcccaagtacttcccttttataaccaaaagccacaatgccagtttatcatactgagtttttttaaactaggtcaatgtaccaaagtcacaattttaggtgtttttaacctattccatagtcagagaagagttaactttaacaaatctgtcacgaatgggatttaccagtcttcaatatacttactatgacagcctgtctttggtttaagaaacagcaccgtgtggtgccatgaaagagcacagtagtgatgtcttcctacaaactcattgctgaatttcatctaaagcttcaaagatctgggtggtctaaacacctatagtgaacc

SEQ ID NO: 233162 - DNA, 410 bp, Homo sapiens
gcattctgtgaatttcctattacatcagtttcatgattcagcattttccatttcatttatttacagtaatatatggcgagataacccaaggtttctgcaggattgtggaacataagttactctgggcaggaagggtgtcgccttctgtaaatttactattgtttaggagaactcaaaacagaagcaagcaagccctcaaaggaactgagaaaatttctccccactttgttctgaggggtctcagctactctggtatttaaaataaatgggttttgaaaaataggttactgccctttagttgatgactaaaacagaagccaagaagtgtgcaaattgcaaactgacatgcatgagccaaacatattctctgaaatgacaatgttcaagacgcagctaaagtcaccactctg

SEQ ID NO: 233163 - DNA, 560 bp, Homo sapiens
tgggaacatggtaattgtgtaagacacactggggttgtatcagaaggacccacaggggccctgctggcacagatggggcaagcgagagtgaacaagaacaaggagcccctgagttagatgtgttaaaaatccaaggctggctggatgccgtggctcacacctgtaatcccagcacttcgggaggctgaggcaggtggatcatttgaggtcaggagttcaagaccagcctggccaatatggtgaaaccccgtctctactgaaaatataaaaattagctgggtgatagtgacgcacgcctgtaatcccagctactcgagaggctgaggcaggagaattgcttcagcctgggaggcggaaagttgcagtgagccaagatcgcgccactgcactccagtctgggcaacagagtaagactgtgtctcacaaaaagaaaaacccaagggtttaagctggctgtggttatacgcacctgccatcctagctgttccggaggccaaggccataggattgcctgagctcaggagttggagtctagcctgagcaatgtagcaggacccccc

SEQ ID NO: 233164 - DNA, 502 bp, Homo sapiens
tgggaacatggtaattgtgtaagacacactggggttgtatcagaaggacccacaggggccctgctggcacagatggggcaagcgagagtgaacaagaacaaggagcccctgagttagatgtgttaaaaatccaaggctggctggatgccgtggctcacacctgtaatcccagcacttcgggaggctgaggcaggtggatcatttgaggtcaggagttcaagaccagcctggccaatatggtgaaaccccgtctctactgaaaatgaggcaggagaattgcttcagcctgggaggcggaaagttgcagtgagccaagatcgcgccactgcactccagtctgggcaacagagtaagactgtgtctcacaaaaagaaaaacccaagggtttaagctggctgtggttatacgcacctgccatcctagctgttccggaggccaaggccataggattgcctgagctcaggagttggagtctagcctgagcaatgtagcaggacccccc

SEQ ID NO: 233165 - DNA, 498 bp, Homo sapiens
cgattcaggagctatttacagcacctgccagcatttctaatgtctcagtgctgcccctgagaaccagcgccggcgtcacaaccagccccattccccctcgtgttctcagctgtagccaagccctggtccagcagtagctgggtaggaaatgcatgcagctcctgccggggcctcccgccccaaccctctctcctgacaggcgatttgctgggctggaggacagggccaggtcttggccttggcaccgtcctgggtcacgagtgtatggttctggtcactctgctgtggtgcgaggatgaaggtgccagcccagtgtgggcaaccctcacagccagaatgttccagtgccccgcacctcgggaccctggatgtgtgcggctgccgtcacaaagtaccgcagacccagcagcttaaaccacagaaatttattctatcacagtcctgaaggcccagagtacaagatcaaagtgtctgcagattctgtttgtctgaggtctc

SEQ ID NO: 233166 - DNA, 358 bp, Homo sapiens
aaccatttttaatttttttagctgttgtctttagggattgatggtactagattggtaatacaagaataaccaaccggaatagagaagatgtttatacattcagtaaacttttctttggttttagatttttctgtctatgagctttagttgcgttattgttttcttgctctggaaaaccctaactgaatgcaatcaagatgcctctaaaggttcaattgagagagctttattttgaatgaaaaatctcattgttttttgatgaaatgctagacttagaaatggattggttaaatctgaagaataatgaaaccacttaatctagtataaaatacttttaataaatgaacagaagatttta

SEQ ID NO: 233167 - DNA, 416 bp, Homo sapiens
tcttaaaaaagcaatgcattagcatcaacaacgggattaattaggcttccctagaaactgttcaaacaaagaattgtgcagttctctaggaaggtcaggctttttcattcttttctgcagcagttcaagttatcacttctgcacaggcccacgttctgccacaggttggaggaacattcattccactgccctggggtctgatgggatcagacactggttcccaggggtggtgctctgaatggccaggccttcaagggtattagccagaagtgctgggttccaggaccaaggcctaacgaaaagatgaagggctttgaagtccagcatagtaagctctgccattccccccactggacttcattttcctcctccgtgaaataggcctgatattctctatagagcaaagttgccatcaa

SEQ ID NO: 233168 - DNA, 434 bp, Homo sapiens
aagattaggtttccagactacccttttgagtcagtcgctattacacggtatagtcccaaagaaatttaagggccactcttggaattttttaaaagcaacatgtatttcacagtttgtgggtcaagaacctggatgcccttagctcagtgtctctcaggaggccacaattggagtggtgactaaggctgtggtctgatctgaaggctggacaggggaaagatctacttccaagttcacatatgtatttgttccagtcatagaattttaaagttagaagaaacctggaaacataagagcaaataaatataaataactgccaggcacggtggctcatgcctgtaatcccagcactttgggaagctgaggcgagtcagttggggtcaggagttcgagaccagtttggccaacatggtgagacctcatctctactgaaa

SEQ ID NO: 233169 - DNA, 614 bp, Homo sapiens
ggcctccggccgctctcggctgcgggccatggccgctccccggcgcgtccccacacggtccccgccccagtctggccgcagcccaccccgcgccgccactgggcagatgggggcggcggctcctgcctcccggctttcggaagagcagagcggagcgcgcctgaccgagtcaggcttccgagtgggattggaacccggggcgccctgaagtttggggaaagcaggagcagaagggaagggatgcgctccccgctctccggcggcgcggaatgggcctccttccagcctctgcgtaggcaagatttccccagttgcgcgctgcaccggggactccccagcccgtgaggcagccaagaggagagcgctcagtgaccctctgggggcagagccgtcaggccaagttcatgggcaggaagactttgtgcacgtgggggtctctgaaggttgagcgcgagctctgcacccccacttcgaggcactcaagaagcggaacagacgcgagccccgccgggggtgcgggtgagggctgcagggagcccgcgaacgacagaaagtcgccccccgcattccaccggagcactcgggaacacggcttccaggtgtcccagcggccg

SEQ ID NO: 233170 - DNA, 535 bp, Homo sapiens
atggagtcaacgctataattagacttctgaaaatgagcaactactagagaatcccaagagattctttcaggaactggaaaggagcagagcatatgaaaataaagacattgtacagagtcagcaaaccatgagatgcactggccaaatccagcccaccggcttgttttcaaacagcttgcaagctagaaatggattttacattttaaaaattattggaaaaaaaatcaaaagaaattaatatttcacaacacacgaaaaattatatgaaatttaaatttcacagaccatagataaagtttcattgtaacgcagccatgctaattctttaggtattatctatggctgctctcatgctacaatggcaaacttgtgtagttgtgacagaaaccacagggttcacaaagtctaaaatactatgtggccttttacagaaaaaagtttgataaaacttggtctattttaacaatgtaataacaattcaccacagacaaacccaaaattacaaaattctcagtctgcagtattctttaaaaaa

SEQ ID NO: 233171 - DNA, 610 bp, Homo sapiens
gatgccatcagtcactgtgacaaatggtgtgtggggggagcttgctggctgaagcattgtcaccgtgggtaattatacacttaatattcatgtgttatcgttccacctggaatctttaaactcttcatccaggagacactaatcttcaccttattattacgtcctaatgtcactctagcagaagaatggggctgccaacagggggagagaacttcctccttctcctctaggttgtaataaacatggttatttgttatttgaactctggctgaagataagacgctatatgcccctgccagatatggcccaggtgtagagatgagtccaggttattgttaaaagagtgaaaatgcccctgtcacattccccatcgttttcttccatctataaagatgatggcaatggtgttggcaatggtggtgataatgatgattatcaagtgagcattattccatttttaggcatgatggaaggaaaagtcaaatgcagtgttcttaacacttcttataacgttcagaaaccaccagatagagagaatgctgtctgtccttaatgcaagcagcccttggaattggttctagagctgcatgagctgccgatgggaaagtga

SEQ ID NO: 233172 - DNA, 1030 bp, Homo sapiens
agctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtc

SEQ ID NO: 233173 - DNA, 843 bp, Homo sapiens
agctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtc

SEQ ID NO: 233174 - DNA, 154 bp, Homo sapiens
ttagccctgttaaaagaatttctttcctgtagaaacaggaagttacattttgtagcgtgtaaccccctaaagtctctaaaggatctagacaaatttgtagttctagtctcaaaggctccaaatccagacaaaattcttccctaatgtactcccc

SEQ ID NO: 233175 - DNA, 264 bp, Homo sapiens
caaggtgatagttttaagaggtggtgcctttaggagctgattaaggcatttgggcagagccattctgaatgggattaatgaccttataaaagagatgaagatgaacttttgaccccttccaccacatgaggacatagcaagaaggcatcatcttaaagcagagagcaagccctcaccaagacactgaatctgcagatgccttgatcttagacttcccagcctcagaaactgcaaaaataaataaataaataaataaataaatgt

SEQ ID NO: 233176 - DNA, 868 bp, Homo sapiens
tctgcttttgttgttaacggactaacccttagtttggtggttagagaagtgatgggaagaacataaagaaagctcagatgacatttgtctttgctttaaatgtgtagtttttctctcacaaggctagtcagaaatattgttggcagaagctgtgtgtatctaaatagtaatttcttaaggaagcataatatgtatatcttaattgctgccaagaattgagtacagacatttgttatcctcgtttgtctgtttaatgcttttctatgggagagaatgcttaagagaggtagatactactgaaatttagctcatcaagagggagacacaccaggataaggataataacagcagctcacttttagcaaacgcttgttatgatgatgatgatgatttattagctggaatgggaaccatgtcttcacgaatagactgaagtccttttgagcccagatcacatgcctgtttgtcaatgatggctgtttatgaaggtgtctctttgaggtggtggtcatctggcagggtcagtagagcttagattgagccttgtcaaggccctgggtgatgagtgggatttagtttctctagctgtgaaattgaaaggatgctatttaatagtgctattagggagaaaatatttgctctgttgaatactttcaaaatatcattacaatgtacatgctgtgctataccatatagatacattggagccagtgtctcgcatgaaaatattttggatgaatatgtaaaccaatgttacctttgttttttgctctagtttttacagctctgtctgaaggtgcaccaaccttacaaggaagatcaaacagcaagcctgttctttgaagaatacttctttattatcattaaa

SEQ ID NO: 233177 - DNA, 748 bp, Homo sapiens
agctagtagcaaatttttgtttcaacttgctgtctatctttctccttacttacaactctggagaggggtttgttaatcagatctccttaaggttggaagagtaaattctcccctctccatccaaaggggaagatgcctgtgtctcctgggttttttccaggtggaggttttgttataagtaaggtttggctgttaaatatcttcccttttttaagagttctaggaaggaagtgtgtttgaggaggtttgagcctgcaaagtggaagtgacactgtgggttgcacggtttggccactgacttctcacgtggtttcagtccttagcaccgtggtattgacatgacatcagttgcaaaattaataagtaatgtggcattgttactacatcacaggcatatttgagaatgaacatcactgtgttttgcaaagtaaacgtttaaggggtgaagaaagggtcatgtattgctaataaaggattatgttagtaacctggatgtgagagaacatttctactttttcagacctgtatttcaaataaaatgtgatgtcatcttctgaagacttaggaaaagtttgagtgagtaagcgccttctccctcagcttccatttccgctctgttctttttttttttttttttttgtgagacggagtcttgctttgttgcccaggctggagtgcagtggcaccatctcagctcactgcaacctccacctcctgtgttcaagcaattctcctgcctcagcctccc

SEQ ID NO: 233178 - DNA, 414 bp, Homo sapiens
agcacatatttcccaacagcataacgagtgtaattttatgggaaaaagtatttagacccaattggaaattagccaggccatacaaccaggagtgtctttgctactccgtctggtgttgaaagggtttgtattgactgggcgcggtggctcatgcctgtaatcccagcactttgggaggctgaggcgggcagatcatgaggtcaggagatcaagaccatcctggctaacatggtgaaaccccgtctctactaaaaatacaaaaaaattagctgtgcgtggtggccggcgcctgtagtcccagctactcgggaggctgaggcaggagaatggcgtgaacctgggaggcggaggttgcagtgagccaagatcgcgtcactgcactccagcctgggtgacagagtgagactccgtctc

SEQ ID NO: 233179 - DNA, 628 bp, Homo sapiens
ttaaattcagacttcagatcaacaaccaatcatattttcagtaaaagtttagcccaagtaatacttgaatatacttatactaaaaaagaacccattatctgaaactcaaatttgactggacattctggatttttatttgctagatctggccgccctttggggggctcacagaattctgccacagagagccaccatacagttgtctgtgcacctaaagatgactgctttaggatgaggtaacccaccatcagctgccagagcaaactaagaagggtttctgtcccccaaagcccattacaggctctgtttcaatatcagacctctcctgatgagtacgaccatgtcactgcatttcacttctacttgcacacttcagcaatgaagagttcagtcacattaggaaacccaggccactatttaaaactcttaaatgttgtgttatttttcccggaaatgaatcacaatctggcctcctgttgtccccaccctttgatcctactcctgccatttaagtcacatagaaaagagtatctctttccctcctcctccacatgaaaacgtgttaaacaatttcatggctgtgttcctgacatcagaacagcctctgatagtttatcaggtctcctcc

SEQ ID NO: 233180 - DNA, 417 bp, Homo sapiens
agctcttaaaatgttagtttttcaaggaaaaaaggtaattcttgagcatcatatttcatgtcccaaagaactatgttgaaatgctagattttatgccataaacaagtctataggagccaaaacctcccctaccccttgagcaagaaaagatggtccgggggaaacctttgatatcacataatgtagccaggcagagagtattaaaccagttcatgcctggactggtagagtctctaatccttgatatctctggtgtcctttagagcatctgggccatccctgaactctagtcgggctgctgtagccactcatttggccctgctatacttagtcttttgggtgaccccacgtggccattctagtttcatctgtgcttccaatcccctgatgccccacatatacccaccatttaattca

SEQ ID NO: 233181 - DNA, 517 bp, Homo sapiens
acttcaataattgatgtgacagtatgaggttttctccacaaagaagccactcaacaggaataaatatatgtaagaattagcacagtcaagtggtagggagccccccatcatgccttttctgcaaactggtggcacatgtttatagaaagggagatgctgatgaaatcctaagtaagaatggaaactgagttcacaagaagataaactgaaacaattgcttaatgttaatatcatgtaaaaattacacacatttaacacagatttaaagacagggcaattttttttttcctaaccttggaatattaggagaaagactatattataccttacatctatttttgtgttcaaccacatttgtgacaactttataaaaactttccacaactttttaaaaaaaattttcacatttggttattatttaaaatttttggaatcctttaaagaaattaacatctgattaacatccaaaaaagaggcgtttggaaagttcaataaatatccactaattgttaaaaaa

SEQ ID NO: 233182 - DNA, 437 bp, Homo sapiens
agggtgagaggggatctgaccaggggtcctaaccttttgaaaagtcccgtttaaaggaaatagtctgggatatggggaaagcggggtgtgggtgtcgtcagtgcttcactgcccactgcttgttatggggatgggaaagagaggtccaaaggacggaaaggtcacacaagtggccttgagggggctggtaaagcaggaacagagtcaaattgtgcctggttccttcctgagtcccttggtgggtggcccagtggttctcaagcccttgctctgcctggttcatcaccacagcagtcactggggaggactgcctgggttgtaggggtctgctggcaggagctgcccatctcttctgaagaatccacagtttttctttgttttcttctacaattacaaaagcattaaattatctttaaaaataaataattcagataata

SEQ ID NO: 233183 - DNA, 332 bp, Homo sapiens
tctgtgtgtggtggtggaggattggcattgggagacatgggaggcaaagagctgggcctggccaggccaggcctctggcttccaagaactcctagttccaggggacacccagtgggggaagagctggctgctgggaggcccacagcctagggctggtcggccaagcagccagctctggtccctgctcacaagtgccctatggcttctaatgcatttctcttcttcctcccttgctgcacctgcagatgcagaagccacaccggcgagccccgccatgtactacctgaccagctaccagcctcctcaggacgatgccctctgcttccatcgtg

SEQ ID NO: 233184 - DNA, 311 bp, Homo sapiens
ccaggactggaacctagaggtgagctttcacaattctataccttttccctggtagaaggaggtaagaacaccagaaggaggtaaggacagcagaaggagaccagttatttctgactctagctggcttcgcatcttggagtttttagatccattttgattttcactgatatcaaaaccacttgtcctaacttactatgtagcacagtcaacttctttgaatgttgaacttttattcttaatcgggagacaaggacagaccttaaagacaaatgtaattagtagactgttaataaaatttaattttccttctt

SEQ ID NO: 233185 - DNA, 250 bp, Homo sapiens
cagctttgaaatcagataggtttggttgggattggattccaaactgtactttgaagttgtggtcaagtacctttaaatggaacttcaggtttcctgatccatgaaaattagctggacatggtggcacatgcctagaatcccaactactcgctaggctgaggcacttgagcccaggaggttgagcctgcagtgagccgtgatcgtgccgctgcactccagcctgggcaacatagactgtgtctctaaacaa

SEQ ID NO: 233186 - DNA, 491 bp, Homo sapiens
actgtgctgtcgttctctcacatggcctttggtcattggttcagacaggctaagaagacaaatggagatttgcagaagaaaatgtcatatgggttatcctggtagtctccagagaattaactgagtcatccacattatttagctccatctccatccttcatgtgataggaaacagagttttgaagtcgaggacataaggcagcatcaccaaatgctctccaggagagttgctacctctgccaaaggcaaaaaggagatagggaagctgccatagcatctgttggttccaggaagaaaccaccttgcctgtggcctggggatagaaggatgacacctcatctagttactttatgcatggcagttctgcactagcaaaaactcagaggccaacccccagactggagcctgaaatgttgctacataaaacccagtgtttccatgaccgagcttgccagctgcaacaacaatatcagcagaaagatcgcttctga

SEQ ID NO: 233187 - DNA, 417 bp, Homo sapiens
tattgtcgtttattacataattattctaccaggttgccatgaaataagcaactgggttttaagttttcagtagttatgtggagtatgtatgtagtcaggacctatttccatgttctgtgtaagtgttaacaagtccattagctttgctgaatttaatctctggatatgaaggagtagaaatttgcatccttctaaaaatgcatgctctgtttaatattaatatattaaaatttattaatttggagtcctcagatacgggaactaattttactgtctaggttgctctttggtagtatctatgagtaaagatgatacttgacaaaaataatttaataaatgttttagatactttactagtatgtccaaattaaattttccctattaaaagcatttgagcttctacttaatacattataa

SEQ ID NO: 233188 - DNA, 765 bp, Homo sapiens
caggcaacaaaacagacagtgtgtcctgacagctctgctgacaaaggtggcataaaagagcaaatgaatggagcagtagctggagtgtgggccagaggcccatttgggcatatttcctgacatggaagttcctagaacagtagaaagggagagaatcatacaggagaaagaagagtcctctaaaggttaaaggttgtgagcagcccagagagggtgggtcccgagagccagggcagggctggccctgcggagaagaggctgaaagactcaggagcccccatccacagccacatacagggcctctggagggaagtgatccgcccaagtctcctggaggactcttctcacccaagacatctgaagctgtcatgaaacaggcagagccgagcagtggggctgcggcaatgagtcatggcaagctcccggaggggatgtgcccggttactaacagagagcatcaagaaagttcttcacgggggtgtacagcaggagaagcagggtacaagcatgccacctgatcctgcagggcctgcccgggttaccagggcaggatgcagtgtctctctgggcctctcctgtcaccccaatccctttaatgtcttcttgatgctcccagcccataggtttgtctttcctttcctatcacctctatcaaaaggtctcttctattttacacattttgtcctgctgcttctccctctcacctgtatttctattttattttaatttttttgagacaggatctcactatgttgcccaggctgg

SEQ ID NO: 233189 - DNA, 366 bp, Homo sapiens
catgctcagaggaaaagcagagtgagctgctggcaaaattcctctgctaagtggcagcgtggaggccatgcgaaatgagttgcatgcgccatgaagagcgattgcggtgtgctgaagccacagatcatggcgcttcacacaggtgggttgagagtctgaagaggcactcagtaactgccagtaactggtttcctgtgcctgcctccttacctcgattcaccctgaatttgctgtgcagccagccccctcgatggcagccttgacacctggccgctaaagagggcacagtgcttccgcattctccccactgaaacccaggggcctcgcctgtggctcactgcccttttggtcccatcatattcccaa

SEQ ID NO: 233190 - DNA, 550 bp, Homo sapiens
tttttttttttttttccgtgacagagtctcgctctgtcacccaggctggagtgcagtggcccgatctccactcactgcaagctctgcctcctgggttcacgccattctcctgcctcagcctcccgagtagctggactacaggcttccaccaccacacctggctaattttttgtattttcagtagagacagggttttaccgtgttcatgtttgccaggatggtctcgatctcctgacctcaggatccacccacctcggcctcccaaagtgctgggattacaggcgtgagccaccaccatgcctggccctgaatacacaatttacatgtgagagggggtggaggaatagtcacttatgccttagactgcctcagtgactctacatttttacataaataggacaggggaagcaatcagataggcattcatctcaggtgtgcagagggatgggttctgtcccacacctgtgaagataagctattagtttacattggcagtgggaaattcaaaagaactattttagggtggagatctcgaggtccccagtttgtg

SEQ ID NO: 233191 - DNA, 210 bp, Homo sapiens
tctgaatgcagtgagtcgaaacgatttctacatgttttcccatggtttaggaggtgtctttacatacttgtcaatagtagcctgacctttttccccatggagttgctaagtgtgttttgtttgttgctttgagtacttttttcttgttgtttgtgtgtgtgttgcacaaaatacacaagaaaataaaggttttttttcttttattgctca

SEQ ID NO: 233192 - DNA, 387 bp, Homo sapiens
catgaccgggcttgttttccaggttaagttccttaagaaattgtaaaccaagcaagaaaaacaaacagacaacaacagaacacagattgttgtggatcatgcagcaggaaaagtaggacaccatttgagctgaccaagcatatgtgttctccgtgcagctctgtcgaagctgtgtaaggtgtgcttggtgctggctcctgccagatgctgttggcatggcttcatccacccagcttgctgttgggtaacttgcagagtgaagaagtctgttgttcacgtcatcaccacaaccctgaacatccaagcagttcatgtcaacaactagagtataattatcttctttacttgtaaaactgtggagcctgtggattaaattcaccaaaatga

SEQ ID NO: 233193 - DNA, 353 bp, Homo sapiens
gagaccgagtcagccttctggacttcccacctgctgggtaaaactcaagtaacatgtgagagccgcgctcctcaggccccaccccctgtgggtgattgatttctaagtaggggaagcccgccctcctcaggtcccaccccttgtagatgattgatttctaaagtaacaagtgagagccaagctcctcaggccccaccccttctggatgattgatttctaagcaggggaagcccgctctcctcaggccccaccccttgtagatgattgatttctaaagtaacaagtgagagttgcgctcctcaggccccaccccttgtagatgatggatttctaagcaggggaagcgcggccgc

SEQ ID NO: 233194 - DNA, 1317 bp, Homo sapiens
tgtagagagtccctaccagcaagaaggctctcaccagatgtggcccctcgaccttggatgtagcctccagaattactctagaagtaaggaaccaagcgcctcactggtggtgtggaagaactgggattccccacagtgcagtggaaattcctgggagtctcgaaccacatattttccatcgactacatccaaagctctgcaaagaacggaaccacagtcatgtcaatacactatgaacaatgccaaaatctcaagaaacccaaaggcatatttctccatgtattaatatatttccagtcagcccaaataatgaatcattcttcaaaacctacacggcgttgtagataatttggtgctctcatagcacatttataaataaacctggatgacttcaccctgtgcctaactgaattcttttaaatcctatgcagaaaacaaattagagatagatagaggtagacagaaactagatggagagacagattttggcatgaaagtaatccaatttcattttccagtttcctggttgttctatgtcgtggcttttaagaaataacaaaaagaaatttgtaagtttcctgaacactggaaataaagtgggaactgaatcccagttagagaaacaatctagactatgccaggaaatgggaactgttcctaggattataatatttatcagattcaaaaggaatggaaactaataaaggcagaaagaatgttttacagactctgatggttgcctaccccaaagccattccctttatccaacccttcactgttctcccacctcccccatacacactgcctttgctaataatcctaaatttgttcagcaattcatcctccatatgcctcagagaaagctgctcccagccccagtagtcagtcgggattgctctaaccctggtgtccagtttccctcaccagtaactgatttaggcaaatgcccatatgtaactgtcttgcttatgttaccacattgattgatgtctccctgaccctctaaaatgttcatactttgccctgcttctctggcccagtcctgaccaatgggatgtgagaggcgtctgctgaagaaatgggggaaaaggtcttctacaagaagagaaagtttccctttcctgcaggccagtgtcatgcctgcatgtgatgaatatgatagaacatcttgggaccatgtgcaggattagcctaaggagactagattgaggaaaaagcagagaggaaatacctatctcttgatttcttgaaatgagaagcagaattacctatctctggagttcttgttgtgttagataataaacgtcctattcttca

SEQ ID NO: 233195 - DNA, 448 bp, Homo sapiens
attagtatgtagtaatcacataacagaattccagaatcttatttaaaattctttgcccccaaatgaaaatagcgtttttttctggttgtagaaggaatttctatgttctaaacaataaaaacttacaattgaatgagtcccttatttctccaagagaaggtatcaagtcttttccataactatggaagaaatcaattttaaccacccagtatgaggacttctaaccatctccacctgtgaaattacttggaagagttcatcccttctctgtagaactaaatctgtaatatattttagaatctctttcagattcaggacatgaaatctttatcaaatttataatggtcagccaaattttttgcacttcatctgtcagtgttttcaagctttcgtttgtagcctccggaatcccttgtttaaataaaacaattttcagaagctaaatatg

SEQ ID NO: 233196 - DNA, 404 bp, Homo sapiens
gattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgttttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcaga

SEQ ID NO: 233197 - DNA, 509 bp, Homo sapiens
gcatcgtggaggtttatttaaaatcacagaaaggtagggctggaagagaaatctattaatagttacgtcactaatgcgaaaagtgagaaaaatgacttgtccgagttatatcagggtggaccccgggcaagactcaggtgcctctgctgtcagctcacctttcaagtttctggtccccactcgcacccactgagaccagagaccgatttacctgaggcagaaggtgctgcacgcattcttgtgaaatttgaggggaccgagaaggaatctcaggaagtttgtttacactgggggcctggagaccttcgggaaaatagccagaaccaaaacggaccagtcagcagacgcagacacacacaaagtgacagggacacagaagcagaagctgaactgggcagagcgggcagcggccgacccacctcgcacggccgcccccgccagcgccaggtgcagggctcatagcgggccagcagagggcgcgccgcccccagggagccgagcggcggccg

SEQ ID NO: 233198 - DNA, 114 bp, Homo sapiens
gcgcacagcatcacttctttggcatttgtgccaaaaatgcatatcctcaatctaatactgagaaaacatcagacaaatccaaagtgagaaatgtcctataaaatagctggccag

SEQ ID NO: 233199 - DNA, 190 bp, Homo sapiens
gcattgcagtactccctgattcacaattcatcttggcttttgaatggattgatcctgacagtcatttggtttatcaatgaacttggacagttcttccccaggtatttaggggcagcccttatctgtttggaaatgcattggctagagaattaaggatgttacacttaaataggggcattattatccaata

SEQ ID NO: 233200 - DNA, 515 bp, Homo sapiens
tggcatattttggggtggcatttcctgaacattttcaggaacaatatgtagccgcagaccttaaacaatggtctggctgtattccaataaaacttcatttacagaaacaactcaatactcagatttggccctcaggctgcagttttctgaccccagtgtttgttagtgaaaaaggaagatacggtgaagatctctacctatcacagaacggtgagaagagtagtaggaaatactttagagagagggccagatgttagatgtatcaatctgcttaccatacagattatgcaaattattctaattgcaatggaaagaaactggagagttttaagcaaagagtgacatgttttggctttgttttaaaagagggctgcgtgtagtgggtcacacctgtaatccgagcactttgggaggctgaggccagcagatcacttgaggccatgagttcaagaccagcttggccaacatagtgaaacccctagtgaacattttgctgcttagacatttctctactg

SEQ ID NO: 233201 - DNA, 446 bp, Homo sapiens
gatagctcttatcttgtgctactcaactttctcttcccttaggatgagttctttacaggaaattcctcagtccctcatgcaatggagcccagataagatggctttagaagccatccagacacacctgaatcctagggtgactgtggcccaggcccaactgggatccaccaccaataccttgtattatagatgatccacattctgaagcacaaagatggcacaagatgaaacaatagattgttatccccatggggtttatccttattatttgacctcgctacacttcttttgactgatcgacagccttttcagacaaacaacctgatattaaggtaaatattttattctttaaatagaaataacaaatgcatttttgttatagattactaaatattgaactgtatgactttacaatatttcactactgtttttagcttgcaaaaaaa

SEQ ID NO: 233202 - DNA, 580 bp, Homo sapiens
actactcttattttcaacacatttggtcttgcttatcttttttatttttatttttgttagcacagagatcatatgtgtccatgaattgtggatcgttttgtcattaccatgtctctgacaatatgtgtataattaatatgttagctctggagtcacattccaggctagcatgttagagccgtgcagcttttgttccttaaggggtgacaaaacttgctgtctggcctaacagataggaaatcctaaagccattctaagaaatctcttactatgaaatgttcccctttgatttaaagaggatatcaataaaaggaatgatgactgaaaaaaacattttttgttcctaaagataatttttagcagaatagttgaaaggctttaaaacttaagtagcagctctataagaagaaaaatgctttgtaaagggagttgagggctgggcgcggtggctcatgcttgtaatcccagtactttgggaggccgaggtgggtggatcacctgaggtcaggagttcgagaccagcctggtcaacatggtgaaactgtctctactaaatatacaaaaattagccaggcgtggt

SEQ ID NO: 233203 - DNA, 345 bp, Homo sapiens
agagtgcctttgtggatttaaggacaaacctcatgcttgcaggacacaggcagggccttgaactgggttgtcatgcaggttggaatgttggtatcaaagaacaagagtcattagcagtttgctaatgtggttaagaatattgtcagcatcatttacagatgatgggaacaatagtcactggggactccaaaaggagggagggagagaggaggggcaagggttaaaaactacctatcaggtactgtgcttactacttaggtgacaggatcattcataccccaaatctcagcatcatgcaagatacccatgcaacaaacctgcatatgcattccccgcatctaaaat

SEQ ID NO: 233204 - DNA, 869 bp, Homo sapiens
ggtcccagggtccacggagccactgggagagaaaaggagtctggttgggtctgatcgaaggacactgggacagcccaagaaagggacccttccggcccacagccctctccgaggccagagtgagggagccggcaggggccgaaggagagcgaaatgggcccgctccccggggctatttttagtctccctctttctctgagaaactccccccgcgggcttctcacgccccaggggcagcagcactgagccgccgaggagcctactgagccggagagcctcctccagagcccagaagagcggagccgggcgcctgcacgttgcaccggggtcaccagtgccatttaaccctcgagtggctggcgggaactgggcaaccccccagggggaccgattggaacttttgagtccaggtcttcagtctgacaaactgaggctcaaagctggggtaggacaaagggttgcagatgagcagcaggtgaagcctgggacactcaggcagtcaacttgaactgtcctccctggcttcagagattcccccagcccccaccccccacaaggaagggggatagagttggggtggaatgcagaaggaacagagctgaagttgaagttgggaaaggcgggatgagaagtctgagggatcctggagcaggcccaccaagcccagagggacagaaggctacttgtggccttggtgtggcctggggggctgtacttgagactcattttgtccaaggactataatattgcatgccccgacacctgtggggcacagaacatgctaaaggggacactggtgatcctcatctctgtccccatcattgtagaatttcactctacagcttcccaggccttacttgtcctgacat

SEQ ID NO: 233205 - DNA, 535 bp, Homo sapiens
catcactttgggagtcctaggctagaagattgcttgaggctaggagtttgagaccagcctaggcaatatagtgagactccatctctccaaaaactcagaaaaattatataggtgtggtggcgcatgcctgtattcttagctgcttggtggctgaagcaggaggattgattaagcctgggagcttgagactacagtgagccatgactgcacccctatactccagcatgggtaatagtatgagaacttttttaaaaaaaattttaaaaaacagggtccggtttggtggcttatgtccataatcccaacactttaggaggccaaggagagtggatcacttgagcccaggaggtcaagacaagcctgggtaacctagtgagaccttgtccctaccaaaaaaaacacaaaacttagctgggcatcctgttacacacctgtagcctcagctacttgggaggctgagcctaggagatcgaggctgcagtgagctgtgatcatgctacagcactctagcctgggccacagagcaagactgtca

SEQ ID NO: 233206 - DNA, 573 bp, Homo sapiens
ccaacactatcatccacctaggtcagtgtaccttcagctgctgagttcactattctggctgttttttcttcacttctggcagctgggatttcctttttcttttgtggttagctgtgtgtatatttgttgttttctatgacatctctgtaagtttagagttatgggattgtggtggtaggataatttatgttagtcagaataagtaacctatatagaagttcttcacccttccaggaaatcctccaatctatgacaaatgactacttaaattgccataaaaggtgaattgtaagtacaataatccaaataaaactttgattttgctcagtgacaatatgcccagcaaaaaaactatgtttctcagcatctcttacagctaaaagatagccatgttacgcagttgtggcaaatgagacataagctgggagtttctgaaaaagctttgtctttgtgaaaaaggcagcaagactcaggggttaaaaaaaaaatcttgtttaagctactgtcttagagttctctgttacaccatagcctaattcaatcactagctgatacactttgaagagcagatca

SEQ ID NO: 233207 - DNA, 348 bp, Homo sapiens
ctgtggaacatgcagacatgattatgatcacccaatcaatgttttattttaaagataaaatttaaatgtttttctccagctaacatcaaacaaaactaaaccttcagaatatttttaattaactttttcaatactttatttgcatttaaaattaaataaatttagttgtgctacttttatacaatttagtgattttttttttaattgactgttttggtctcctgtcagtaaaaatacgatgctttgtctcaacttgcatcttctctcaccccacaaaaggacctcaggatgctaagttcactctttagaaagtcatcataatgatgcagctgggaataatcactgtat

SEQ ID NO: 233208 - DNA, 332 bp, Homo sapiens
tcaaaaaaaaaaaaaaaaaaaaaggaagctttgcactcaaagaaggaaattttcatctttgaccagatcccaaaggcccatttccaccccaaagtatcaaaacgcatatatcctactaatattaatagtttattgagcaattaagttccaggcacccagttaagcctctcacgtggactgcacgatgaaattcataccctcattgatcctcactacaactcagaggtaacatggaattttactgaggcaaatggtgggacctggattccagaagcaatactatttgtgtgaaatgtcatgtcactgtaaaagtctgttagggattacccaaa

SEQ ID NO: 233209 - DNA, 263 bp, Homo sapiens
caaccaaaaaaattaacttgaataatatttaatatgaaatccaattgccccaattcccaatcggaagtactgctgacttccccaaagataacttctaatttggttacttcgtttgttgctccatgatcaaccaaggccacacactgtattcagttatatctctttagtggtttcaatctaggacagggttccatagactttttcttaaagggctgtattagtctgttttcatgctgctgataaagacatatccgagactgagc

SEQ ID NO: 233210 - DNA, 378 bp, Homo sapiens
tacagcatgaactatgttgttagatgttgtcttgttcaaagccaggctgagtctttgatttaatgagatggattcctgcacagaaatgcctagactcaggtgaaatcacatggtattcgatgtaactaggaggagtccatgccttcctgctgtattcttcctgctgtattcttatgtgaaccttactgatgccaaaaatattaggctggctgctttcctccctctgctgcagccaggccacctgtacccaggccttctaaccaagcactgtggtttgggaaccacacatgcggcatgtctggctctagacaaaatcacttgtggctgactctgtaactcttgacaggtgcaaaggcttagacagtgctaatcctgaga

SEQ ID NO: 233211 - DNA, 333 bp, Homo sapiens
taaatccatcgttttttctccacttttttctgcatcctttttaggccatattaccattacagtcaagcataattgccttactggtttctccacctgaattcttatctctcttcaacccattaaccatgctgctgttggagactttttcttttcaatgtaactcagatccaatcgtgaatctttccagattaaaatacttcaaagacttcttgttgttcctgggataaatccttacaaactactgtgatatctggcccatctctaaaccttctgcatcatctcttattttccctgttctctgtcatccaggggcattggccttctgctttctgc

SEQ ID NO: 233212 - DNA, 1590 bp, Homo sapiens
  misc_feature (979)..(979): n is a, c, g, or t
aaatattatgtctttcaagtctatttttttggtaagtcaatttttgactaccctttctttacttattgtgccctgtgaactcttccatgtccatacccattcattgtctataatcttggcactttcttattcattaattcaacaaatatttattccctatcacctttatttatgcatttctatagatgctagagatagggtaaataaaagtatggcaaaaccagcaattacttttgcaccaacctaatatgattttttaagaaatttataatttcattagagaaatagatgtataaacaaagaaattataatacaaacattgtgataagtgcaggaagtagaaaatagtgattattgctttcttcaaacataaagtattgttagtcaggagtccttcagttgtaagtgccagaaacccaatttcaaacagcaaaagcagaaaatggaatctattggctcgcatccctacaaattccaggaatagaactgtgctaagggactcaaataatgttgttgggtcttcatagcttattctggtttatttcttgcttttggggccttgcttttttcttctgaagatggactctgaagtgaattctacagcacactacccagatgccttatttagaatcgaagcattggtttccttcaggttttgggagtgttggctgctgatggctcatagttgagtctctttctgagacaaagggaggtgtctcactcaagtttatccctcctccctgagaatagcttgaatccaaagactgatcaatgagggatacaaagggctggcctcttgccttgattcaggacgtacctaaaaggccatccagctttagagttacccatgggaacagttcaggaatctgaggaacttaacatctgactcttggaagaacggttctgtggagaagagggttgagtttattttttttattctggagatatagggatgaaatggagagaagtaaagaagagnaaatatgaagggaaaccaaacaactgtttgaactggtgaaagactaggcaccttgccctgtgactcctctctagaaccctgcagacttttatcaagtatttggctacaagcaagttttttgtgaaaccagtggaagagtctgttcttcctctctcaactggcctaggatgggatggaactgtagagcacaggcatatttaggagtttagagacataattctgaggaaataagttctagaactttgcagaagcagtaggtagggctatgaactctatacattgtaaggtttgacaggcaaacatctggatgtatctgtcacagcaactaatgtcttagagaataaggtatagcttcaccaaacatttgaggaactagtagtaaaagtaatcaatgctaataaatgacagtataataaaatgaaggcaaagtgccacaggaacagaaaggtcttgaacagctaaccgatatattaaagaacaaatagacttgcccggcatggtgctatgtatctgtagtccaagctacttgggaggctgaagcaggaagatcactttgaacccaggagttcaaatgcagcctgggcaacatagagagatcctatctctaaaat

SEQ ID NO: 233213 - DNA, 719 bp, Homo sapiens
ggcgccgccggcgtccctgggaagctgagcgccgcgtagcttcgccggggggagtggggtaggcgcggtgaggccgtgggcccccacacctggcggaccacaggggccagaagccctggagccccgccagggaagggctgcgtcgctggccaggaccgagcgcggtagagcctcagctgctcacggggtcgctggagttgggggtggccccaggagaaattaaaggtgaaaagccttagcagcagagggaagaggaagatggaggcagagcgagtgaccgaacttggaagggacagccgggcgcaacagggcagggggcgtctgactgttggaaacatggctgacgtctggaggctgcagccagtggtccgtaagtcaggtcaaggacccacagaagaccccagcatgtcttcacctggcccacagaagccctgacatccagttacaactgccccagcctagtgagcatttcggcacccactcctcaattcctacccccagcctaacttcgaaggggcggtgagccacagcaagccggaggagaaagttggaagagagagtggacaaaagaatacccacaggcaccttccccacagtggaatagcggggttttagacaatcaaggataatcacctcttcctatcccagttcagaaacggatgaaaaagacacagcaataagatgggtgggtatcaaaatatcagctttgccacaaatta

SEQ ID NO: 233214 - DNA, 535 bp, Homo sapiens
ctaatctagcttattcttcctcctatctgtcaaactcggcttcactatcactttctttgttcccgtcaacactctttgctcaccttagactcctatgcttatttatcattcatatagtttaaatatttatttgtataattatttaatgcctacccttcttgtattctactgtatccctagtgcctagcaatgccaggcacctataaaataataaatatttgctaaacaaataaataaatgagagttgaccagtcacggcagctcacacctgtaatcccagcactctgggaggccgaggcaggtagatttcttgagttcaggcgttctgagaccagcctaggcaacatgttgagaccctgtttctacaaaaaatagagaaaaattaggcgtggtggcttgcacctgtggtccaatctccttgggaggctcaggtgggaggatcgcttgagcccgagacgtggaggttgcagcgagccaagactgtgtcactgccctccagcctgggcaacagagtgagaccctgtttcaaaaaaaa

SEQ ID NO: 233215 - DNA, 273 bp, Homo sapiens
cccactgtacttacggcattttaaagtgttatcttccccaggcttagaaacctgaacatgacagaggcaaggattgaagtttcaataatatgggagaagctagctgggtatgagtaagagtgagtgggtggaggacatcaattaaaggatgagtgtgtagaaacatatcagttttctaaccatggttgtttctaggatatcccaagtttatggtatctgcaaattcttgaatttcagtgggggaaagaagagaacaagatatttaaaaaggca

SEQ ID NO: 233216 - DNA, 274 bp, Homo sapiens
gtgggatgggcagaaagactttgagggcaggcggaagaatgggacatcaaaccaccttccccagggtgggcagccagctcctcactcatatctgccctggggctgcaaagtcctgccatgcccaccgaccattcccttggagcactgtacttaacctgcagtgccctgggaatgcgcccaccctgtgtttctgggagaaagtgaggtctgtgtgcacattcccagggcactgtacttaacctgcagtgccctgggaatgcgcccaccctgtgtt

SEQ ID NO: 233217 - DNA, 390 bp, Homo sapiens
cctttcctgaactattctgctagattcagacttcaaaaacattgtatcaggaaatacagaaatgttctttcaaaatgagtgtatgggaatgtgggaatgcctaataaaatctgtccttattgattcgttagcaaaaaatcatataaatcaatagcttgtgattgcaagcagatatatttcagatcctttctgtgtttgttttttgctttcttgatctatcacaattggagaaaacttaaaatttctcaatggtattgtatttttgccaatttcttattctgctttatgtttctcgttgctatattattgggctataatggtccataattacttaagaatcattgtgaaatatattgcttaatgacacaagtaaatctttttcactgtttg

SEQ ID NO: 233218 - DNA, 373 bp, Homo sapiens
atctatagcctgagcccacctgggttgccctaagttgtctgattcacatccattctaattccttggcttctctcaaccatgtctgctccttttcctcctcttggccattcctgagtgtacctggatcactacagcagtatctatgctgtttcctccttttctaggtgaccatttgtccttctgccagagggctctgtgggaaatacagattcgatcctgctgtttcttactgggaaccctccatggctcccagtccctggaatgtgccgggcaactttcagctcttggtcgtgggagcctcctgcctgtgcacagtgtgttcttccaggacccatgcccactccctccttcccagcattccagtttggccctt

SEQ ID NO: 233219 - DNA, 468 bp, Homo sapiens
gaggaaatctgaaaataagacttaatcatcaagtcacttatagactgatgaaataattaaggaatataatggcctggcaatgactaagtcgttctatctcctcattgcaggtacatgcttatcacttttttctctcttaacaacgtttattatgaaatggcatgttttcgccacagcagggtagccatttcccaaccctggagcactcttaattctgagatgcctgattagagcctcaggggtcccaaaagatgtgctgttttcccactttataaaattacattcttttctcacagttgtcacaaacatgatattggttgataagaactttggagtagttttaatgactcttgactgcctgaaagatgccactttaaaaaaggagctacttttagctgactctatttgaaagtaaatgattggaccctttttatgttttatatgaagctttgtttccatttgcttaaa

SEQ ID NO: 233220 - DNA, 193 bp, Homo sapiens
ggatgtagggagtcatctctctcttgctttggtactatgactattgcctcactcaaaactgagttaaaaataatctcggctgggtgcagtggctcatgcctgtaatcccagcactttgacaggtcgaggcgggagctgagatcgtgccactgcactctccagtctggtgccagagtgagacaccctctcaaaa

SEQ ID NO: 233221 - DNA, 273 bp, Homo sapiens
tgccgttgtggctggcagatggcagaatgaccaggaatctcatctcaaaacagtgttttcatgagaaaatggaataaagcatttcagctcataccttgacctaaaaagaactctactgccccattagaaaaaataaaattaagaagttataattaataacaattttttttttccaagatggagtctcactttgttaccaggctggagtgtagtggcgtaatctcagctcactgcaagctccgcctcccgggttcaagtgattctcgtgcctca

SEQ ID NO: 233222 - DNA, 421 bp, Homo sapiens
agcatctgatgtaaacacttgtggggcgggtgggagattctccgggcgcccctttttatctgcctagacatttggctgtctcattaatattaagtaaacacctgaaaacacctttctggtagcctcgaaaatcagtgaacacatacacatcatattctaaaaccaatttgttgatgataaaacatatcattatccaggagagtggattgtttgttctttcttaacaacctcctgatgtgtaaatccatcagccaaagaaaactgattgtgatattgactttttatgcagatatgctgaaaatggaactgggtagaaataaagtttgtatatacttttgatagttcatgtatttgtttattttggtgtgtttgtaatgcaagttttcatttatcaattaaatttccttttaattaaattagt

SEQ ID NO: 233223 - DNA, 446 bp, Homo sapiens
cagtcctctattgggggataggtgctagtggccttcagagaaacctatttatgtggccagtggtgtggccttacctgcagtaaataaaaaaccttcttggtgtttcatatagaaaatcagccattgggcggggcattatttacggcatttttttttcattgcacacaataatttctgacctatacatgtataatacagcattttcttgtttttctttttcttttctttttttttttttttttctgaaatggagcctgggggacagagcgaaactccgtctcaaaaaaaaaaaaaaaattagctgggcatgctggcaggtgcctgtaatcccatctactttggaggctgaggcaggagaatcacttgaactcgggaggtggaggttacagtgagccgagatcactctactgcactccagcctgggcaacagagcgagactccatctt

SEQ ID NO: 233224 - DNA, 113 bp, Homo sapiens
gcctttccactcttccaccttgtgaggacacagcaacaagctgccctcttggaagcagaaagcagctctcaccagacatcaaatctgccagcacattgatcttggacttccca

SEQ ID NO: 233225 - DNA, 1258 bp, Homo sapiens
ttgtatatttggattgctgctctaggttgaccctcagctaaagaaaaatgcttccttatttagttttattctgcctgcctgttagtttgaaaggtaccacttgtttgcttcatgcagtttttttttttttggttaaactcagcctctatatgtgtttatatgctttcatattttcttcaagtcacttctggattggtaattcacgtaccagagtggccgatgccatatttcttgtttattcttttttttcaatttcatggccttccagcagttttctgggaatactttctgccagttcttgtttacttctctgtttatatgcgtcggtattggaatgctagaacgttaaagtacaaaatatagaaaatataaaatttctgttcatacttttacatcttaaactggaaagacatatctcacattttttaaccatttatgtgttaggtgatatgctaagttcattattcatgttacttaatcatttacaacaactctttggcgtatagatgccattttactggtgaggaaactaaggcttacaaggtgatgtagttcttttttaagggtcatacacttagtgaaagtgaggctggaattttaaccctgatagggtgaccctagagtgcagttacccgggtatactctctgaggagtcctgtatgaatcacgtcctgggaatttttccaaagtgaaatgaatgcttctggaagaactcagcacaattggcttgaattcctgtggaaattttgggcaaatattggaaccagctggaaatatagtaatggggtatcacatgccaaatctggacctgaccattttagcctgatagttgacgggtattagtaagatgtgtcttcaaacccttatttattctcattggttacaataggtactatgcaggatgcactgtggaaagtaagactggatatgagattgataatgctcagtaaattgtgatgatatgtaattaacaaatgtaagagatatgattttcagtattgtagcattgtgtccaagtggcaattttttttttttttttatatggagtcttgctctcttgcccaggttggagtgcagtggcatgatcttggctcactgtaacttccacctcccaggttcgagcaattctcctgtctcagcctcttgagtagctgggattacaggtgcccaccaccatgcccggctaatttttgtatttttagtagagatggggtttcaccatgttgggccaggctggtcttgaactcctgacctcaag

SEQ ID NO: 233226 - DNA, 439 bp, Homo sapiens
ctatatgtggactctgaaagagtggaactcacagaagcagagagtagaatgatggttgccaggggctggggttgggggaaacagagagatgttagttaaagtatacaaacttttagttataagataaataagttctgggatttagagtacagcatggtgactataatgaataaaattgtattttatacttgaaatttactttaaaaagtagatatttgttgttttcatcacacaaaaaagtggtaactatgtgaggtgatggacgtgttaattaacttgattgtggtaattgttccaaagtgtgtacatatatcaagtaatcacattgtacattttaaatagacacaattttgatttgtcaattatacctcaataaagctggagaaaaacctaaaataaataaatgtcaacctcttaaacaataaaaatgtctaatgta

SEQ ID NO: 233227 - DNA, 118 bp, Homo sapiens
tggtcataggtaaacaaggggggatccttgagtcttacctaactcaagggtgggaggattttttaaattatagctaataaggagccagcacagggctcaagcaaaattcaacttgcca

SEQ ID NO: 233228 - DNA, 410 bp, Homo sapiens
gggaggtccccatcccccatgaacaatccccaggcactgggggtcctgagatgtctgagactcagcccctgctctcaaggagctcagagtccattgggagaaatagttgatccgcagcatccagctcagaagggttctgttctagttgtgtggcctggcccccttaacctctctaggcctcagtttccttactaatgaaatggatgggggataatatagggaaggattaggtgaaataatgcatgggaagtgcttagcatagtgctaagggctcaataaattatcactgtcattattaatggaagcccaagatgttctagaagcataggcaaggagataggagctttgcgtgagggagtctgtagggtgttggggggggctggttcctggaaggagggcagggcagtgga

SEQ ID NO: 233229 - DNA, 332 bp, Homo sapiens
atccatggatagcatgtattagaatatcatccctccttaagggtgaataatattccatcgtacatgtaactacattgtatttatccattcatctgtggatggacacgtggacttttttttcgaatacctcaattcactgtcaagaacacaggagacttctaactgatgagagaaatgagaaaaatgatgtttgaggaggatgactttgacagctgtgtttttccaaatcagatctcagaatatatgacctgttttttataatttgtgaagttaattatttgaacagtttcagaaagctatgaaaaataaaatgaagttttatatgtaatgaa

SEQ ID NO: 233230 - DNA, 569 bp, Homo sapiens
attaccttgattctcagactattgcatttttagtatctgtggtgtatctttctccttttctcttgctgttattgtttatttatgcctattcttaaagttcattcgccccagtgtattatagttttctattttatgtatttcttgattatgtttgttattttttcttctgattattttgagttactctttctaaattctttgtctagatctttaaatacttaactcatttatatttagtctttcttgatattgaatagatccatttaaacttacctgtaaatattttatctgcatctcactaattttgcagtttcagctgtcttttcattggtgttctatcctaaatactttgtaattctctcactgttattttcctttggattatgttatttaggagtgaatgttctagagttctaaatatatgatcttttatctatcttttaatttttaatttctggtttaatttcattacagtgagataacatagtcgctatgatattgaaactttgagatgtgttgacatttgattatgatacagttaattactgtaaatggcatctttgtacttg

SEQ ID NO: 233231 - DNA, 157 bp, Homo sapiens
tctacaaaatcttagagaaacgcataaaatcaaggcagctgttattcttcaatggtctgtgtgagtgtgaacttcaactttctctacggcttgtacatttaataagcagctatttaacttacataaaagttaaaaaataaaaacaagtttaacaatt

SEQ ID NO: 233232 - DNA, 876 bp, Homo sapiens
cttatttcgggaagatatatttttgtgtgaagttcattgggaaaaaggaaaaactagagacaaaacttgagacacagttacaatagtccgggttacaggcaaccctttcataaccccctcctggtgattctcatgctcacatttgagaatgcttctaagaaattttaggaagaaaagaggagggaaaggaagaaagatttgtccatggtcatttagtggccactccatggcttgattctgaaaacggagaagttctgagttaaaagacgtgttaactgagggaagaaggaagaaagagaaaagatgacaggaggactctcaccttggcaagggggatgatggcagtgacactggtaagaggtgagcaggaagtatagtaaaagcacaaactcatcctacaaggagaaaggtatcgacattagtggaaacagaagcagttagaaaacttaggataaactgtgtgcatcaatcagactgtataggagagaaaacacagagaatggcaaaaaaaaccatcttcatatctcaaaagtgagagggagtcaagagcacaggggcagctccagttagttggattaaggttctagaccaggccgtactgcacagacatcactttctgttgtcctgctactgagtccctctccctgttgcactgacattatcaaaccaaatgcaaatgagatgaaccacaataatgggcagaactgcacctggttcagcacaacctggtgaaggtcttaagaggaggggaggtggggagtggaggatttttgccacacccaaaggggtgagaccacagaagaaaaaattatttacatagaaactcaggccaatcctttcgtaagtactccaggactattgcttctcttgatgatt

SEQ ID NO: 233233 - DNA, 488 bp, Homo sapiens
ggaacctacctgaacctccgtttcctcgtctctaagttggggatgatacaaattacctctcagaaagtggtaattattaattaagcgggatcctgtctgcaatgcctctggcactggagggccacgttagcattcactgcctgatttcctgcctgcctgccaactctaggctcagcagcctcagcctggggagcctcacttggaactaaattacatctaaacccagagccatcctttagctgtgaagctgacaggggcttgcaatcctgcctgtcagccttaagctgccacacatctgaacacacaaactgaaaaattaatgtccctggaaggcattgtctcccttcccatagacaccactgaccttgcctctctgcacagcagcggaagccggagctcctgctttcactgtctgggtgaaagcctcagcactgcagggctggcaggaaacaggaaagaggctagcattctccttgcatctgagggca

SEQ ID NO: 233234 - DNA, 238 bp, Homo sapiens
gtcggcccacagcttcctcaagccaagctccccaggcccaggtcaggcctcacggtggcctctccaggatcagctcctgccctccgatggcgtctccaggccccaaacggtctccggtcggtgggctcctccgcgcccagcttgggcctcctggcgacctctgcaggcccaagtcgtcctgaagtcagcgtctcccggccctgcctcccagcaagtaagcaagctctttgggctcaac

SEQ ID NO: 233235 - DNA, 405 bp, Homo sapiens
ggaataatgcagagtagttgagaggaagataacttttctgttagacaatcctcaccaaaaagacggggagggggagaaccagcaaaacaaaaacttttccttttttgctgaccgctgctataacaatcaagctttacgggacagttaatccaggtggctccaccaatacatcttctcccaaatttctagtggctgaacagcttctagtggtttccactagctgaaactgcttcccagatgcaaaaactgcaacttgaacatgaaacacggaaactactccaatctcatcttctagaaatcagttattcaaatggaggtccctgttggaagaaacacgctcctagctccctgcccacacaccattcattaggaaaggtcactttaaaggacttctacggcaggagc

SEQ ID NO: 233236 - DNA, 165 bp, Homo sapiens
attttcaatgtgtcacagacaaaagcttttgcaaaatacaacaaaaatgatttactaggaaaattaaatttttaagcccattaacagtataactggatgtcatggcaacaccaaatgttataaaagtctgaagaattcttattctcaatgtcatacttacctcat

SEQ ID NO: 233237 - DNA, 485 bp, Homo sapiens
actcgctggccagcccgtgctgggtgacaagaacgcactggtaaactgggcagacgcagccccctacttgggatacggcttcattcctgcatcacagacttggtgagcacctcctcagccctggaggcggtgccaggcactagagggtgtctctgcccttggggagctcacagacattaaagaggccattcttggctggatgcggtggctcacacctgtaatcccagcactttgggggggcgaagcagatagatcacctgaggtcaggaatttgagaccagccttgacaacacggtaaaaccccgtctctactaaaaaatacaaaaattagccagacgtggtggcaggcgcctgtaatcccagctactcaggaggctggggggctcaggcaggagaatcgctttaacctgggaggcagaggttgcagtgagctgagatcacgccactgcactccagcatgggcaacatagcgagactcccatctc

SEQ ID NO: 233238 - DNA, 124 bp, Homo sapiens
aggaactgtgaattgagggataagttgttgccagggtgatgattggaggtagtccagctggttcagtcacttcttaatatttaataagccctgagagagataactggcctcagttactggcagg

SEQ ID NO: 233239 - DNA, 1577 bp, Homo sapiens
  misc_feature (955)..(955): n is a, c, g, or t
  misc_feature (993)..(993): n is a, c, g, or t
ctcttggtttttgttccagctgagcaattttcattgccgacagcacaacatacattaggataaagcaaataaacaatgcaaggcacttggagccaggaagtcgcatctcagactagaaacacatagttttctattgacatttgggaggtgggctgctaaataggcgagccagccaccaaatagaaaaccagtggccatgaggttcttgcacttctagggaagccatttatttaatcgttagatctttgaaaggtgtctgaagttgattttgatgtaacaacagccagtttctttgtaattaaatattaactcaaaactatgtcttgggtaactgttaacctttgccatttgttgtttgccttagacatgtaattaacattcattgaatttaatttgttgttgttcacgtcttttattaactcatacacaattacttgtcttctgtttttaaaaacttttttgggaagacagggtcttgctctgtgcgcaggctggagtgtggtggcttgatcttgactcactgcagcctcgacctcctgggctcaagccatcctcccacctgagccttccaagtagctaggaccacaggcgcgcaccaccatgcctagctaattttttattttttgtagagatgggatctcgctatgttgcccaggctggtctcaaactcctgggctcaagtgagccacagtgctgagccttgtcttctggtttgttgaagcagtaagtcagacaatatttgccacaataatgtctgtcaattgtttgtggctggccataaaaactccagcatcacattcatctgaaggacactgctaatgaaggccactcattttgctgttgtcatccaccttattgtatctcaggacatccagcttaatctttttctattatgtttattcttcttgggagtggtatgactacttctatgaagtcccaacacaagatgaagagnggactccttttgaatgtgtagttagagtatgttcatcnttcagttgcttgccagcaaagatcagtctctgttgatcaggagaaattccttctttattctggatcttggcctttggattttctgttgtgtccaagggttcaaccttgagagtggtgctcttcctgtaaggacttttatgaaaatctgcctgttgcttgtggctccatcccagatggtggatcagaaaactgaatttcctattttgaaacaaatttcttgttaatttaatactttactttgaaataatccatgtaaatttggcatacatatttttaatagttccttattttaaaatatgatctagacctggcacggtggctcacagctgtaatcccagcactttgggaggccaaggcaggcgggtcttgaggtcaggagttcaagaccagcctggccaacacagtgaaacccgtctctactaaaaatacaaaaattagctgggcatggtggcgggcacctgtaattccagctactcggggggctgaggcaggataatcgcttgaacctgggaggcagaggttgcagtgagccgagatcgcgccattatactccagccttggtgacaagtgcgaaactctgtctc

SEQ ID NO: 233240 - DNA, 336 bp, Homo sapiens
taatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcga

SEQ ID NO: 233241 - DNA, 471 bp, Homo sapiens
taacccctgtttaaaaataagaaaactgagtcttgggaaagttaagtagcttgacctgagattcacagtttacaactacaaaactcatatactatattttataacacactgtctcttactcttactatttaaaaaaaagagattgttttaaaaattgattcatttaactcagtgaatgaagttgaagataaattcacaacagaaccattgatttgaactcagtgaatataaaatgtttaactttattctttagatcttagctttttacttttcacattcctttggtaattattctgtatcttaatttttaaaaaaatcatgtgaatggacagacagatagatggacagtatgaccgatagacagacctgtccctgagtgtgagtgtatgtagaagagtccccctgtcaagttatgttataaaagttcatctgaggtcagatattgggaataaagtttcatttttccatcga

SEQ ID NO: 233242 - DNA, 343 bp, Homo sapiens
ggaggtaggggtggggtgctcattcaggaggaaccatgcacactccattcaggatgtggggccagatctcagtagaatcacagtattagaaagagatgtaggaatttgggagtcatctacagtgaagtgacaaatctctttcaatggtgaatgggtgcttaatttgggctgaatataaaaaaaaagaaatcccttattttaatatttttgaaagaaagttattttggaaaaaacaattgaacaatatgacttcttcccgcctgggtgataggctcttttaatcgatatgattttttcagcctcttatggcaaacatttcttggaagaaatatacaaaggagaa

SEQ ID NO: 233243 - DNA, 191 bp, Homo sapiens
ggaagcagaaagggggctgagttgattcagagtttttggataagtagaaaaatgggcacgatttccacagtaaccagttgttaagagctcctgagacagaagacagcaaggcccataaaaagcagtaaagtagaaggcagatttgggaaagaaagcattgttgctaaggggctagaaactggcagggacac

SEQ ID NO: 233244 - DNA, 3822 bp, Homo sapiens
aacggtgtttgttatgttacattttatctggcatttctggctctctagttggctatagcgctgaaactgaacatctcctgggttcttcatgctgacagtttaagggaaataagctctgtgataagcagaactagaaaatccaccaggaacaaggctctggcgcttgggaagggacttggattccaggccaggcactgctgcttcccagctgtgtggcctcagggcagctcacctgacctgcacccaggttgtgggggctgtatggttacatgtgagctctttgaaaactggcaagcattttgccaatataaagaacgacttctactctcagtagcagtgagaataaataggaacaacaatggctgtttgccatgcagcaggtgctcagaactatctgttgaaataacgagaactccacccctgcagtttgaaggcaagcaacccgcagggccccagagaggagccacaggaggctccaggagactgcgcaaggcccagaatggatgggcaaggcggggattcgacttggctcttgcagaggcagccaattggccctcatccagccctgccaaggcccgtgtggcatgggcaggcttcatggcaattctctctccaggtctgcccctctggcccagctgggacaggtgcctggctccacagcctctttgctgtggctttacaggaaacaggtgcttgtgccaatcagcagagagcgcctggtgcagggtgtggaggagatgagataaaaagttgttggtgtgtgtgcaggtttgcatgtatgtgcatgggtgtgtgtgcatgtttgtacgtgagggtggatgctggggtgctgagtgagcatcaattctggcccagatgctgaaaggattgcctccaagagcctcattttcattccagggagttctcccctcacacaatccaaaacgctatagacatcacagctcttatcagtgagagctgttttttctaaccttttcctgtctctgacctcatctgctcccccagtctttttatgaagtagatggagaagttgttattggactcttttttttattttaagactgagtttcactcttgttgcccaggctggagtacaatggcatgatctcagctcactgcaacctctgcctcccgggttcaagtgattctcctgcctcagcctcccgagtagctggcattacaggcatgtgtcaccatgcccggctaattttgtattttttagtagagatggggtctctccatgttggtcaggctggtctcaaactcccgacctcaggtgatccgccttggcctcccgaagtgctgggattacagaagtgagccactgtacctggccttttggactaattttttagattaaaaaacattctgtgcgtcagacaccagcggcccagtagaaaaagccagaggtgctgatgacttctaaggtggcgctccctgcagctgcgactcaggtcctgcgttagtgtctgcacctgtgaccatcaggatgagctggggccccgggtgcttctgtggtcaggctgggacagtgaaaggcaggtttgagctgctgaagagggagcccttgcatccagggctctcaagaggcaaaggcccgcctggcagtgtcctggggcaggagcatggaaggctgtgtcatgtgcggagacagcggtgatgggggaggtttggggtgcggtgagggggagactccctccatggtggaagcccttggagttgccagatggctggtcaatgctgatgccaatgtggaaatggggcgctgttgtttgtggggtggctggaccctgcatggagaagtgaattcagttttggctttctcagctgttggctgaaggccatggcccctcatgaagtcttcctgtaagcttgaggactttgttctcactcacagggagcccggtcagctcttagacaggagggctgtggtgtaccctggaggtgtttcctgtctctctagaagctggccatggggagaactgaggggtaggtggggaggggccacgcggacccctgcagcctctttgatcttgtattcagaaggtatgagtgtgcatttctatggggcgaggagctatagcatccaccagattctatggatggagctttcgtggatccagagggtgccatgttcttccgaagcctgagaggctcctgagcggggcaaacttctccatcgcccttggccagagatccaaccactcaatcctaagctcctcatcagcaaggtgggatgcagcccccggcattgacctcctgggtgtccccagccctccagccccagacaaagggggaagattctagcctcatcccaaggtgggtgggcactccacatacccagcagcctgcagagatccttggtggtcccagcctcccagtccctgctctgaaagcttgatgaagacctcccctgcataaaaggtctctcttggggcagtcgtctgactccagcgatggttctgtcctcgtgccttcctgggggtcgaggcctggcctcggggtgggattggtctctaggttcaggttagtgcccctacttttacctatgagagcccattgccactgcttgccatgctagaacaggccactgctccaacgaggaaaacccatttttgacgtccatcatgttaattagcacagcctctagggttgatggggacggaaccacagaagcaccatggggtcctccctgaactggagcctctgtgaccacctgctagagggagattcttgactagggccaaggctaagcccagaggagagcaatggcacattgtcagcccgcagtgtttgcaagtgaaatgtagacagggcaggctggctgcggggaggggcttgtttgtttgtttttaatcccgatttagtcttcccaaaggcaggcacatggaagcatcctcacccccgctgcttcccgtggcggccctcacagaaggcgcgtctgtctggcatcttggccgtgaatcagagctgcttgtgatgaatcagagctgctcgtgcagccctttgcagaggcataaatccgcaccacccttgttaattggttaggttttgacattcctgacagctctgcccgccgcagatggtgtaattgctgggtctaacgagaaggttgagcaccttcccgtttgtcaccccgtcattctccagcacggctggattctgccctgtgactgttatgcctggcacggatctcagctggatccctgcccctcctgccgaggtcctctctgagcacctgctccccatcacacagacttttatttaccctggacttctccgggtgccagcacctcatccttcacacactagcagccacggccggcacttccatgggagagttcactcccggctgcatctatcaccatcagcgcggccaggggcccagcatccagcctctgtctgttactcctgacccactttgtttcatgaatgagcctttcctgttgatggaggaggctccaggagggttttgacggatttaaataaccctgcaggaaggggaagccagcaggggagcttgccgaagccccggagccatccttagggctgcaggcgggaagcatgaaggggactgtcccctcgcttgctccactttcagattcaagcagggcccatgttttgtaagaattttgtctttcttgattccagttgtaagccatttcagttactataactttaaaataggcttttgactgggcatggtggctcacgcctgtaatcccagcactttgagatgctgaggcaggtggatcatttgaggtcaggagttcgagaccaacctagccaacatggtgaaaccccgtctcttctaaaaatagc

SEQ ID NO: 233245 - DNA, 603 bp, Homo sapiens
atgccttccttttatgtgatattgctcctttgaatctcctacataaagacctgttttcctaaataggaggctcaataaagttatcctctggagaaatgaccctacaaatctaagatttatcagacaataaaaccttgtgggttctccaggcccaaattggctgtcctaaggaaactattaagttccataaatgtatagacatacatctttctgaaattcctgatactctatgggcttctactctacaaaattgctttattttctttttcgagatgaagtctcactctgttgcccaggctggagtgcagtggtgtgatctcggctcactgcaacctccgcctcccgagttcaagtgattttcctgcctcagcctcccgggcagctgggatcacaggtatgcgccaccatgcctggctaatttttgtacttttagtagagatggggtttcaccatgttggccaggctggtctcaaacgcctagcctcaggtgatcttcccaccttggcctcccaaagtgctgggattacaggcgtgaaccaccgcacccggcctaaactgctttgtaagttaccccaataccctctgaaacctgaagcaaatcag

SEQ ID NO: 233246 - DNA, 529 bp, Homo sapiens
tccccagaccatgtttggaatagtggatcctggaagtgaatccatgagctgcttaattttaggtgtcaacttgactggattacggaatacctagacaactggtatattatttctggatgtatttgtgagtgtgtttccagaagagattgacatgtgagtcagtgggaaattctcccctcctattggctgggggcccaatataacaaaaaggcagaggaaaggcaaattcttctctcccctgagacattcttcttctgctgctcttggacatcagaactgctggctctcgggcctttgaactttgggacttgtaccaggaagccctgggttctcaggcctttcactttggactgagatttacacaatcggcttccctagttctgaggctttcagacttaaactgagccatactaccagcatcccagggtctccagcctacagacgagctgtcatgggatttctcagcttgcataatcacatgagccaatttccctaataaacacccgctcatcatatgtatctatatcta

SEQ ID NO: 233247 - DNA, 381 bp, Homo sapiens
attataggcattgccattccctggtgtgagtcaagttctttgactggtgtcagatctaaatattttaggcagaattatatttaacaaagactttgtatcctggtgttcctagcagaagatatcaatgaggagtgtaacagctagagctcaaattcctgatattctatcactgattttcattaaatgatcttaaacaaataatttttacttccttgggttttcatttcccttctttaaagtgggtatgaggccaaatatctacttaattaccaaaacagaatattttgggaagaaagagacagtagccttaatgatgcaagaagcaaaccggatacatctcttgctggcctagcattatgcactagaaaaaaaaaaaacagc

SEQ ID NO: 233248 - DNA, 233 bp, Homo sapiens
aagccttgatttttttgcttttccttcacaaaactaagcaaacatccctcagatagaaccatatcttttttcagttgatggttccacattactagagacttgtcgtcagaggtggtcatgcataggcagaaaaacaacttgttgaccatgttctaaggcatttaggcagcagaaaattggttggattagagcagaggttctcacatttttgaatttaactgacctgtaaaatt

SEQ ID NO: 233249 - DNA, 1864 bp, Homo sapiens
  misc_feature (402)..(402): n is a, c, g, or t
gaatattgtgcatttaaaagagatgaggtttcaccatcttgcccaggctggtctcaaacccctgggttcaagcgatcttcctgcctcagcctctcaaagtacagagattacaggcatgaaccaccgtgcctggtcctatttttaattttttgaggaaactccatactgtttttccataatggttgtactaatttgtattcccaccagcagtgtgcgagggtttcctttcctttacatcatcaccaacacttgttcattgtttttatagtagccgttctaacgagtgctaggtgatatctcattttggtttgttttttatttatctatttttgatggagtatcactctgtcacccaggctagagtgcagtggcatgatctcagctcactgcaacctcagcctnccaaatagctgggattagaggtgtgcactatcacggccagaaaatttttgtgtatttagtagagatggggtttcgccatgttgcccaggtaggtctcgagctcctgacctcaagttcaggtgatctgcccacctcagccttccaaagtattgggattacagacatgagccaccatgcccaccctaattaacagtatttgtcaaattttaatgtgcatcagattcttaggtttcagctggcatctgtttccagctcttggtgctatttgcaaccttgtatcttaggatgaaggcataaaggttttcaagcagcaaaaccttccagggttagataagagtgtttcactgtggatctgtgagcacctatagccactgtgtgcatccctctgggaccccagcagctgcttctgagaaaacagagggatggagaagaggacatcacccagatggtggaaacatctatcaaaagttaggatgtcctctggaaagcctctttgggtgtctgatttcatatctccttcctcatcagagaatggcgtcgcctcctatttgatgagaatttaaacacatctagaacatgtgcttatctttttcctatctcctgtctctgggatcacatcatactgcctccaagaatcctgtccttaacccccttccttagaatttacagcatagcctggaaacaaccaagcattcatctttattctaaagtacctagaacagagctggatctgtgacagatgctcaatggctgtttaatcaaacaggaaaaactcatatttggagtagggagtagggggaggcaaaatggtactctcaatgaattataatattttaaaatttgtcaatagagaatataatacaaaccagagaagcataaaggaaggtcatgctaattttcatgaggtagtttctaactccaggaacaaaatggtgaaagggcattctaagtcaaaggaatttatcatgtaaagacgggagtaacacacacacacacacacacacacacacacacacacacacaccccactctgctacaaccacaacaaacactttgttgttcttcaaatgcaccaagctctcttcagcagtgttttgtagtgcgtataggacatctttgaaatattctggatatttaacctttgtcttcttggcatgttaaaaatatcttctggcggctgggcgcggtggctcacgcctgtaatcccagcactttgggaggccgaggcgggcggatcacgaggtcaggagatcgagaccatcctggctagcacggtgaatccccgtctctactaaaaatacaaaaaattggccgggcatggtggcgggcgcctgtggtcccggctgcttgggagactgaggcaggagaatggcgtgaacctgggaggcggagctggcagtgagccgagattgcaccactgcactctagcctgggtgacagagtgagactgtctcaaaaaaag

SEQ ID NO: 233250 - DNA, 389 bp, Homo sapiens
agattgcaccactgcactccagcctgggggacagagtgagacttcgtttccaaaaaaaaaaaaaaaaaaatgtaaaaaatggtgagtagaaagacaagaatgaacatttgaggactgagtttggctttttgttttgactcatgtcttaaaagaatattgtgcatttaaaagagatgaggtttcaccatcctggctagcacggtgaatccccgtctctactaaaaatacaaaaaattggccgggcatggtggcgggcgcctgtggtcccggctgcttgggagactgaggcaggagaatggcgtgaacctgggaggcggagctggcagtgagccgagattgcaccactgcactctagcctgggtgacagagtgagactgtctcaaaaaaag

SEQ ID NO: 233251 - DNA, 2770 bp, Homo sapiens
attgactgggcccagatagaacaagaaggcagaagaaatgtgaattcctctttctctgctggagctgggatattcttcttctcctgcccttggacatcagagctgcaggctctctggcctttggacccgaggatttataccaagcaggtttctgggttctcaggcctttggccttggactgatagttacaccattggcatatctggttctgaggctcttggtcttggactgagccacactcctggcatcccagcgtctccagcttgcatggcctgtcacgtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 233252 - DNA, 2879 bp, Homo sapiens
attgactgggcccagatagaacaagaaggcagaagaaatgtgaattcctctttctctgctggagctgggatattcttcttctcctgcccttggacatcagagctgcaggctctctggcctttggacccgaggatttataccaagcaggtttctgggttctcaggcctttggccttggactgatagttacaccattggcatatctggttctgaggctcttggtcttggactgagccacactcctggcatcccagcgtctccagcttgcatggcctgtcacgagaaccctgactaatacacctggagtgcagaatctgctggagaaactgccattccgttattgactggctggtcaggccatacagcctggtggtctagatgtgtttggagtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 233253 - DNA, 2637 bp, Homo sapiens
attgactgggcccagatagaacaagaaggcagaagaaatgtgaattcctctttctctgctggagctgggatattcttcttctcctgcccttggacatcagagctgcaggctctctggcctttggacccgaggatttataccaagcagtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaaatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 233254 - DNA, 3417 bp, Homo sapiens
attgactgggcccagatagaacaagaaggcagaagaaatgtgaattcctctttctctgctggagctgggatattcttcttctcctgcccttggacatcagagctgcaggctctctggcctttggacccgaggatttataccaagcaggtttctgggttctcaggcctttggccttggactgatagttacaccattggcatatctggttctgaggctcttggtcttggactgagccacactcctggcatcccagcgtctccagcttgcatggcctgtcacgtgattcctgtcagaatcaccatttttggtaaacaaaccaagcccagaacctgataattatggagcattctacactgacagttctttgagacaaatttcctcttggcatttacactgtggctttagctttcaaaccagaggttcctcttacccagcaaaaagtgagttatacgctttcttaatgttataacgttaccatggatgatcctgaacttgccgaggatagcagagacgggtgggcagaacaggaaagaatcagatcagagactgtaaaaagtaacttaaaaaaaaataattctggcagagacagaatttgaaggtacttgtgcacatcagaacactggacttgcttttttctgggagcaggaatgctgcttaattagatcagagaagaatgcaagtggtccatacatttagatctacaatgcgtggtttccagacctgcagcttgttttgctgcgcttcatcatggagtcatagaagggcagagctggaggaccgagtgagggacctggtgccatatccctacagacaggcaattggagactcccgtaggttaagggctgcagagcctggaccaatgcccagaatctctgagctttttatcttacaccatgaagtgacagatgctggcagatgttagacctttgtgcttaactgtttaaccacacagcacccgacttctgtatgcagcgaggttctagagtttccaaaacacgggtctcctctcccacctcagcctcctagcataaaactagacacatcctcatgcttttgaggtctaatcattggattttgttcctttcagatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 233255 - DNA, 2719 bp, Homo sapiens
attgactgggcccagatagaacaagaaggcagaagaaatgtgaattcctctttctctgctggagctgggatattcttcttctcctgcccttggacatcagagctgcaggctctctggcctttggacccgaggatttataccaagcaggtttctgggttctcaggcctttggccttggactgatagttacaccattggcatatctggttctgaggctcttggtcttggactgagccacactcctggcatcccagcgtctccagcttgcatggcctgtcacgagaaccctgactaatacacctggagtgcagaatctgctggagaaactgccattccgttattgactggctggtcaggccatacagcctggtggtctagatgtgtttggagatggctttcccgaagatgagattgatgtatatttgccttctggttctgggggctctttgtttgtattttagcatgtacagtctaaatcctttcaaagaacagtcctttgtttacaagaaagacgggaacttccttaagctcccagatacagactgcaggcagacacctcccttcctcgtcctgctggtgacctcatcccacaaacagttggctgagcgcatggccatccggcagacgtgggggaaagagaggatggtgaagggaaagcagctgaagacattcttcctcctggggaccaccagcagtgcagcggaaacgaaagaggtggaccaggagagccagcgacacggggacattatccagaaggatttcctagacgtctattacaatctgaccctgaagaccatgatgggcatagaatgggtccatcgcttttgtcctcaggcggcgtttgtgatgaaaacagactcagacatgttcatcaatgttgactatctgactgaactgcttctgaagaaaaacagaacaaccaggtttttcactggcttcttgaaactcaatgagtttcccatcaggcagccattcagcaagtggtttgtcagtaaatctgaatatccgtgggacaggtacccaccattctgctccggcaccggctacgtgttttctggcgacgtggcgagtcaggtgtacaatgtctccaagagcgtcccatacattaaactggaagacgtgtttgtggggctctgcctcgaaaggctgaacatcagattggaggagctccactcccagccgaccttttttccagggggcttacgcttctccgtatgcctcttcaggaggatcgtggcctgccacttcatcaagcctcggactctcttggactactggcaggctctagagaattcccggggggaagattgtccgcctgtctgaggggagcccagaggcacatccggacaagtttcagataacccgtggggatagtttttgctagattttggaagagggggcgggacagaggatgctgttcttcagtgctgaaatccacgccagaatgtcggtgttcatgaagtcactgattagttcccacttggtgccccaggcaataataggcccgtctcttgggcacgcacactcttcatactaagtgtttgacatacacctggatttttgcatttcaggggtcagtatcctatgacatgatgggtgttaccatcctaattttacaggcaaggacacagcagctgcgagaggtacagaaacttgtcccaaggctcacagccagtaggcataggagcgggaatgaaaatcgagcactgtcagaatctggtgggcagcccctgacttgaaccactcccacgtgctgcctcccttaggaggggacactgatgatgaggtctcggagccggcatccttccatccctgtcgagtcccctccacctcagctcccagtccttgtgctttttggagctaagcctgggatgaccaaattcaccccagctccttcattcacagggctggatgtagctgggattgagtccatgttatcggctcggtactcaacacaacccaagtttcatccgaggaaatgtccccgcagtggatgcagctcacatgctgaggaacacccagctctggacagagttcttataaatgtataaattaggctcagaaaccactgcattctgacctgctgtacagactgcccacactgctgacctgcctagcgagcaggacatcccttctgagccatctgctgctctctcatttcatcaccccaactgtcccttgtttttgatcaatggggaccagccactgccccaggagcactttagggctctcagttcaaactgaaggacagttgaactcagatggggttcatgtgggattctgggagctttctgggaattcagttggagtcaagtcaggatgctctcaaggacccctcgggctcagagccctaaagtgggccctggtgaagcagggtggtcctgcgtccacttcccaagcctgagccaagctcatcttcattgaatgtctcatttggccgaggaacaactgaactttgtggtttgctgtttagccttcagtttgctccgctgcctcctacccagaggtttgtgcgagcctgtgttgcagggttgtataaaaccaaggtacttcgttagttttgcccattcagccatggtcacgtgacatgcaaagtaatcttgctcctaattatagaaatgatttttcttttaattttttactttaccagactttactttgtactcagagaagaggcctcacatggctgtgtcacatataaatgttggactaaactctta

SEQ ID NO: 233256 - DNA, 1082 bp, Homo sapiens
gccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaatgggccaaggttgctcgggtgattggtttactggcttcgcacaaaactgatctccaggaaaatacacctgttgttgaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtactggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaa

SEQ ID NO: 233257 - DNA, 833 bp, Homo sapiens
gccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaatgggccaaggttgctcgggtgattggtttactggcttcgcacaaaactgatctccaggaaaatacacctgttgttgaggtaatgtcttttatgactgaaatgtgatgaatgacaagaaatactgttgttgattctgtaatttagaacatgcggctttccttgaccttcacttgacttttctttgtgggattgtggaaattgttcaaaaacttatcacctcaacagacctttaggcttaaacatagcggctcatttacaatgtagtccatcattaaaatggcacagcagagttaacaaggctcgtgaaccctactcatcattatttcatttgtttttgaataaggcttgttcatttcccgttttcttgtagtctgtccaacattttgttacagctaatgtatttcctaattaaatcatagcttataattc

SEQ ID NO: 233258 - DNA, 1129 bp, Homo sapiens
gccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaattccaattgctaatccagcatttgtggatagctgcaaactgcgatatatgggccaaggttgctcgggtgattggtttactggcttcgcacaaaactgatctccaggaaaatacacctgttgttgaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtactggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaa

SEQ ID NO: 233259 - DNA, 115 bp, Homo sapiens
ctataattaaagtgaaataagtcattcttatttaaaacaaaatagtttgcgagtaagtgttccagttcttgttactcacagacattaccagtaacatatatgcttaggttgttca

SEQ ID NO: 233260 - DNA, 827 bp, Homo sapiens
cccttacggctcctgccccagctcaggcatcctccttggcctgtaggactccagttttgcccttttctgtccatcccccagtgtcccagcaggatctttcagtgccctgagctgaccctggccctttcctgctcaaagtgctcctgtggctccccactgccctccagtttagtccaaatcgtactccaggctcttcaggccctgctcctgctgaccactccaggcccctcacgcccctccccactttgcacctgaccttctggtcaggtggaagctttttctagccaggtggcagctttgatcactgccagctggctctcacaacctggcatgttttttcttcctagcagacttttgttcatcctgtagtgtcaagctcagatcaccacctctgtgaagccctccctgactaccacaggtggaacccctggggactgtgacagcctgtgtctgttcttccaccctctctgaatccaggatcagaagccctttgaaggcatgtcttgggtataaatcatctcaactccaaactcagggcttacaaggggccagagagttggtccaagagttgattgtcacagctggacagagcttgcatttccagtttttgtttttttggaaacagggtcccactgcactccaacctgcacaagagtgagaccttatctcaaaatatggaatattaggaacgatagataaatctataaggagattcaggaggcagagagaacacgtggggattgatgggctatgggacggggttgtccagcatgagacccagagctctagtctggaggacagtggagccatctctgaggtgaggacgg

SEQ ID NO: 233261 - DNA, 412 bp, Homo sapiens
ggaaaatctcatcttaaaattcttaatcacatctgcaaagttccttttgctttgtaaggtaacatattcacaggttctaggggttgggagagggatatctttggggggactattaatctgtctaccacaatgcccaatgtttaagtcaaaccagagggccaatgggggcggaagatttgattgaagcatagggtattaacaagagaaaacgatcaatggtttgaatcagatttaagttcacataggatgggcctagatgaggggtccaggctgttacgtcagaattgcatcaagggcctgagttcaaagttaaaggaaattcaaagtcaaagttcaaatttcaaaggaaattgatggaatctcaacagagatcctgagctctggatcaaagccccaggagcactggtggtta

SEQ ID NO: 233262 - DNA, 271 bp, Homo sapiens
aggttcttgggggttgtccttacagttagacagaacaggggattgtgggaatcacttaagaagtggtgtcggctggagtaatgaggaggaaagaaattttagctcagagactaaaagacctaaacagagaagcttgcagtggttatagagcttgtggctagagtccagtcatgctagactcgttctcagcatcaaatctgtgcctagagtgcctagattatagttgttttaatttaaactaatccaaacgtgagctatctcatacaaggtt

SEQ ID NO: 233263 - DNA, 482 bp, Homo sapiens
agagattgcatgtactcttcacccagtttctcccaatggtaacatcttgcgaaactatggtgcaaaatcaaaaccaaatctctttttataacaaagagagggttcccacctcaagctcagatccttccctgtgtagctagaacttagtaacagtgttttattttattatattcagtttcaagggttacattctatttataacaaatgatactggttttccctttacaataatgataaaattttattactgagtaaattgatttatgtttaaaaattgagttattttaaagaatatattatataaatgattgtgctagctgtatgaaaatgaaagtgaatgatacataattgaatttcaggaaacactgaaaacactgaagctacactatcaaatggaatgctttccagaccctactttttctacattgaacaactactatgaatctgatacatcatgaataaacccatcaattcactgcatt

SEQ ID NO: 233264 - DNA, 148 bp, Homo sapiens
ggcaggagaggtgatcctctgctcagagctctaaaattacattattccttaccactactctttctaataagcctaaaactgagcacacctgctatttcttaatgtgactcttcttattcaacaaggacagaggatcctatatctttta

SEQ ID NO: 233265 - DNA, 361 bp, Homo sapiens
tatttatgcggctcttattctatcatttgaacgtaagctttcacttttgatgaggtggaaattaaatgaggctaaggaaagtagtggcatgagcttatattgttatagtacattgttccaaggagatatttaaaaatgaatatcagagtctgaatttttcttctttggtaaatgaaaatggaaataactagctaaactgcttcttttaatggaatttaataatataaaattaaactaatagaagttaaaataaatttgtgagagttatgaaagtacttccaagagcatacaaagtagctagagttcttacttatttattgttatttattacagcattcggaataaagaaaaacaaatcatt

SEQ ID NO: 233266 - DNA, 301 bp, Homo sapiens
cagtcaaagagagggaaagatccatgcctaagaaactacacaggttttttaaagttttttttttctccccttctaagttctcagctgaagtctgtgtaatgttcctgtctctattgccctgtattattaaagctcagactttctatctatgaagaattggctggtgaggaaattagaaatagaggtggaattaaagtcatctcccttggagatcatattgttggcattaattggggattgcaggctgagtacaaagtaccttgtaatggcccagaaaaagaaatagaaaaatttttttccc

SEQ ID NO: 233267 - DNA, 261 bp, Homo sapiens
tttaggaccttgccatttcacatttatactactgcaaaaacccctaaattagctccctgttaatacagtacctgattgtaatctactctttatgccgctgtcagaatggtattcctaaaacaaatttctaattgtattacttccctgatccaaaaggttggatgggtctccattttcaaaataaaattcaacctgttcaagctctctccacactgagaccaagctttcacttccatatatttacactccactcccactaag

SEQ ID NO: 233268 - DNA, 225 bp, Homo sapiens
gccaccacgcccggctaattttttgtaattttagtagagacggggtttcaccatgttagccaggatggtctcgatctcctgaccttgagatccgcccgcctcagcctcccaaagtgctgggattacaggcttgagccaccaagcctggcctgttgtggaggatcttctatacataagaccatgtcatctgcaagtagaaatagttttcttttccaattttggata

SEQ ID NO: 233269 - DNA, 408 bp, Homo sapiens
tcatagttatttaaagaaatattgtttaaattcctacaggactttggacaacatgcagaagtagttcaggtatcttgtttagcattaaggaagtgagagtgtgcttgtgttgttagcttcatcttgtcgtatacccaaattttgtgatacctcaaaatgcagagaccgaaaatgttcataaatgtactttaatgagatttctcaaagtgagttattgtttggagttggttaactctgtatcacgtatttcgatcctctttataatgttggctaaatgtttgttaaagaaaagtagtggaaaggaagatatatgaaaacaattagatgttaccttcttgtaagtcacattgaccttattcaataccaagtaatcattagacttttaattttacggaacaacaaatttgc

SEQ ID NO: 233270 - DNA, 288 bp, Homo sapiens
ctaataagtaactgtgagatgtacagaaaggtgttcttacatgaagaagggtgtgaaggctgaacaatcatggatttttctgatcaattgtgctttaggaaattattgacaattttgcacaagttcttgaaaacgttatttataacgaaatcaactaaaactatttttgctataagttctataaggtgcataaaaaccttaaattcatctagtagctgttcccccgaacaggtttattttagtaaaacaaacaaacaaacagatttttatcaaatgttatgatgcaaa

SEQ ID NO: 233271 - DNA, 503 bp, Homo sapiens
tctgcagatatcaattcttgttttaagaaatagtttctggtctgttactgggaactagtaaagattaaatgctagaccattagtcatcaattttctgtgccacctgaggtacccaacatgaagtaggtgttgtcttaccaaaccatgaagttgggtatgcacagcaacatcccctcatcaaatggaaatggttaatataagatccagcctgcacaggtcatgaaggcacaggtgtggcctctttgagagttccctttgatcatcgttgaacaagaaaatatttgggtctggtttaccaaaggacctacaagattttctggcaccaccattccctggaggggtcagccagctacatgttggcaggatgatggcactggactatttccatcgtggaaggggcagcattttgtcctcactggaacagacacttggttagaatatgaatatgctttcactgtacatatttgttctgctaaaaccaccaactgtatatgccttattca

SEQ ID NO: 233272 - DNA, 626 bp, Homo sapiens
cagaacaatgcgggagttgcagagagaggtgtcctgtgtttgttcccagtcttccttcactcacctgcacctgctcctgccctgcttcggccaacatgttctatgcaggcagcagagttcatatcaagggcccatgttttaactgaatataatgaattttttttttcaccttggaagagtcttagaggcaagattagaatgttcatctaaaaggagtgcaaatttcttcaaccattcccacggaggaaggtctactctgtgaaaaggaaatgatcatacataattcatgcatttgctgtacggatttaattaaatgatagacaaaaagtagagtggcacaagtcaaactcaaaaaatagtaacaacaaaatcaatttcaaaataagcaacagcaataaatgttacctactattttacgaatgaaaatactgagaccaataaaggcattatagtatacatagccttggaatcagaagaccaagaacatacaagagaacatagccttggaatcagaagaccaagaaacaatttaactctgcccctctagagctctgagaacttgggcaagccttttaccctctgtgagtttcagtttcctcatttatttaattgaaataataatacag

SEQ ID NO: 233273 - DNA, 511 bp, Homo sapiens
cagaacaatgcgggagttgcagagagaggtgtcctgtgtttgttcccagtcttccttcactcacctgcacctgctcctgccctgcttcggccaacatgttctatgcaggcagcagagttcatatcaagggcccatgttttaactgaatataatgaattttttttttcaccttggaagagtcttagaggcaagattagaatgttcatctaaaaggagtgcaaatttcttcaaccattcccacggaggaaggtgagctcagactcactttcatctgtccctctcccccatgtgcttggccagggtaagggacctcaggagggcccccccagtctcccagacagctgactctccctgtgtaaataattctaatgctctcagttattcactactcatctgagccacctattgaactataagcttcagaattagctttgtacaacccacacccagcacagggtctggcatttatatgtgttcataaatgcaacaaataaacatttattaaaatgca

SEQ ID NO: 233274 - DNA, 640 bp, Homo sapiens
agagtagaggccatcttggaattgtttgaagagcactattggaagtgaatatatacaccttacgtttaaataactgcctgtgaagggaagtagaggcttgtgctggggggaggggtgttataggattgaaaataaattagtataggctcagatggtacccagacctaagtgattaattcaccactttataattagataatagaaatactgtaccaaaattctgtaaaagctgctgtgattatctctctgtgccatcattagccctcatgtagtcactagagggcgctccactctcttttcagtctatgtgattgataaccggtaccgttcaaggattactttgagactcctatagttgccacaagtcttaattcagtcatactcatatttatatagcattacatttttatttttattaatgagtctttccagtgcagtagtccctaaggcctttctatgaaatgtacattctgaaactggtgtggtataccaactgttttcagactgattatcaaacagtatggataaccactcatatccacagaaattaaaatttcaggtagaagtggcaataggtttgtagtacggaagtttagggtggatacagtggctcacgtctataatccctacactttgggag

SEQ ID NO: 233275 - DNA, 190 bp, Homo sapiens
gtatttttagtagacaggggttttgctgtgttgactaggctggtctcaaactactgacctcaagtgatccgcccacctcagcctcccaaagtgctgggattacagacgtgagccaccacacctggcctcaacttttatatgaaggacattttggttccttgaaagaaagtgatcccttctgttgacatcc

SEQ ID NO: 233276 - DNA, 530 bp, Homo sapiens
ctctcactgagggcggggtgttctgtccccagaggtcaaagcccagagaagttaagacactgctgaaggtcgcccagggcctctggcacaaccaggcctgggacacttcccacgatgggcagaacaggagacaggaggagggtctctgctgctcgggggactcccagccgccgccggacccctgaggcgccccccacccccgcctgaccccatggcagcgcctggcagggcgcagggtcaccgccctgccggaaggttaaacaaacagaagcggaggagggggccaggagggggagttccagcgcttctcggctttcggggcgagttggtgccccccgccggggcctggtgggagaggggagataatccgccccggcagaagcgcctccgggaggctccgggtctgccacggccccttggccctggaagaggacggcagcggagaaacctggctgcggagcggcgggagcgcagggccggggcgggccgcgataagatgaggacagcacgggctgggccgggggcggccg

SEQ ID NO: 233277 - DNA, 578 bp, Homo sapiens
ccctcacaacaggcttttgcactgaccaccggcatggcttggaaccctaaccattgttcccaagactgagatgcttactggctagcttccatgatcatccttgcagccatcccccatttgtgatcttcgtctgccaggatgtagtgttgtaaatcaggcacaagtctcagtaccaatgaagtcttcaatcttagtgcaaagttgcagcatagtctttcattttcttcatatgtttttaacttgaagactattttgtataataactaatatagctatactagctttgcatggtttatcttttccatcctttatttttttaacctttctgtagctcatgttttggaagtttctcttataaatagcatatggttgggtttctcaaatccagtttggcaatatttgtctttatgttccaaataaaaaatagctctgtactaatatttcactaatatattttatttgagcttacatccatattcttcctaatgctactgtcctatcagttctgtgtttttttttttgttgttgttgttgtttttttttgaggctgggcaacagagcgaaactccgtctcaaaa

SEQ ID NO: 233278 - DNA, 426 bp, Homo sapiens
tatgaaagagactgagcccctatgagtgagggtgatgtcaacacaacagcaggcacccttggtaaccaagtcagcttccatattgatcaggactcttttgattgcaagaaaccaaactcggatctttataaaagcaaaggtaattgactcagtcagaagcacatacagcacgagagttgtaggcatggctacacttaagccatccctttatctggctttcattagagcctcggccgcgcctcttttgtgggagagacttgagggagccgaggcagtttcccagccgctgtgatgttgctaaagattaaaaaggagctttgaagctgcaccagttctctctgtgccccctcggtacaggacctcagaaagacccaagccatctggcaaacctgacataaagacaaaataaagtgattgaaacagtct

SEQ ID NO: 233279 - DNA, 639 bp, Homo sapiens
tggactccaacgacactttcatgactctaaaagtccttccagaaagcttgattggttacctggtaggagaccctgaaactgcctagctgaggcatgagctggttcaggggcacatggtcagtcaacagatccacttggtgtcatgggcaaattgagacccaagctggaagacagaaccagaaatgtgaagagatctgggggttgaatacggggcattgcagctgaatctggagaccagatatttctaagtaggactgcttcatcctccacaattttaagaagtgatatcttctgtttcgggtgaaaggtttagtatggattggacaggggaataatttcacctggccaaaatcctcagttgggagggttttttttctgaggtcacatgaggtcttcactgaatatctgtgcttcctagtgtcttccaaggttcctgaggacctaatattggttcctactggttactttcctgttctgggattcccttatgctgccttgcttggaagctgtgatagaaagcgaggattttgagcaaggagccctgggctcacctaagtgtctgagcctcagttcctcatctgaaatgttagacacaatcacagggtgattgtatggagcaggtaggagtacatttgtgaa

SEQ ID NO: 233280 - DNA, 280 bp, Homo sapiens
cagctggtaagtgacatagctgggatttgaacccccacctccaaacggcctaactccaaagctgcactctttgcatggcatctgctgacctaattatttattcattcatctgcttaattttcagccttaacttttgctgaaatagagacaggcaaatgaggggctgctttgagctcattaattatgaaatgctactcctacctagacctccagctacaaaaactttccatactctttaccttattgacaacttcatctggaatttttcagttgcaaattt

SEQ ID NO: 233281 - DNA, 588 bp, Homo sapiens
cttcttataaaacatgtccttcctattaccttctaggaatgatatcagtattgcgtcatacctctttgaaaagaaaaacttagccttgtattaatagaatagagaagatttattagtgacacctcatttatctggaggtaattaatgcagttcagacttcagtaacctctgtttgtatgggacagcacaaaacttggcagttttaaaaaaaaatgaaacaccaaaaaacaaaacaaagagcttgtcatctgtgagcaggctgaaaaaaacccaagacccaatgaatatgtatgatcaacatgtgaccaacaaataacagagacagtgtctcgtaggagagtgttggcagcaatttgtgatcaagggaagcaagcttgacatgacagcaaagagagttggacaaccaaaagaaaaagaagaaaagtaggacatctttgcacacagacagacctattccagtcattgctttttgaggcatcattttgtcacattgaagacatttagacagttgagtccaagttagagagcattaagtaaacataggttggtttatcatgtttacctctgtaatgtacagggtcatttgct

SEQ ID NO: 233282 - DNA, 309 bp, Homo sapiens
cagtgagccatcagttcttcttcagcaacagctctcacaaccacccctcctccttcaatccagctcctccccctcatggctcatgggtgcacaagatcctccacctacacatgagagcacccacccagcagggtgtcgggtacactgtaagccctcagcaaacacaatctacattcccacactacatctctgcctttgtcctctgccaggcctgcacctcagaataccgatcccagctggccagctttgactgtaaaccttcttcttcctctggttcaacctgcaggttggccacacacagcctctgtt

SEQ ID NO: 233283 - DNA, 426 bp, Homo sapiens
gtccccatcacccccccgacccaagcacgaacagggcaggaacccgggtccaagtcctcaaatccacacctcactcctcgtcctgaacacccagagatggggattccttgtgaaaaacagaaagcacaaatgcactttgggaggtgtggagggaagggggaacccccaggagcgtggcctgtgcctgcccggcctttctttatcaggatgacacagtgacgataagcctggccaatatggcgagaccccatctccaccaaaaaataaaaaacaaaattagccaggcgtgctggcccgtgcctgtagtcccagctactcgggaagctgaaacaggaggatcagttgagcccaggaggcagaggctgcagtgagccaagatggcaccactgtgctccagcctgggcaacagagcaagaccctgtctca

SEQ ID NO: 233284 - DNA, 253 bp, Homo sapiens
cccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggctt

SEQ ID NO: 233285 - DNA, 151 bp, Homo sapiens
ttcgaccctgggaaatgcatttgagtgcccccgcagtccgtaagccttggtgtgacagaaggaatttgttcatacttttcatttcttccggcagcttattgagctctcatttttataatttttaagttagtaaattgtatcattggcaaaa

SEQ ID NO: 233286 - DNA, 303 bp, Homo sapiens
tctccccctctcccccaccctgtctgctgccaacccaccccaggggctgtactagctgacaagtttctagttgccatcagctatgtggcagatgtccccagtttggcagaacagcatttccttggcacagattgtcccagggcacagctgagacagaggttctggctatgtcagtggccaaatctgatttaaaatggggaggccgattgccagcattccagatcgtccctagtaaatgtgagtaaacagagctgttgttaaagcagttggagtgagtccactcattcaataaatatttcatga

SEQ ID NO: 233287 - DNA, 296 bp, Homo sapiens
atataagaggtgcctcccttccttgaaacttcttcacctttgcttcaagagcaccacagagcagattcttcaaggcagagatatacaagaatccctgtggaaaacctcatgaactcaaggtcatgcagagacttagggaagaactgggactggcttatcaagactctacactactgacccagggcttggcagtttctgtcctagaaatcagaacacgcagctcatgcatcaccgagaaggtggtcagcctaagaagtggttccccactctttgttctaagatattcctctctcaga

SEQ ID NO: 233288 - DNA, 626 bp, Homo sapiens
aagatactcaaagacaaaaaccagcaagaaatggcatttgacttgcaagcctttaggagatgtgcataaacagagaagctcaaagggaggcagagaaaccaggatgccatcgttgattatgtccttccagcaactgcaaccgtgcctcaatttgcagggaaatacattcctcttcatggaccctgttctgggacccatagcatgctccaggctgcagcccagacaggaaggtgtccaatatgtctttgagttccatcttggggatctcatgtgatctctggtgtgttagtgagtgggcagggcccctggatcccagcactgacctcagttacatgaagagtctgagtccatggcaggatctgggcccacagtcttctcaccaacccagaggcagaaacagactctacaagcaacatggaatggcagtgctttgtatctacatttattagtttttaaaaaattataaaatctggctgggtacggtggctcatggctgtaatcccagtgctttgggtggccaaggtgggaggttcccttgagcccaggagttagagaccagcctgggcaacatggcaaaaccctgtctcgacatggctaaataaaaaaattagccaggcatgctggta

SEQ ID NO: 233289 - DNA, 542 bp, Homo sapiens
ttatgtcaaagcttactattgttcttaaaagaataaaatcatgttgacattttattattctattacctgtattatctcttctgtcccccaaattgaaaccaaataatttggattctggaggcatatagtcatctttatttaaaatttaaaaagtgatacctgaatcaggaatgattcttgtgaaatagtgttacttctaaaatcataatttaaaatatagaaaaagtaaatcagcaatagttttatgatataaaaaagcagggacagaaataaaatagaaatgttagctgcatttttcttctgtctgtaaattgtgccagtgtaggtgtaaaattatggtagaaactttgaacttctaaatcaatgaaaagtaacttgcaggaaatcaaatcagaattgtacacaatcaagatacattcatgacaccaaggcatattttgtaagatgccacacaccttaaaggatcttcctttttgctagtcatacttctggaaaaataatgatcattctttagttatacttcttaaaaattctcgatttgg

SEQ ID NO: 233290 - DNA, 441 bp, Homo sapiens
aggttatattaggtggagaaaaagtaaagtatgttttctctgcatatccaaatcatagtacaaagtaaatactgtgcatctgacacacaggaataaaaggaccatgaaatcacttgtcaaaaatcttagcagtttagaaaaaccaggcagaaagttgctgcagggtcggatgggtcactttcttaaagttcccacagatagggctgactgcagctttcacaactgtagaaaacacaggaggaaattcaaagagcgaaccacgatggtggattcctaactcttggtcagacccgccctctaagtggtagctcagctagtctgcccatggtgggcaccaggcaacttccatggagaggggatatgcccactcacgtcccctcctggtcaatacttataggcatgtcagcaaaaagacttgtttaaaaataaagagtccacaat

SEQ ID NO: 233291 - DNA, 504 bp, Homo sapiens
cagtggcagagcctgagccgttcgtgcatctgttcaccagcatccagaataacaatagatttttgaaacattcctgagaaaattctgggagttgcataccggccagtcttattccctaaagttgttccttctaaagggtgggatgaccaaaaatttcagaaaagcaaaccaccgctgaaaggcaacgttatttctgttggcagaaggcggcctgagcaatctagattttccacggttcaccaactagtttttaaggaaatatggctgtgagaggaataaaacataattcctacctttaaggaactcagagaagtgaattaaaggaagtcacagatcaggcaaccaaccacacaaagtttctaagagcaaactgttcaggtcggcaagtcactcttatccactgttttgccttctgaggtttcagttactctcagtcagtcatggtccaaaaacattaaatgaaaaattccagaaataaacaattcacacgttttaaatcgtgtt

SEQ ID NO: 233292 - DNA, 409 bp, Homo sapiens
tcaggcctctgctccaggcccctgaaggagggtggctgtctgcactgtggatacagctctcctgccacctgtgtcctggtgccaagagcctgaaaccagacctggccttccggccaaaagggactttctctgctttcacccagccggaactgagacaccactagaagttcctcctggctgcctccacctcaaggttcccaccaggctcctgcctttccgagaggaggctctgatggacagtcttcctggggagcaagggagggggctggagccctagaaggaacaaggaggtctggggcagctgctgcggcagtgatagactcgtgtgccatgggccactgccgctgcacgtgcacctgcattgtatttcttaaaattataaattaacaccatttgaaaattcagagga

SEQ ID NO: 233293 - DNA, 462 bp, Homo sapiens
ggatttgtcctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtaatctcagcactttgggaggccgaggtgggcagatcatgaggtcaggagatggagaccatcatgcctaacagtgaaaccccatctctacaaaaataaagaaaatttaaaaatca

SEQ ID NO: 233294 - DNA, 392 bp, Homo sapiens
ggatttgtcctccctgctgtcagaacaacagggttctggaagagtagaggacaggccgtgggacttggctgtctagagacaaggcgggagggatttccttgagaggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagaga

SEQ ID NO: 233295 - DNA, 675 bp, Homo sapiens
ggatttgtcctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacgggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagaga

SEQ ID NO: 233296 - DNA, 225 bp, Homo sapiens
ctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcatt

SEQ ID NO: 233297 - DNA, 468 bp, Homo sapiens
agcccctggctgacctcctccactttcacctttcagcctcgtactcctgtgccacctcagcacactctcctgctctaaaaaaaaagaagcattcaggcagtcactaaatagcagtattgatgccccatccccacatgccctggaatgataatgcatcacccgtggtgtgtatccagacgaagccagattacgctcaggtggttaaaagtccaggtctaattagagttccagggaatcaagccattgtattattaatgattctccggcaatgttctgattaaaacagtaattttaataagcacagctcgatgctaagtgttcagtgagcacctaattacatcagttatgactccaaaattatttaaaattccgctttttttccaccggacccggcatgcaccaaataaaatagagactcagacaacttggtgattatttgctctaattaatatcctaagcacctctttt

SEQ ID NO: 233298 - DNA, 282 bp, Homo sapiens
ccttccatgccttcgtttctttatctccaaaatgggtgtcacagtcttgacctcatactgttgttttgaagattgaatagactgatacatgttaagtgttcatttgatttattaagtgtgcgctctgggctagacactgtgataggtgctgggattacagcagagaacaaaatccctgcccacaggctttgacagtccatcaggggaataggttgtagcaaatagaaagcactcaataaagtttttatattgctgtgactagtagtaattactgggtggcta

SEQ ID NO: 233299 - DNA, 312 bp, Homo sapiens
cttccggctggcgtgggccctctccgggagggggccgagcctctcctgcccgggcctggtcctggcgccagcctcaggcctgcaggtcctaacctcagccactgccagtgtggggttccccattcatccgccttttggagtaggggctgcgctgaggcaggggaatgggagaagtttgaaagggagagagtaaaaggaagccctggcccctgacagctttgacagtccatcaggggaataggttgtagcaaatagaaagcactcaataaagtttttatattgctgtgactagtagtaattactgggtggcta

SEQ ID NO: 233300 - DNA, 180 bp, Homo sapiens
gatattttctgtgccttagtctgaggacaaactctacatctcaccattctgtatgaacagtaaggaggagcatggctgacccagctgcatggccaatagtcctttacatgatcatccttgtagctaccctctgatcaacatgccttccttgcacttttaaccattcctcagagttcctcc

SEQ ID NO: 233301 - DNA, 300 bp, Homo sapiens
gtagctgggattacaggcacctgccaccatgcccggctaatttttatatttttagtagagacggggttttgccatgttggccaggctgatcttgaactgacctcaggtgatccacccacctcggcctcccgaagtgttgggattacaagcatgagccaccacatctttcagtgtcatttatgtaaataattctacttttaattagaaaagttcatctaaaatctggtttgtaaattgaaatctgccccttgcttttcagttcacagagacataaccaaccaagcccactgatctagtgtc

SEQ ID NO: 233302 - DNA, 614 bp, Homo sapiens
ctcccacaatgctatagacacaatgacagagcaagcaagaaagaagaaaactggaattggctgggtttaaatctcttccactgaataggggcatgagagaaaattttagtcgggtttatagaaaaatctagccagttacatgtcttacatttctagtgacatttcttcactactgagagaatagaatgagttccacagtggcttttattcatcactgcaaagaagctagagaaaatgactctttgctctgagaatagtcctgtccctggaagggtctggatatagaatgggaaaccatggccttgggaaacacgctgggaatcacaggcaggtacttttattttaaattggttcctcgtctccattctatccggttacgagtattccttcagaagacgtttactaagcgcttgctgtattggggttgctcttctcgaggagtatctttgtggtgttctctgtatttcctgaatttgaatgctggcctgtcttgctacgttggggaagttctcctggataatatcctgaagagtgttttccaacttggttccattctccccgtcactttcaggtacaccaatcaaacgtaggtttggtcttttcacagagtccca

SEQ ID NO: 233303 - DNA, 416 bp, Homo sapiens
tggtcagtgctttaagtgaatctactcagagctgtgaaatcttgggggaatttgacccagtcacagttgagagaaggttctggaaggatatgggctaaggtctacagatgaataaaagttaagctggtagagagggaagagcttgtaggatggacagagggatggttggatgagtgacatgagcctgagtttaagaggttgactatttcttcaccctgtcctctctcttagcctgtgaaggcttgctggtaaattgctaaatctggcagagaatgaggaaaggaagatctctttccctggctatcaattgtttgagtgtttcacttaaagttgagcacctgttctattgaagtgcccacctctgttcctctccatttctttgaaccctatcactggtccttgggaagggtaaatgc

SEQ ID NO: 233304 - DNA, 256 bp, Homo sapiens
cagttaatgtcagaaaacttctgacaagggaccatctgcagctgaatactttggagacagtgttgggatccttaaatcgaggttcagaaattcaaaagaatatgggacttttaaatttggggtcattactgtaatttgcttagtgtggaaatataccagaaaatatatgagacagtggaatgagaaaatattcaattaaataataggcaaaaaaatgcaaatggtctttgtagccagtctccctaggttcaaatct

SEQ ID NO: 233305 - DNA, 602 bp, Homo sapiens
gcatgtttatttccaaattaacagggcaataaaaatcctctcttaaaaatcagggatatcagtattcatctcttttcatgtaaaaatattaaaaaattagaagtgaaatatcacagaagatattttaaatatgaagacaaataatgaaataaggagaattttaaaagccaaatattttggatcagagtaagaagttagtggtaaaagataaaggttatccaacaaccttttgcaaatgaagccaaaaaagtaggtttgcgcaacactgaataactaaaattacaactcttttatatttcattaagaaacatgccctttttcaaaaagtcagatcggtttaatcacaccataaaattatttacccaaagttaaggaaaaatagcatgctttcatataagtagaaaatttaaatacacaattgatatttaacgttctctaagcaatgtaaagattgcttttaagccatctaacagagttgtatttattattagggatcaaaaagtgtgtaaattagcacaatatattttatataaaatgaatctgttttctcttataagagtatacaattataattctgaattttgaatttattcttaaacaaa

SEQ ID NO: 233306 - DNA, 560 bp, Homo sapiens
ctgatgcctacctcagagaattgttgtaaagattaaatgagatgtgccttcagcacagtgcctagcctatggtaagggtccaaaactgttagccatcagtgctattaccattgtcctcatcttcatcatcatgactatggtatgtgtatggaaaggggaaactgcctaaactgatgctttacttgtgtgtggctatgatacagctcaaaacttctctaataaggcacgagggcctattgggaaaaggctaccagcctttgacttgtatttcaaataaggtatttttgcttctcattttatttcttctacatatgtccatattttttttaaccttcctcttcacacttgatttttagcatttcctttttctccctaaactttgtatggagaaaaagaggcaatgagatgctatttttgcaacattagctgaacctgggatatgcgtagtcatgtttatttctgcatccagagatcacacacacctaactcaactgtgtaaaatatattcggaagaaattcagtcaaattaaaagcatgatataagcatgcttatagagtca

SEQ ID NO: 233307 - DNA, 508 bp, Homo sapiens
gagtatcatatagacagagaggtagagatgccttctcttatgtggataaggtggattagcaagttgctattaattggcatctacctactccctcgtcatacaaccaaattagaaaatatcgacaactaatgtgcctcactagaactcaaaatgggttttcccataaaaacaaggtttatacaaagaagaagacaagcctactctatacgtgttcaatgctgtaactcaagacacaatgccagtaatggagagcatttcccttcttgataaaacagtgtctgatctgagaacactggtaactctgagatgtggcctccccgtgagtgtctactgtctccgaaccccaagggcctggagatgtatgattgcaacaccctcaaggactaccagactgatattggtactggccagtatatttgatatcagctaccatttggcactgctagggtcctttgataccagattttgcagcttttcaagagaaaatagaaatctagattttcatata

SEQ ID NO: 233308 - DNA, 612 bp, Homo sapiens
gagtatcatatagacagagaggtagagatgccttctcttatgtggataaggtggattagcaagttgctattaattggcatctacctactccctcgtcatacaaccaaattagaaaatatcgacaactaatgtgcctcactagaactcaaaatgggttttcccataaaaacaaggtttatacaaagaagaagacaagcctactctatacgtgttcaatgctgtaactcaagacacaatgccagtaatggagagcatttcccttcttgataaaacagtgtctgatctgagaacactggtaactctgagatgtggcctccccgcaaccattattgttttgaagatttacaatcaaaaccatttccaaattaaatctgaacaaatggaggcattatttctaaatggaaacctctggaaagtgaagttctacaatttctcctcagagtactttgctatagtgcacatacctgctctgcacgcttgctggaggctgaaccctgcctagaacatgatgggggctcacataaggaagggcacacagtggcatttgtccccaactaactgataatttagttatttaatgaagtaccaaaggatgaaacaaaactaggaaaa

SEQ ID NO: 233309 - DNA, 571 bp, Homo sapiens
tgccttttgccccataggatgctgcttctaactgtactgactcctggtcttttatccttgtgggacagttgtcacagcccccatgcctagcctcagatttcctttacttatcactgggggctgagctcgttggaactgagtgcttagagctaagtgctgactgggggctgcctttccttgcaaaagttctttctttcaccctagacactgtctcagctttcttgtccccacagtgacttgttcaaggacacatcaaagactgaaaatatagccaaagttctcactttctggtccagaaactggatgaaagcaattgacgggagtgacaatgcagatgtctcaagttgatggaagcaaatattaacaagttcatctgccaaagaagagaagccggctaggtggagcctgatgttttattcttcaagcacagctatcaactttgagtgagaggatacagaaaatttatttctactttggctgctttcagaactgcatttatcagcagctccagcataatctacatcaagctgcaaagcatcaattggcagcctgtttgaagcagatccaggct

SEQ ID NO: 233310 - DNA, 466 bp, Homo sapiens
agtgtccatatatgtctgggtttattttctagtctttctcttaggttccattggtatatctatttctcagtgcacacttatgtcttaattacaatagctttaacataaatcttcgcagataccctatttattctttttccgcagcagtatcttgacattcttgatcctttgtacttttatacaaattttagaattatcttgtcaaattccataatgccatctgttggctatgtattggggttgaatggaaacaatagattaatgcagaggtaattgatacatatacaatgttgagagatgcaatctctaagcatggtacatttcttcatttatttaagtcttttgtaatgtctttctaagttttactttaaactctaatattttctttaaaaggtcttgtacaactttttggagatttatttttagtttcttaatcttttgatatattaaaaacagtaattaaaat

SEQ ID NO: 233311 - DNA, 166 bp, Homo sapiens
tagttgttagtgtatgaaccgtcttcactatgctagtgagtcagctctgtgtaggacaagatgaactggttttcaatattttaatatcccttgtttcttcaaggagatcagggattatacacttttcaaattctaaataaaagaatgtgctttgtttcttaatcaa

SEQ ID NO: 233312 - DNA, 405 bp, Homo sapiens
agacccttctgggtgccaagaactgtggccttggtaccagggagagaacactgtgttcctgggcatgaagctgcagaggctgcggctggagttggcaccctccatttatctattcatttgtttattcattcttttgttcaatagatggttattgagtaccttctctgtgccaggccctgctctaagcaacaggaaataccatcaactgcagaatacagagctaaagaatctgtcttcgtggagcatatactctagtgggaagaggcagtaaaacaagaatcataaaggccaggtgcagtggctcatgcctgtaatcccagcactttgggaggccgaagcaggaggatcacttgagcccagaagttcgagaccagtctgggccacatagtgggaccccatctctac

SEQ ID NO: 233313 - DNA, 379 bp, Homo sapiens
gtgcagtaattctggactgaatttcaaagttacccaaattaacatatttgaccacagtgacctttccagcttgatttacttctgttccattaccaaatttctggcgctggccaatcaactcatcttctcctatctcttgagctttcaagcctcattgctttggctcatgccatcctcttgccctaaaatgccctccccattgtgttctgcctgtgtagctcacatagctttaaagggtcaccacaaattccacctcttattgaagttattcttgacccctatattcttgtggcaagtttttaatctgtgaaaatcacaacacttcacctccagtctttttccaggtacccacatcctgctttcaacctcttttgtgttg

SEQ ID NO: 233314 - DNA, 428 bp, Homo sapiens
tagagttcttctaacttttaaattcatttcaatcaggttttgatcaccactactctactgctttggtcaaagtcaccagtaacgtctgtgttgctaaattcagaagtcaattactagttttcattgtattttacttaccaaccccatttgacaaaattggtccgtctctcctccttaatagactttattcatctggcgtccgggacagcaaactcctagttttctttatagctctcctcagtctcccttgagagttcttcattttcctgttgttgaatttcagtgcttcagtcttgagacctggtctctatttatacccatttgtttgggattttatccaagtttatggctttaaatatagtccatttgctgaatacttccaaatttatatctccagccttcacttgtcatgtgacaactcttattta

SEQ ID NO: 233315 - DNA, 477 bp, Homo sapiens
tggctccagctgaaggtgtaggggactggccttttataagccttgtctgtcagtcattaactgtgggctgatccccagtctgtccgtcattaatgaactgcaggaacttcgggctgatcctggaatggggtggggcagggggagccagtgatccagttcagcccagagtgcttcttcagagagggggcatctgtgagccactgacaactgatactttcagactctggggatgggttctctgcctgctgaggggatctgggtttggggtactagcagcatccaatacagaaggtcttatcactcgtatttaatatttccccattgttgtaacagacatttactggttcctgggcttagcactggcgattcataagagaacaagtctgatgtgttctctgctatcaggaaacctatattctagtggtggggaaaagccaacaggttatcacaacagattattgaaacccagtgtaaaca

SEQ ID NO: 233316 - DNA, 360 bp, Homo sapiens
tggctccagctgaaggtgtaggggactggccttttataagccttgtctgtcagtcattaactgtgggctgatccccagtctgtccgtcattaatgaactgcaggaacttcgggctgatcctggaatggggtggggcagggggagccagtgatccagttcagcccagagtgcttcttcagagagggggcatctgtgagccactgacaactgatactttcagactaagagaatgaacagagcccctgagattgagacctcaccctgagctctcagttgctccatatagatctttgaaatcctttttgcctttaaaatttctatacattttaaatatccataaatagaatacattcacactcg

SEQ ID NO: 233317 - DNA, 2811 bp, Homo sapiens
  misc_feature (2301)..(2301): n is a, c, g, or t
  misc_feature (2563)..(2563): n is a, c, g, or t
tggctttaaacaatagcagtcatttattttgctcacaaatctgcaacttgggcagtacttggcagaggcagctaatctccatttcacatggtatcaactgggctgtttggtggtagctgggggatctactttcaagatggcacactcatatggctggcaagttggtgttggctgtaggcctctcgacagactgcttaaggcttcctcaaaacatggcagctaggttctaagagcaagcatcccaagagaagaaggtagaagttcatggaattctgatgattataccttggaggtcacataagggtccttttcacctactcattggttgaggccgtcataaggacccatagtggttgaagtacaggggacatgggttccagctcttgatggaggagtgacaaggttccagcagaccatgtggaatgagaaatattgttgtggccatctttggaaaatacagtctgccacatacatgaattccaacatgcttatgttcatttctggttcattcttctactaggagagaactttgagaatacgtaacaaataaaaatgaaggcgagaagtggaaataaattcagtattgaatataagggttattggacattgaagataatctttaaatgtataattctcagtagttgttaatgcaaagctgttccttccctcccccccgaaaaaaaacccatctcctatttgttactcaaagggatcacatatcttcatgtgctctgaaactctcttaaatcatttccatcttccagaaaaaccatcccagtgttctccagggtatttacaaaagaacaataaaacattcatttttttagcacactgtaatgaaaaccatccccaagtacttagtttaactgccttgtttaccgtgggagtttcaaatgtcattaggaccctgttatatttttgttggtctggagtcgtgggaatcacaaagtattttttaaccaagggttaaaactaggatagcaatgcccaatggcaccatctcaacattttgttaaagtgtgtttcattaatgctttggaagcctatgtaaatcagaggatggtggggggaagaaaaggtcacgaatactggatgttaaagcagtgtggtgtgaagagaaacatctgctcctggttaaattctttaaacttatgttcttttgactcactcatttaactgtggtgctgagatttgagttcaatgaagactctaaagctggttttccagaatgttccagggagtcttaatgaacccttgagttcttaaccccaagcttgtaattccaaggtcactggtattaccaaagtataaaactagggttgtcaacctcagcaactccaaaaaactgtctttttgttttttgggacctacattgcctcatcttagtgcctttgtgaaacaaggcccatgggtatgcctgattatgaggcattttttaccttgataagaagtagtgatattaacaaattgcttattgctacttcttttctttttcctgaggggaagattgacttggtttcttaagagatggactgaaaacccacgaactgcacattttaacagcaatgctttcttgagacatgtctctggacctgcaacccccttaatgtctctaggcctcagttttcttcactgttaagatgataggagtagcaaatgatgtgcaagttttctgaatctcaaatgaatatatttttaaaacattattggtcccagatggatatttcctgaaattgtagactcatagatgtttccacttgggggtaacctcagatactgcaaatttaatctcatgcctattcattcctttaataaatgcccaaggaatacttactgtgtaccaggaacagttccagatgctgaggacaaagcaggaggcaaaagagacaaactgcctgtcctcatagagctctcatccagctaggaaaaccagttgtagggagatggaggggggaacagcatgccaaacagagggatctgcaaagtgctgaggccccctgatgggaacaaatcttggggtaggggggaaacaatgacaaagacttgtgaaggtgtcaggagtttgggatgtggcctgagaggtgggcaagacccatttcaggggcagggcaagggttgggaatcttattctaaatgggacatcgttggagagttaaaacgagcagccttaactggctcacatctttcagataccagcctggctgctgtgagggctgtatacaggccagcatgcaggaagaaaaccagcagaaaggtggtggtgaggccaaggaagagcatctccaggaggaggggaatgcntgagctaccagagaggatggggtggtgagggctaaaaagcctgtgggatttggcgtcatggaggtgacaggagggctgtggggagctgccggtgaggaggcagtacagaagctagagagtgagtggaggtggagtcggtgaggcgggtgggtggacgaggcttgcttacttctattgttggttggattctttcctctttttcttcttttaaaaaaagataacttgaatttagttgtatgctgagtggaaggagccagtaganagagagagagagagccaaagctgtccgttttgcagatggacaggaaggagccaggacacagctcagctcgctcacgcccagagagagaaaaagttaagctgctgaccctgaaggcaagggagagcaggctgcacagctgtgtgtggaagccacgggctcaagcagccaaggcagggcggacagtgtgagagagctagtgtaagctgttgatgagagctgttgctgaataaaaccatattcccctgccc

SEQ ID NO: 233318 - DNA, 301 bp, Homo sapiens
aaaaaatgacatacaagccatgaagaggctcccacatcccacttctctgctttgggctaggatgaataccacttcttgaaaagattggcttctgcaattaccactgaataaacaaccaattaaaatgtctcccctgcccctaccccaccctttttctctcttgaagctttctcatctcagagctatggggcagaggtggctttctctaataacatttgtgttctctgcctgagagaacatttgatggaaatgaacaaatcaattagaaaataataaattatgtggaaagggctgatccaag

SEQ ID NO: 233319 - DNA, 465 bp, Homo sapiens
ggcttccagagttgtatgagataatttccatatatgtctcatatatatatgagacagagagaggtttataaatatatgtatacacacacacattctattttcctgtttctctggaaaaccctgactaatacatttcattagacctctgttttcccatctgaaaagtgaagacagtaatttttacctctagaattgttgcaaagattacatgagacaatggacccaaggcccatagcacagcatctgttaactgagtaagcattcactagaaattgtatttatgtttgtgactattatagggaaatgtctttaggcgtgtgtctaagggctgaattcagctgtgtgtctcactcctccctgagggctgtgccacggtcaggtggcttccaatctgtactcaattgttactgtacagactgtttcttttttagtggcagtcccttaggtcccaaggtgaataggccg

SEQ ID NO: 233320 - DNA, 1398 bp, Homo sapiens
  misc_feature (8)..(8): n is a, c, g, or t
  misc_feature (735)..(735): n is a, c, g, or t
  misc_feature (922)..(922): n is a, c, g, or t
  misc_feature (1251)..(1251): n is a, c, g, or t
ctacagantcgatgaccccatacggcaccccatcatgcctgcatcatgcctcccctcttggcctgtgcctccttatgtctgcagatgggcttcctctagcccacacctccatcaaaggacagggacccccctgcctcgtgccccatgatgcggcccacatggcgcctccggcctctgccccctctccccacagatatcgacgagtgtcgcatctctcctgacctctgcggccagggcacctgtgtcaacacgccgggcagctttgagtgcgagtgttttcccggctacgagagtggcttcatgctgatgaagaactgcatgggtcggtgactgccgggcaggggtgtggtgggcgccctgggcagggagggcattgaggagagggagggtggggacggctgttgctgtgtggacgtggatggagggggcaggaggagggaggagctgtaaattagctgaggtacagtgagtctgggctccatgaggcctcgtccttaggagagagacctggggcctgagacctgggggtggccggcacactggggtgtggtctcccagggagggtgtgtagcttgggtagaggacagggaccctcagagaagcctgggaaatactgccggttatgaggcctctcgtccccatcattgacttcgttattcatttgatgagcatttcacatgcatcctctgagctagaggcactgcagggagctctagctccagggagccctctttncttggagctcacagcctaacaggaagacagacatgaataacatgaatcgctgaggaaatgcaaaactgggctgggtgcagtggccctcgcctgtaatcccagcattttgagaggctgaggcagtaggattgcttgagtccaggagttcgaggccagcctgggcaacataacaagaccctgtcactanaaagttttttaaaaattagctaggcatggtggcgcgtgctactcgggaggctgaggagggaggatcccttgagcccaggaggttgaggctgcagtgaaccataatcgcacttttgcactccagcctgggtgacagagtgagaccctgtctaaagaaaaaaggaaggaaggaaggaaggaagaggaaaaagccaggcatggtggctcatgcctgtaatcccagcactttgggaggctgaggtgggcagattgcctgagttcaggagtttgaaaccagcctgggcaacatggtgaaaccccgtctctattaaaatacaaaaaattagctgngtgtggtggcgtgcacctgtaggtccagctactcaggaggctgaggcaggagaattgcttgaacccaggaggtggaggttgcagtgagccgagatcgcgccactgcactccagcctgggcgacagagcgagattctgtctccaaatt

SEQ ID NO: 233321 - DNA, 332 bp, Homo sapiens
cacttgaggcgaggagttggagaccagcctgggcaacatatcaagaccccatctctactgaaaaaaaaaaaaaagtttttaattagctgggcatagtgacacccacctgtagtcccagctactgaggaggctaaggcaggaggattgtttgagccaaggagattaaggctgtagtgagccatgatcatgccattgcactccagcgtggacaacagaacaagacactatttaaaaaaaaaaaaaaagaaagaaagaaagaaaactgaagaaaatgaaatgtgtccacaaggcctggccaaggcaggcatcagatatcagttgcccccatcttc

SEQ ID NO: 233322 - DNA, 464 bp, Homo sapiens
agctcgcctctgcccagctggacgatgcaggggtctacacggctgaggtcatccgggcaggggtctcccagcagactcacgagttcacggtgggtgtgtatgagcccctaccccagctgtcggttcagcccaaggctccagagacagaggagggggcggccgagctccggctgcgctgcctggggtgggggccaggtcgcggggagctgagctggagccgggacggacgcgccctggaggcggcggaatcggagggagccgagacgccccggatgcgctcagagggcgaccagctgctcatcgtgcgccctgtgcgcagcgaccacgcccggtacacttgccgcgtccgcagccccttcggccacagggaggctgccgccgacgtcagcgtcttctacggcccggacccgccgaccatcacggtctcctcggaccgcgacgccgcgcctgcccgctttgtcacc

SEQ ID NO: 233323 - DNA, 371 bp, Homo sapiens
atattggaagttctgattatggtaaaactcaaaatgggtgttcttccagcgtaataagtttattttcagctccttttaaacagttctgttattagtgaaagaggaactgtttaagattgtgatttataaacgtgtgaagtctcacgtgctctcaaaccaaaggctgtcagaggttggtgctgcctgttctcgaaatggctctggatgggggccgtagccacgtgtctgtgcatatgctgcttttgctctgattttaaagctgtaggcttgctaattccataaggatcgtattttgtttctgtcaggacatggtcttgtaaggatatgtactcaggttgtgtttctaattaaaggcagtttttgattcaaga

SEQ ID NO: 233324 - DNA, 523 bp, Homo sapiens
gcaaaggatttatcaggattagcaatcaactgagcagtggaattttatgaaatgcctgaaggtaattatgtggaattgtgaaatgtatatcagtgggattactctagtcttgtctaattatttgaccgttatcaatacaactgagtgataagtatttagaagatgctatttaaatatttttcagtgaatactgagaggcacagtctcttgataaaccccttcctattcaataagcatgtcaaaatattaaacaatgtcatcttaggaaaggtaagaatggaattttggaacttaagctaaaactgccataaagacgctatggcgtttcaaacaagctgtagttgtttgcatagattggtagaatttaattttggaaaaattactaatctgaacaactagcgatcagccctggtgcataaaattacttgctttcaaaaattctgaccacaaatattcacaatggatgcacaaacaaattttgccagccacaatacgaaagatttttggaatcttaccttgtctt

SEQ ID NO: 233325 - DNA, 1559 bp, Homo sapiens
  misc_feature (925)..(925): n is a, c, g, or t
ttaaaatgctattatgaaacagattcattcattcattcatgttgcccacctggtccccatagtcatcggagttttccactcttgacgaacgaatacttgccctattttccaagctaagtcttgaataccttgtaatgttttacttcttgtggcatcctgcactttgtgtaaaatcaggagtggggagtgccaataaatatttgattgactaattgacagcttgagtcaaggttctggaagagaataaatacaagggaaaggcattccctttttcatttagaccatattttgcctaagccaaatggacgatttacagctaatcattgcgtcttaaccagggacagctggagcttactgcttgcctcctgcctagtcgtctttattccttctataaaggcagaaaacagaagggctctgcacacagcagtcacagacgctcatcaaagacaaaccactgacatggaaactgaacaagaaaaggcttcctggttcaaggctggcttttgggagccatgttcaagcatgccctaagtagcacagtcagcagcctttttccttcactctttaggggctggggttgaggaacaagattccctcaattttccaacaaataacctatttcagtgaaataaaaaaagggggggtggggcattggtgcagtcagtcattcatatgccaagttgtagccatgttagtatttcatgccagtaattctgtctagcagaaactcatcctggctcttttccattccttttagcaagattgcagttgtaaatcagcaggaatgtcctggagactgctccaggtgggttgtcgggagcagtctggaagaagaatcttcagaataatttaggttatgagtctaagagggaaggtcaatgctgctatttagaaccagagcactatgccaaatttggctttgganggatgcgttaaatgtcattcttggaatttgaatttagaatattttaaaaacacgatcgtttgtacattcacccctacaagatttagccagggttctcatctctgacctctgaacatcctctaaatttgcgagaccactatagtaataatccaatttgggttagtactttttactcataagaagagtttcatttgtagcttttagaggaaatggagtgagtatcattctgatctcaagggcactgtggacagaaattggatttgcagagttagtgtaggtcttggttctacctcttaataacagtatggccttagacaaatactttgtcctctctgggccctttctttctttctttctttctttctttctttctttctttctttctttctttctttctttctttctttccttctttcagaaacagagttgggtggaggttggaaggagggagaggatcggaaaaaataactattggtcactagccttagtacctgtgtgatgaaataaataatctgtacagcaaacccccgtgacatgagtttatctatataacaaacctgcacatgtacccttgaagctaaaatgcaagtttgtttgttttaaagaaacagttattcagaggaatgaatgccac

SEQ ID NO: 233326 - DNA, 316 bp, Homo sapiens
ttttttaataaggccattctacttatatgaacaatgtcatatccataacggtggattctgcagattaatgatactctaatttttatttataaacctgaaaaagctaggtgcatacaagaattagggcaatgactttagccaccgaaatgctggacatcagaaaagcacctgaagttatgcctagttgcacaaaacaaaaactttaatcaggtgccttcaagtggaaggacaaggcgattcctgaaacctctacagagacacctactatatcatctagtttttcatctttcttcagggcagggagtcctccctttcc

SEQ ID NO: 233327 - DNA, 257 bp, Homo sapiens
cagtccaccttcaattacttgtgctatctttagcattcaagatacatttctatatatacaccaaattgtaggcaactatgtaagggcaataaagcaattttctttttctggtatgtggtatcccctcaatttcgaagtcatacagtattggtttattttaattcaaatcaactccacaacttagtaaacgtttatcaaatgcctattgtgtgccagggtcagacataaattgcatataataaaatcacctttaaaac

SEQ ID NO: 233328 - DNA, 405 bp, Homo sapiens
ggccacagagggagaccttgttttttttttaaatgcacctggcatataacagtgcttaataaaaattttaagacaacttaagaaaaacaagcccctctaagattatctacattgactttgtgcaatccctctcattatgtattggtgaactcagaggaacaaaatgtttcaagtctaagtcacataatcagttgataaatctccaaagcaaacccgtcccctcccattatctagaaggctactttataactgaataaaaatcatgtttgacttgtccttttggcacggctagttacgttaaaggtacgtaatggaaaataaactagagctggctggctatggaggaaagagatagatctaactccgagcaagcaataccattcgcatggtagggcaagcacatgc

SEQ ID NO: 233329 - DNA, 257 bp, Homo sapiens
gaacccagatttgtttattccgaagttgtaagaccactaaggtcttaacagttattaacacttagaattcatacaagacatgagtagtcatgtatatgctgtgagtttttttacttgtcatgttggtgatctctttgtacatggttgccctctctggggatgggtagaacatatgactaattaaacattacaggggcatccattaatattaaacgagtaaggctttgtgctgctgaactccagctcatcctttaaca

SEQ ID NO: 233330 - DNA, 385 bp, Homo sapiens
gaggacagcttcgcctggggcgcagattcctcgagggctgggacggcgacgagggcctgagggttcgattcctgttccagcttgctgagtccagcctctgggaacgcggcagggtccgaagggaggaggcaggcgcagaggctctgctgccctcactctgcggtgtgaccttgggctgcttgtttagcgtctcggagcctcggttagtaagggaaataatgaatgtgaaaggtggggctcttgccgggccctcgctgagtgtgaacggagtggaactttttggggcaatcctacttgcgtccctaaaaggggatgtaaaaccctgtttcctcctgaactcctcagggactattaaaaatgcaaatatgccaaacaaatgtggtta

SEQ ID NO: 233331 - DNA, 220 bp, Homo sapiens
agggcaagaagaaactagctagtccctttttgcccttctgcttgtctgcagtgtgaagacacagcatttgtcccctctggagatgcagtagcaaggtgccaaattggaagaagagatagacagccctcgtcaggcaatgaacatgctggcctcttcattgcggaattcccagcctccagaactgtgtgaaataaatttctgttttttataaattacccag

SEQ ID NO: 233332 - DNA, 248 bp, Homo sapiens
atgtaataaagcatgttactttcatgactaggttttgaagatgtttggtacaatgttttaaattcattgcattttctggagaacaaaaagcccacctgtttgtaaggcatcctggtatgtttagaatttctcattgatttcaggaactctggccttgatgttaaagaaagtgatcacagacctttgtttaaggcaggcagggatgcatctgactgtcagggaaacaacacatctctgggggaacaaag

SEQ ID NO: 233333 - DNA, 463 bp, Homo sapiens
ggccccagttctgcttcttgaaaaatctagaaacagcatctcaatagcaaccatcagccagaattctgtatcagtttcaccttaagcagggcataaggactcctagacttccccaaggctgttattatttcccaccatcccccccaccacaatatttaaagtgtttaaatcatttattttgaaattcttatgtgatccaagaccactgtgcatttaagctagtttatttgtttattaaaacaaaagaagtagactgcagttacgttgtttctttttctgttgtttggtgtcaggagtagaatacatttggccagcttcatgagaggattagaaagttggagaaggaaaaatagaattgtttacggagccaggagaataattgtctataattatagatgcttgttttgaggtttggaaaaggtggtttaaaaaacttttaagaaaaaacatgataaacatctat

SEQ ID NO: 233334 - DNA, 428 bp, Homo sapiens
tcattgtagatttggaaagtattgagtaggagatgataatctataatcaggattctgagttggtaagattttatagatctgaaaaaagtaatttcttgaccttggcctcaataagaaagtcagaacttgacccttatttaccagcaccatcccccccaccacaatatttaaagtgtttaaatcatttattttgaaattcttatgtgatccaagaccactgtgcatttaagctagtttatttgtttattaaaacaaaagaagtagactgcagttacgttgtttctttttctgttgtttggtgtcaggagctgaagcaggagaatcacttgaacccaggaggcggaggttgcagtgagccaagatggcgccactgcactccagcctgagtgacagagggagactgtctcaaaaacaaaacaaaacaaaac

SEQ ID NO: 233335 - DNA, 4233 bp, Homo sapiens
cgcgaggcaatcgtccggtgtgtgagcccgggagccggaggtgtagcggcagagacattgttcttgccggctccctacggtgccgtgtgtgcgtgagagaagaccagtctttcctctagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagc

SEQ ID NO: 233336 - DNA, 759 bp, Homo sapiens
gggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggtaaattttaaacaaataatttggtatttttatctactttttttcttgggtatgactatatatattttgcatttcctgtctcctcattatctgacagtatctttgtaaacatgtctaaactgtattcaatattttattcatttgatggcaaaaagtgtttttaactgcaactcacagtaataaaaacattttatgtcatattctggtacataacacattcatatctatatatgcacacgcttattcttatatgtactctagtattttatttttagagtcatggtctcctctgtcactcagggtggagtgcagtgatatgatcatagcccactgtggcctcaaacttttggcctcaagcgatctcccagcttgcagcttgcattcccaaagtactgggattacaggcatgagccaccaagcccgacctttatt

SEQ ID NO: 233337 - DNA, 4322 bp, Homo sapiens
gggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagc

SEQ ID NO: 233338 - DNA, 1727 bp, Homo sapiens
cagagggagaagtcagcggagaagctgggagctcctttggaggctgcggtgtccctgactctcctgaggggggctcactaacgggtgggtcccatgccacagtgtctgaggagaagcaggaagtgagtccctgaggagacgccgtgacctgagggcttcccttactgaggaggcctcgtgcttcatctgccacaagcggtgcccaggccggtggtgacaactgggacgatgctcaggcttctgagacttgctttggccttctacgggaggacggccgaccctgcagagcgacagggcccacagcagcagggcctcccacaaggtgacacccagttgacaactgtgcagggagttgtcacaagtttctgtggtgattatggcatgattgatgagtcgatctacttcagtagtgatgttgtgactggcaacgtgcctctaaaagttggacaaaaagttaatgtggttgtggaagaagataaaccacattatggattgagagcaatcaaggtggatgttgtgcctcgccatctttatggtgctggaccctcagactcaggaaccagagttttaattggatgtgttacttctataaatgaagataatatttatattagtaacagcatttatttttccatagccattgtttctgaagattttgtgccttataagggtgacttgttagaagttgaatattccactgagccaggcatctcaaacatcaaggcaacttctgtgaagcccatccgttgtattcatacggaagaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaatgacaaagcatttttattctgtttatctttccttttatgagcagtaaaggggctggtttaacttaaaaggttagcttagtaagcctaaatagtattttatatatgacttttctggcaaatctaattgagacactggccagtccaactggaccaggaacccagcttagggaaataacttattaattaaaaagcatgctaaattagcttgctagtcactggaggaaaggagttcttaattaaaatgaacacggccattaaatttgaattccatatttcccattagcagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctctcacccacataacttgcggtgtttgttgttttacttgttccttcttccccatgctaggatgtaaactccacaatggcaggatgtcttttaatctggttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgc

SEQ ID NO: 233339 - DNA, 334 bp, Homo sapiens
ctgtgtaagaggatggggtcggtgaggtggggtggtgtgagcaatggagctcaagggctcaaggtgcaggcctggactgatggccactaggaccaccccaatggcttcagggtcaggacaggaagggaatgtgattattgcagcaggtagtagggcagtatgagtgtattattcatatatgtgtgatgaaatggagcatcaaataatatatcccataggatagaaaggcacagtgagtgagtttgggttaaaaattcgatgagataaagtggttgtacctcctatgaaaacaatttaatttcttattatgaaggcattactcatgttcttcaga

SEQ ID NO: 233340 - DNA, 367 bp, Homo sapiens
ttgaccccatgccaccgggacaccctgggactctgtctgttggggattgcaggctgagctggctggggttgggagcaggttaggagaagatggggtctgatctcccagctgtctctcccaggtggaggttgagagcttcttggtgcccagggagagcgcctgccaggcctggctctgccctagcctgtgacgggacgtgctgcaggtggctggccaccgaggcttccgggagctggggagggcggctgtgaagatgtgcccgggccctccctgtttccagccttcctgcagggcctgtctctggagctgatgcagatggcaggaccaagtgccaagcctgggggcatcatagtgaaaaaaacgctta

SEQ ID NO: 233341 - DNA, 325 bp, Homo sapiens
ttaaatgttactgtatctgtaaagtgaagatatgatctctactctgccgtctcaaccatggctgcactttggaatcacctggggagctttgaaaaatacgtctaaatcccaccttcaagagattccaattttattaaggtgcagcctgggcattgagatttttaaacccaccacaagtaattcctatgtgcagctaaggctgtgaatctttgaattgggggatggctaagaaagccctctatagatttacttacaaacattagtagatgttatcgacaatctaaattgttttttgtttgtttgaccattacttcaactgtttaaa

SEQ ID NO: 233342 - DNA, 454 bp, Homo sapiens
caaaaagaaaaaggagttaataatgcctagctattttgaggattacagcttatatatctatatatatacagtgtctatcacatttactatttagtaaacttccattataacatggtagattattatatattttcaaaatagtccaccacattgaacccagtactaaaactgttcatggaaattactattcattaaatatactgggagtttagctaatgtcagataacctcgccagattatacaataaggggatcaaactaaaggaacctccaaaacctatctagctctaaaataaataacacaatgaaattaggcacacttagcaagtctgaaaacagtcaaaaagaagggtatagacaaaaatgttcccaaaaagaattattccacaattagctactgctcattttcaggaggaagtctgcaccaaggaaacgctgatacaaataggggctcc

SEQ ID NO: 233343 - DNA, 606 bp, Homo sapiens
gtttactgttagtatgtctcagacatggaggtcaggtgattgaatacaagaaccaaatagagtttttattcttgcccttagatgatagccagtgttgagactttgttaaacctcttgtttcacttagttgaaagtactttatacaaaaaaagcaagaggagccaaatctgttgagaaagtagaaaatatgacttggcttctaatggttcccctcagcccaaacagtcacaggcatctctcatttttgtttctacaaatgtttatataggtagcaactatcagtatcctcttgctcatagtaagttatttgatggtgcagactctatcaccgtatcttcaaaagtggctgactagggaatgcacacagtatgaatcgtattctctgataatgtctgtggatatatttgactgatttgcctcttagatgatgaagtctgatgtctccatggaaattccatttgagagagatttaaaaattaaacatcatgaatattaagcagtgctgcctggaagttcagctccaagtgacttaatcactttgtctgcagttttccttaaagaagccattgtttgaactaggaaggcatttgtttttctaaatagaaa

SEQ ID NO: 233344 - DNA, 608 bp, Homo sapiens
cagaaagtcgggtgtggggagagggtagtgatgaggattgttgagaaactaaagtgcatcccttggggaccagctgaggaagggagagagggaaaatgggtagggaaaagaaggaaaagaagttggacaaagagaaacaagtacatgatgctgtgaaaaacagcagagactgtcaacactcaggctgctacgttgaaccagcttcttgtattgtcttgggcttccggcatcctgttttatctggacaggtggaaaattcatttcttatgctgtctgttaaacactggatgagttgctgtgctgtgtgaaaatgtttgtgtctaaaaataatgggcttacacacagaagtcttcaaaatctaaaatggtattagacttaataatgagtgtatttcaggtgaaaatatgtctcctctcctttagtagctacctggggaaaatgaccctatgatagttaggctggcccttcagaattttgaccttgattggcttcctgtttctcactatttcttggaaaactgaggcgggagtgtgcctgtaaaataatgtcaaattaaaggcagtcttcaaaataggtaaggttcattatttattttgaattagtgctat

SEQ ID NO: 233345 - DNA, 424 bp, Homo sapiens
ggtcaggatgctgaaactgtcttcttagtggcttcttcactgcataccacagggccaggcacattgtgaatgtttggcaaatatttgtggaaggaatgaattgtgggctgaccgtgtgctctcagcctctatcagcatttcattctgtcacagccattttcccctgcaagattggtggaggggaaagggtaggcctcctgggagaggttctggatctttctgccatctgctttgttccatgggtcagccctgaaattagggcatttggatgggtttgcagcctcaaagtggagaatggattctgcctgcgaggatgtgtaagcatcacttcatcgatggtttgctgttactcaacttccagattaccttttgagcacccttttaggaaagagaggaaagttaataaattacattttacccactg

SEQ ID NO: 233346 - DNA, 455 bp, Homo sapiens
aggtcatgagggggaggctttattgacaacggagaaggcagagttctaggcaagttcacacaacactgctccaagggtccaggcacgggtcaaacccgtcaggaccaagggcctcttcacctcagggacctcagtccctcccaccatcctgaaccttcccacaccttttccagcaacccaaagatatccacccccaagccaccttctggacaaagtgagtggcagccactgttgtggagccaggaccagagttgggtctgaggcctaatcatgtgtggtgggcacagtaccccctctcctcagcctctggggacaggcaggaggtaggcaggggcagcagccccagcccacagagccctcactgcacgaggccgatgtggcaaaaggcaggagccctggcatctcctcctccctgtgcctgagcggggctctacaaagccgagcctcctcaggtc

SEQ ID NO: 233347 - DNA, 530 bp, Homo sapiens
cagaaaatacctgcttggcctcctctggttctccaagagaaggtatgtctgcaacgcatttaagttgcctagttatgtcaacaagacacagaattcactggcttctgaaaatgtacacatgttaggaaggtgatgacatttttctacagctctctcaacttcgtatgtagcagagctacagcaaagagtgtgtatttcttggtatatgtgcttattaagctatcacataccaattagagaaggtagctgtagattaacaaaggaacactctctgagaatttaaactgttgcatggtcactttacaaagtctaaatatttttccagatgatttaatgaagcaaacctggacttttttcttcaaggtcgtatcttcaaggaaatttttaaaatagctatttggaaagcaatggtatctcttcataggtaatagggtgagcaaggaaaaaaactgttttctttgctggtcacctctcataagatgttcaaacacatggcttatgactgttaagctaaacttcaatgcggccgt

SEQ ID NO: 233348 - DNA, 245 bp, Homo sapiens
gaccatgaacactatcatattggcatataactttctgtatgaagatccctctgccatggaatgcttcctctcaccccttttcactagttggcaaagttcttggccaagtaaaatgagaggaggagggggtagaatgaatttcatttaaagctcaacctagttcagaaatgttaaacaaaaccagagcaattgaatattcttctgatatcttgcagtatttttgttgaattcattttcttccacta

SEQ ID NO: 233349 - DNA, 932 bp, Homo sapiens
tattttttatttccactttcatctttttcatattgattctctttgactttcttttttgaactcaacagattccctgggtattaacccagcacaactcctttatgggtcattgcacattctggtatctcattaagaattgtcataaaaaagagatcccaggaggccttccagtgaaactctatcatcatgcaatcttgggatttctaagttggaagtcacagtccctttgcaaacataataaaacactttaaaatatttgctaaagttacaaaccaattatgtaaaaatttaaaaatcacctactacttttaaaagcagagaaggcatccatagactatttccttgcttacaagctcagtgaacatactgaattcacttataaaaagaattttctcaattttagttgcttttcaaaaaattcttattccttttatttgtaattctttgacattgttgctgcttcacagttttggtaattggacagtttggtctttattatgatattaacatttttacctgtcctgaaacaaggaaatacaatcaaagaaacagaagattggtggaccttgaaccacattatgatatcagatgacccagagtcatggttactaagttgcttaaatttttagtaacaaagatgtattagaaagtgacaggtcaattcaataatggtttttttggatacatttaattatataatccccttaagttgtgcttagtcagcagtatttaatctgttgtctattatatatctaactggtctgttatgtttattatatatttatatattgcttattcatatcttattggagtaactcatttttaaaacaatatatttcatctcctaggagaagaggatcgagtatgtgtttttattctttttcattaggacattggggtattttcttattgtgaaatgtattgaatatttc

SEQ ID NO: 233350 - DNA, 509 bp, Homo sapiens
tttgccaccaggagggggaaaaaggctggggtactagaagtaatagatttagtactacttgagagatttggaacatgctgtggacccagggttgttggtcatctctgcaacaggatggggatggcagatgtttgagcaaaatctatattaacatgctagcaaggactagttctagtttagctgtgtttcactcattttacacagaattagaattggccaggtgtggtggctcacgctgtaatcctagcactttgggaggctgaggtgggtggattgtctgagctcaggagtttgagaccagcctggggaacagggtgaaaccccatcactactaaaatacaaaaaaattagctgggcattgtggtacatggagtagctcccagctactctggaggctgaggcggagaatcgcttgaactaggaggtggagattgaagtgagccgagatcatgccactgtactcctgcctgggtgacagagcaagactctctctagctcaaaaaaaaaaa

SEQ ID NO: 233351 - DNA, 691 bp, Homo sapiens
ctaaataataaaatctacctcactttctttccacttgtcacttgtgtttggagcaacacaatggaaggagcaagctgtaacttgtgaacaggagacacattaatgaaataaagctccagagagagaactcaagctggcctgttgccgtgacgctgggctaatgacattgagctggaagagtgattcccctggagtccttatcaagtgacaccatcttaattacccagtgaaaagacagcccgtttccagcaaacaattacttcctgatcgatacccttgtcttgttaagtatgcttcctgaccatttatagccaaacatttgatgtacttttcctgagaagaaaaatcaccttcttagctatctctactcagcagaagcccctgcccacatcacacacaaaaccatctacatttagatattctgaatggttggaaactcctatttattatccttcggtgacttttatctttagatgaagaactgagaagagcacacaagttcctctcagcaacatgatttatgcttgaggctaaggcctcaacttggggaagggaagaaggttgtttcaagcctgtggcctcctgtcactccccacccctggaaggcccttcacttttgggtgtggcctagaggcctcatggacagcagtcccttctgacacccagtgagatatcatctgggagggctgcg

SEQ ID NO: 233352 - DNA, 654 bp, Homo sapiens
agagatggcattcttgctatgttgcccaggctggtctcaaactcttggcctcaagaaatcctcccaccttagcctccaaagggcttggattacaggcatgagcttcagtgcccagccttaattttatattttatgttgttctacttttacgagattttctacaatggtcatatattattgccataatcaaaataaaacaataacttctaaaagtaagaaaaaaacttaaaagaagaaagagtactgtctttgaagccaataacatttagcttcagattctggctgtgtaggttttgtcaagtcattcggcagttgttcttctgtaactcagtttcatcttctgtaaaatgttaatagtcattattacacagcttagatttgttttgaggagcataataaatataaaacactcacacaaactgtaatgaactacagagatgttgtttctgattttattatgtcttggaactgttttctactattatctctcggaactgttttcttattttcatacgttggtacctaatgtgagtagtgctgcttaaatgaccacaaggatcaccatatacatttatttaccttttaagtaaacattagtgctgggctggttctcttagtcagaatgtactgtgactaagggtacatcctttagat

SEQ ID NO: 233353 - DNA, 528 bp, Homo sapiens
cacgtaggtagctggcttatcattcagaagttttatagcatcttttatttatggagttttcagtacatggtatacatctgattcctgctagaatcagtgttcattcaacaaatacttttaagcaccgactatagactaggcacagaattccaaaaataagcaaacttctggttatcatcttgccaataagcctgcctcataataacaatcaaattacaaatacacataaagcacaagtcaacttccatttccagatacttgataaacaagatctctgaaccctccagctacgaaatcgcaaaaaatgctggataaaatattaaatatgtattttaatgtatcacagaaccagcaggaaaataataaaaattccacagaagccaaaagcaaagcaagacttgtggtgtaggccaggtgtggtagttcatacctataatcccagcagtttgggaggctgtggcaggaggattgcttgaagctaggagttcaagaccagcctaggcaacaaagtgagatcacatctctacc

SEQ ID NO: 233354 - DNA, 412 bp, Homo sapiens
ctgcctcttgttgcctgtgcgtcatcgtcattgggcaagtgagtctcacattttaaaatttcatacatgtggattttggaacttctgtttacactaaaagagataatattttaaacaactggcacattgtaactcctcagagatcgaatggttttgaggaatggaaattgggctgcatttaaattgaagcactgccatttactagctttgtaatctaatttttcagacttagtgtctcttttgtaaaaggggcataattgtttcagaggagttgtgaggataaaattttaaaatacaagtacataaatgcatatgaagaatttatcctagcacctggaccatagatgccacttcagtggtaatgactgctgtttttgttgctgaagtgtaatttgattttcctgtttttcac

SEQ ID NO: 233355 - DNA, 776 bp, Homo sapiens
gctcattttctcttgctgctaccatggaagaagcgactttcgcctcccgccgtgattctgaggcctttccagccatgtcaaactcaaaatgtgactgaaaaacagaagcatttggaatacgtaacagaagtcattaaaaagagccatgtaatatgtgcctgcttccccttctgccatgattgtaagtttcctgatgccttctcagccatgcagaactagtctcactctattgctcaggctggagtcagtggcgcaatctcagctcactccaacctccgcctcatgggttcaaatgattctcctgcctcagcctcccaagtagatgggattacaggcacatgcccccatgcccagctaatttttgtgtttttagtagagactagggtttcaccatgttagccaggctgttctcagactcctgacctcaggtgatccacctgcctcggccttccaaagtgctgggattacaggcatgagccactgcaccaagccttattctattgattattataagaagtgttaacatcttgaactatgattatatattcatcaatttaagcatatacatttgattttgttaagtcctcctgaagaagtctgtttataatattaaatatcctagttgatcactgttttaaaatttacttttttatatatttttttcacttaatgtaactctgatcaatgctacttcagtatgctggaagtggaattacaatgtggatattttaaatgaggaaaaaactggcttttaattttcaagtgagtcttatgta

SEQ ID NO: 233356 - DNA, 859 bp, Homo sapiens
gctcattttctcttgctgctaccatggaagaagcgactttcgcctcccgccgtgattctgaggcctttccagccatgtcaaactgcatccactgaaggtcttggaatgtatacctgatggataaggaggaactactattgcatgtgattcaacaattctacttctgacaaaatgtgactgaaaaacagaagcatttggaatacgtaacagaagtcattaaaaagagccatgtaatatgtgcctgcttccccttctgccatgattgtaagtttcctgatgccttctcagccatgcagaactagtctcactctattgctcaggctggagtcagtggcgcaatctcagctcactccaacctccgcctcatgggttcaaatgattctcctgcctcagcctcccaagtagatgggattacaggcacatgcccccatgcccagctaatttttgtgtttttagtagagactagggtttcaccatgttagccaggctgttctcagactcctgacctcaggtgatccacctgcctcggccttccaaagtgctgggattacaggcatgagccactgcaccaagccttattctattgattattataagaagtgttaacatcttgaactatgattatatattcatcaatttaagcatatacatttgattttgttaagtcctcctgaagaagtctgtttataatattaaatatcctagttgatcactgttttaaaatttacttttttatatatttttttcacttaatgtaactctgatcaatgctacttcagtatgctggaagtggaattacaatgtggatattttaaatgaggaaaaaactggcttttaattttcaagtgagtcttatgta

SEQ ID NO: 233357 - DNA, 205 bp, Homo sapiens
caaaatgtgactgaaaaacagaagcatttggaatacgtaacagaagtcattaaaaagaggtatgatgaatatgatgaacttagaatgatactgatcttcacaatgaagcataaagttaaaagcagataagtattgaaccttaaaaactccttatattatatagatttaatccaaatgtgagtattttgtggacttaaaggaggca

SEQ ID NO: 233358 - DNA, 832 bp, Homo sapiens
gctcattttctcttgctgctaccatggaagaagcgactttcgcctcccgccgtgattctgaggcctttccagccatgtcaaactcaaaatgtgactgaaaaacagaagcatttggaatacgtaacagaagtcattaaaaagagccatgtaatatgtgcctgcttccccttctgccatgattgtaagtttcctgatgccttctcagccatgcagaactcatgttttaaacatctgcaagaagacacactgtataactgtataaacagagtttgcagtctcactctattgctcaggctggagtcagtggcgcaatctcagctcactccaacctccgcctcatgggttcaaatgattctcctgcctcagcctcccaagtagatgggattacaggcacatgcccccatgcccagctaatttttgtgtttttagtagagactagggtttcaccatgttagccaggctgttctcagactcctgacctcaggtgatccacctgcctcggccttccaaagtgctgggattacaggcatgagccactgcaccaagccttattctattgattattataagaagtgttaacatcttgaactatgattatatattcatcaatttaagcatatacatttgattttgttaagtcctcctgaagaagtctgtttataatattaaatatcctagttgatcactgttttaaaatttacttttttatatatttttttcacttaatgtaactctgatcaatgctacttcagtatgctggaagtggaattacaatgtggatattttaaatgaggaaaaaactggcttttaattttcaagtgagtcttatgta

SEQ ID NO: 233359 - DNA, 429 bp, Homo sapiens
gtcctcagcctactcaacgtgaagacaatgagaagccctttgtgatgatccacgtccacctaatgaataaccaagtcatctgactccaacctaactctgggaaactgagaaatggcttctgtgtgctcaggaagaagaaacagatgggattggtgagcatctagccaatttccaccacaaatgctcattttggctgcctccaggccaaaggtaaaaactaaaaagccagagaatactaaatgttggccaagatgaggaaaacagaaactctcatcctctgctagttggaatgaaaattgatgcaacgtccctggaaaacagtttggtattacctagcaaagtagaacctgtgcctcccctacaacccagcaattccactcctggtatacaatcaaaataaacttttgtacttgtatcccaaataatata

SEQ ID NO: 233360 - DNA, 811 bp, Homo sapiens
tgtccataatctgtgaatcctgctgaaatcagctagactttgctccaggatgagggattggtccaattctgttccatctttccacgcatctttcatcaggttattaggaaagagtacacttcactggctgctctactgggaggctttatctccattaagtgaaccacagagaaaaaagaagagaagagttttacttctgtcatctggtgatacattgctttggtgaatacaagaaaccacaggataagcaacagggctctttggtaaattccacaggctctcctgatagggcagccaagtcttttcccagtagccagccctttgcactaaaacatgtggattttatttctatggatgttgtgagtgtggacctaaacttctctaagagaacttgtatttctcaagcctaaagatgtattacatttttttgtatttgtatttgatccacataaagaaggggaaaaaaatttgtgtgtgtggatagcattccaagaaggaactctagccccaggaaagctgctatttctgctcttctccagctacctgccaacaatttgtcctcaaaagaggctctttctgactatttacagatctgtcacttacagattggcaattttcatgcatttcattctgctttgctttacttcatactggcatcatctttatcagaaggatatataaatatagatatatggatatcgtttgtcttccctttctccacattaacatattccatgagtgcaggaagtgaaatggcatctttatttcattactctctggtccataatacattccctggcacaaagggaac

SEQ ID NO: 233361 - DNA, 401 bp, Homo sapiens
agaagtgctctgaagctctagcgctttgccacatgtttttcttcacaaaacaagatgttgtactcttgcttacattttttcctgtcattatccagggagttcaggaataaaaatgtcttatcttggttatttgtactcatcttcaagctcatcatttattgtgatcccatgtttctcggtggctggttggtgttccattttcagttgaagagatgcctgctgtggtatctcttctttttccttgtcatattaatattggatgatgatgataatgataagcattggaagaaaggaacaaatttgtctttcaagaagagcagagggacatacatgctcaaatatgcacacaagagaacatgagaataaaaaagaaagataaaatgtatccagaaatggtctta

SEQ ID NO: 233362 - DNA, 607 bp, Homo sapiens
atgattgtaaatatcttctcccacactgtggcttctcttttctttctcttaacagtgtcatttaaagaagcttttgttactgatgagacacaactacattttttcttttagcaaccttgcttttgaatcatatccaagaaaactttggctaatacaacatcgcaaagactttttcctaaaagttttagtttttacattcaggtctataatccattttggattaatactgtatacagtgccatgtatgcatcaaaattcagttttttgcaaacagatatccaaatactcaaggcgcatttgtttaaaagactatccttttgccatgaattcctcttttacctttttctaaagctgaatgactatatatgtgtagatctatttctggattctctaatctggtcaactgatgtatttgtctttatatcaatatcaactatatttattattacagctttaaaataaggattgaaatcaaatagtgttaacttctatgattttattttaaaattcaaagttgtttcagccattctgtcatttgaatttccacatgaatttttggatcagcttatccttttctattaaaaagcttactggacaacttaatatc

SEQ ID NO: 233363 - DNA, 327 bp, Homo sapiens
gatgtgcaatccagactcttcaacaggctaatttttcccctgcgcttgccatggttcccacctgtgggtgcgtcttaccacatcctcggacctaaccactctgtaattccatttttaaaaatagtgtctttgcccattctgaaatgacgaacgggaagcccagcagctcactcaccttctggaaaggattttgttttgcccctgaaatgaatatctaaaccagcaccaaaaagggaggaaaaaacaagttattggagagaccagttatcactctgtaagttccctttctccagtccctctcaatccctataccagcctccaatcaaa

SEQ ID NO: 233364 - DNA, 452 bp, Homo sapiens
tcagctgtaatggataaggacaccttagcatctccaatcgataggaaagaaagggcatagcacccaggaaattattctccatcgtgactcaccaatgaggcaggggataggggagaggcaggggattcggggagctgcagggcaaaggcaggtgagtctccataaaaaggttactgagaagcatgggactgtccctgggtgtttctttcagattattgtcagagtagttcagatagcttagtaataacttttggcttcccagaaatggataactgacataacttaaagatatgatcctaggcacagtggctcacacctgtaatctcaactgttttggaggctgagatgagaggattgcttgagcccaggagttcaaggctacagttagctatgatggggccactgcactccagcctgggtgatagaacaagactctgtttctaaaaaaaaaa

SEQ ID NO: 233365 - DNA, 430 bp, Homo sapiens
atgggaatccctttaagatcagtgtccatgagccttacctcgcaactcttccaagatcataaccaaagcctgttacagcggcggaggataacagtcagacaggaccaagctgaaggtactctttatcaccctgacttcaagtaactgtgaagcacacctctcacctgaacctcgccaacgagacacactgtggatgagaaggcagtgccgcatgacagggaacgcaggggctttgggtgacgtggggccgggtgacatgggatgaggtgacgtgggctgaggccacctgcctctcagctgctgggtgcctccctcaccaggtggctgccttgcttgggctcagaccagactcacggttctcaagcccccatacagcttctgtttataggggttcttctatctgcgttttctgctattaaaactgagaaaa

SEQ ID NO: 233366 - DNA, 629 bp, Homo sapiens
catgtgcattccacacagcagcttcctctgtcctgcttactcagtcatccttccccatcgaaccacttctccagaaatttgttgggatttctcttgtccacaggtgccccctcccaattcaaattctcctttggaagcattgatatgtttattatttattacaaagacatttctggaagaggtaaagataagcccatgtgcatttagtcaaccctcttggattggaagtcccactgaccttgtaatgaaggctggtgggcatgggtgtgtgcttttacatagacagacctgagcagactgtgcagtccttctaatcaatgacacatttacaagaaactcaaaaatatgcacagagatggaaggaaagcttttttttgttacataacacatttcagtgtctgttgattataatatattttaaatacgaaactaaaattatacgtgtccctaaagcacctcctcagaaccctaaaaattttgtagaatatactgggaaaaccactggcatgattaaaaaaaaaagagcatggagtttggagtcaaacaaacctgattcaaatcctggttcaaccatctgttctctccaaatgttagttcccacatcagtacctaccttctcagattgctgt

SEQ ID NO: 233367 - DNA, 452 bp, Homo sapiens
ataagtatcttgcgaaggctgtaatagcagagtggcattgagttactgtggctcttttatgctttgactagtaaggaagagaaagagagaaatgggttggcaaaaattaaccaaagactttttcagtaattattttaaaaagaaaaatgttatatttagaatggtattttctttaatggtctccaatccaagattttttgttaaatggtgagttttttttgcatgttggaaaccaaacagctattgctgttgtagtttagatatttttagggtgcctgagtgaactagaagagcagttagtcatgtccatttcctgggcacccagacatgtgaatctacctgtaaagggtcagtttgcagaggcttactaccattccctcagtgtggccatttaatggactaatgtgtcccatatgggctcactgtaattttattttttactctaacactta

SEQ ID NO: 233368 - DNA, 269 bp, Homo sapiens
cagtccagatccctgcattcgatccaagggaggcagactgctgggggaaattgagagtcctcgaggtgcccctggcagtgagcgggccagaaagagaagcaggaaggcgccagcatcacgaggaactgcttccctcaaaactgctgtcaggccaggcacggtggctcaggcctgtaatcccagcactttgggaggctgaggcaggcagatcacttgaggtcaggagtttgagaccagcctggccaacatggtgaaaccccgtctctact

SEQ ID NO: 233369 - DNA, 249 bp, Homo sapiens
tattactgcagattagttttgcctattccggaaagtcatataaatgcagtctttgatgtctggcttctttcagcgtagtatctggggtttatctatgttgttggtcatgtcagccattcttcttttctattgttgagtagtgttcaattgtatggaaatgccaaattttgtttacccattcatctattggtggaaatttgtgttgtttccagttttaggctattaggaataaagttaagagcatctgta

SEQ ID NO: 233370 - DNA, 398 bp, Homo sapiens
aagatagatggtaaatagatagatagatgatagataaagaaaatacatagctgttccagaaaacagaaatggataacttcatgaaccaaaagcagagtaatatactttagaaaggaagcgggccagaaaacccacagttgcaaaacaaatagaatttccaactgcctcttgtagccccttcctggaagtagtcacagcccagggtgtttgacttcttcctctgttttttgtttgtttgttgtttgcttttctgtggggtttttgttgttgttgtttgcttttaaaaaaaaattccctttccctgcttttttgtcacagcagcctttgtcacttcaaacaccgcaagtgttctttaaaaaaaattatatcaacctttcaattaaaatgcaacatgtctg

SEQ ID NO: 233371 - DNA, 363 bp, Homo sapiens
tcaagaagattttatacatgtccatttagcacaacttcaaaaatatagataatatgcatctctagcaaggttgtcaaaccaatatacccatacattgctagaaccaaaatatactgtgatatattattaaatattattgccaagaagtagaaaatgtgcatgctattttgcccaataattctacttgcatggcaaaaaaaaggaaccaggtatattcttcaagacgtttatgcaatattatattacataaaaatgttatgaagaatgtaattccacaatatggtattaattaaattattgagcacatctaattacttgaatattatgcagatcttcaatataataaattgaaacaatatgtca

SEQ ID NO: 233372 - DNA, 369 bp, Homo sapiens
cttttgtattacttattttttgtgcttgctgctataacagaatatctgaggctggttaatttataatgaacagacatttattggctgacatttcaggatgctatgaagtccaagaacgaggcgctggcatctagagagggccttcttgctgtgtcatcccatggaggaaggcatcacatggcagaagggcaaagagagaagaagggagagagccaaaggggccaaacttgtcattttataaggaatgcactcctaagataacagcattaatccattcataaaggcagagccctcatggcctaaccatctctctgagaggggacaaacattcccacagcaacagcctctcatgtggttttaccctcaagc

SEQ ID NO: 233373 - DNA, 503 bp, Homo sapiens
gcggccgccgcgggcccagctgtatggttaggccaccatcgttcgtcttgggaggactccagtgcttgttgccctagcattaattgaaagtggaatgaaaaacgaagatgcagtacggtttattagagataaacggcacggcgcttttaacagcaagcaacttttgtatttggagaaatatcattctcaaatgcggcttcgctttgtgtccggaattggtgggttcttggtctcactgacttcaagaatgaagctgcggaccctcgcgcttctcttattcctgactctggctgccatcgttggctgatgaaagagttccttttatttggtgagttcatccatcaagattgtcttcgaagctttgtctttgaagttttcacctattcccaaccactccccctggaagcttgtttcctgcactgttaagagcatggaccctgaaggcggactacctggattcaaaccctacctccacctcttattgggagaatgaccttgtgtaa

SEQ ID NO: 233374 - DNA, 248 bp, Homo sapiens
gacctctgtttcctttctctgctctgtgccatatgacttctctgctttcttattttttttccttagattagcttgaggccttgattcagcttgccaaattagatcataggatctagtaaacaatgatcttctacttcctgtgagaaaagggtggtttggagacctaaagagtatggtcacgtatgatacagaggatgttctgtgatcactgatattcaaaacagcttccccagcactctgtcccttta

SEQ ID NO: 233375 - DNA, 462 bp, Homo sapiens
ggctgagctgatgaagacactgagggacttaaggcagcccaagataattgtgttcagcactgtcccctgccctcgctgtggcatcagggcctcctatgacctggagcccagtcactgtctgttgaatgcctgctgtcagggtggatttatttaaagctttcttctggtcatttggcaactgaatcctaggccatgagtgtatgtcaaagggagcacagacccatcgtttcatatgcctgctcaatgtgaaccggaaaggaaaggggatgcaggaagggagggactgggggaaaagttgagttggagtcaataggagctttagagacctgtgtcccagagaatcagaaatgggaatctgaattgctagaatgagaatcaggtaggagagacacatgagacagttacccctgcacggatggttgtaaagaaacagtcagaaataaagggaagctgagtggaaaa

SEQ ID NO: 233376 - DNA, 222 bp, Homo sapiens
tagaaaaagcagatagttgtcaccaagagttgtccggaaacagtggcaagggaattattcctcaaggaaagtgcaattctctgagctgtaacagtggacaatggtcgaatagtcaccaaccacgatctgggctcacacatagcaaagaggtatattaactaggatgccctacacaggcggtctgtggatgagaaatccctatgcccctcacttcaccagggc

SEQ ID NO: 233377 - DNA, 428 bp, Homo sapiens
acactgccctgtggaccccctcatctggctgttcatttgtattctttctaagctggtaaatggccccttggacggcgcggcaagcttggtagaagaggcgaccctggtcctccagggcaatcaggacgagatggctacccgggacccctgggtttggatggcaagcctggactttcaggcccgaaaggggaaaagggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggttgtcaataaaatatttcctggcaacctggaaa

SEQ ID NO: 233378 - DNA, 143 bp, Homo sapiens
gctgtgagttccgtgaagggagaggtggtgtttgtcattcaccaagatctgtctagagctgtgccctccttacactggggaagtgggctgccagcctggggccccacagctggttttgcaaccagcacagtgctcagaacaga

SEQ ID NO: 233379 - DNA, 502 bp, Homo sapiens
ccttaagggaatgtgattatgtgattatggcactcaagtcacataagcaggctgctgtaacctttgtttctctgattttagattaactttctttacctctgttgttttgaaaatgttgtaaatgtctacaggaggccaaggaagatgccttccctcttcactgttgaacttcattatagattaacttccttttacctttctcacgcaaagatttcatgcctatcgcattgctttaagaagaaatgttaactatactattttaaattggaaaggaaatgaaaatgagacacatggaaaagaaaacaagtgataactaattaaattgtaacttataaaccagccttgtgtagaaaatgttataaccctatgaaactttgtttcctgtctatataagcaaggacttaacttttaactttggagcactgatcccatttttctggagtgtgtgcttcccaaatggctattcccagcttttcacttgaataaaatgtttaaaactgga

SEQ ID NO: 233380 - DNA, 333 bp, Homo sapiens
agtccgaggctggcgggccacccgggggccactgctccaggcctggtttgggatcacagatcaccctgctgacacgctccctgtcagcatctgcacggaggagtttgctggctgtggcctgcagcccacacatcccaaccacagacacgctctttccccaccttttggtccctctaacaactcaatgcccagaactttctattgcccaggactctcagggtcccttcggaggccggacagaccctcccctccccaggccttcgtgcagcccctgctgcatgccaggcccaccttggtgaggctgtgtcgggctgagctcctggtcattctgca

SEQ ID NO: 233381 - DNA, 217 bp, Homo sapiens
cagtcaaaaatattactaacattgataatccaacaaatgtcactataaaattgttatacctgaaaatccaaggttcaaacactttctcaaagttttctactaaacctgaacgacgaagataactacaatgaaatctatgcagtttaaaaatacagggaaaaaactgaaagaactcaagcactctttagaaaatgattataatatggatctagaaccc

SEQ ID NO: 233382 - DNA, 458 bp, Homo sapiens
caaagcaaaaggggtggaaggaaagttctgggagtggtggctaagttcatggcattgataagtgatggtttgatggtttcacaggtgtatatttaactccaaacacatcaagttgtatacgttaaatgttggtgactttttgtatgtcaatcatatttcaataaagtgggttttttttaaagagggaatcatgcatgacatatactttaaaagcttgagaaataccggttcaatgctcattgctagttgacaacccagtagggtgactatcgttaacaatacattgtatatgtcaaaatagctagaagaaaatatttgaaatgttgccgacacaaagacatgataaatgttcaagctgatggagatcctaaacaccccgacctgattatttacattctatgcatgtatcaaaatatcatgcgtatgtcaaaatacatacaagtattatgtatcaataa

SEQ ID NO: 233383 - DNA, 546 bp, Homo sapiens
agagacaggatgttagggtggtgcaaaagtaattgcggtttttgcaattacttttaatgccaaaaccgcagttacttttgcaccaacctaatacatcaagtattatcaatcatttacacctgagtataaatgaacacttttacccctttctcatagcaaaagaaagcagagggctagaggagaaaatttaaaaaaaaaattagaaaatctcttctgttttcgtgttttacctgggattgttgtgaatgttagtcccttgcttcaccgtattgtcatgtctttttatgttgactttaaacttggaagtactaggtaagggagaaatgaaatgtgttttgatatcctatagctttttcagaaaatactttcccaaaaccaagtagacacaaagctgcctggttatgaagtattctcatttaaatcaagcatgtgaaatggggaaataaatcttggacttttttctttattttatattctgctagtgaaacactgaactctgaaaaatgggcatgtcacgattgcttttaataaatctacttacctgtc

SEQ ID NO: 233384 - DNA, 167 bp, Homo sapiens
catggggccagcagtgttttcacaagtagtccagagggcagaagacagtcgcagtggtgccaagtgtggacagtttggccagatcccaaaaccagatcccagagccagatagccggcccctgcagcggcaccattgtttccagagaggccttcattatttctttaag

SEQ ID NO: 233385 - DNA, 400 bp, Homo sapiens
ctctactaaaaatttaaaaaaaaaaaaaacccacaaaaaattatccaggtgtggtagcctgtagtctcagctactcaggaggatgagctgggaggatcacttgaacccagaaggttgaagctgcagtgagctgagattgcaccattgcattccagcctggtgacagggtgagaccctatctcaaaaaataaagtaaaataaaaagatcagagaaagtatacattaaaattcaaggtgaaaaaacattcactttgcctgttttgtttgttccaacgaatagactcatctcataatattctgtatatttgtaacccattgtaaagatgttgcctattactcttagtgaggtggacactctaattagaatttttattaaattttattgtggtaacatacacat

SEQ ID NO: 233386 - DNA, 159 bp, Homo sapiens
cctctcggcaacttaggcaacttaacccactcatgcttcctcagactgctgcttcgcctgtgagcaagcctataagagagatcgagtcagggctcagtccatagtcccatctggatcaaccagatttgtttcccaggccctcccaccccaccacctcca

SEQ ID NO: 233387 - DNA, 409 bp, Homo sapiens
ataattaatcatctcagttccttttaatcctttctttacttgtaattctctgcatccttgagcccttttaaataattttttccaggcagttttagagaagaattgacaagtttacttatttttaatgaagctaaaaaattacagtgggaagatactgagtggtgttttgttttactctgctactgcaatagaatggagtttcaggacaactgtgatattccatgttttttcccaaacactgaatggcatcttctctcacattcttacatcaccaacacaaatttacatgttccatctctcttttcctagatgagactatttattttgtggaggggaggggtgttgcaaacagtcctctacactaccatcacaaatattagcatagtgtccaccataaaattatcttcca

SEQ ID NO: 233388 - DNA, 433 bp, Homo sapiens
tgacctaaattatgtctaaaccctagccacagaggaatctgggaaatgttaacttttactcttcgttgtcacaggaaggaacgctaattcatcttatatcctccactttgttttaatgtggagaactgcgaagttatgttagcagaagaaaataaccacaatttcttcattgtgggcaagttaatattgagttaggcacatagtgtatctaaggctaaaaatcattatgaactcagtagtcaaggaagtgccctaagaaaaagttgtaaagatattttaaaagaagctgagaacatgaagccattaagaaatggtgtgtttacagccgagctagtgtgtttaactttgtgcattgttgtaacaccatttgttttgatacaggatatcgtttttttttttaaggtgctttttcccatatgcctaaaatttgttt

SEQ ID NO: 233389 - DNA, 457 bp, Homo sapiens
agctgtaacactgcatggcccaagattccgttccttagaatccgtgaggccaagaaccccaggtcagagaacacgaggcttgccatcatcttggaagtggcccacgaccatcttgggagttctgggagcaaggacccccggtaacactctctaccagaaagaacaaaggtagatcgccagagacaactttagacccttttcagcttggagactgcaccagaggaatctacagacaaactttagtagcttttgactacctttaaccaacttatttgcttttccacaatttgctgaccccagagactcaaggccctttttcctttgacttgtcacaactctaaaaatgtattattctttgtagaagatgctctatcagctgaggttcagagccacctctttgagaattactcattccttggatacctcccatgtgtctatggaatatacacattaataa

SEQ ID NO: 233390 - DNA, 340 bp, Homo sapiens
cggctgcctgtcccacgccaaaaagcgccttgcccaggccttgatagatgcgtgctggtggaggaaggttggactggtcaggaaccaagacccgggccccaacaccttctgctcccctaggtttccctccttctttttcctggggccgcgaagagacctaacgcaaggggccctgggggtggggtgcagtcatgtgagtcgggccccggcggccctgcgctaggcctcccctcctgtcacacacttcctgaatcgggcgtcgcaaacggctgccacggccctcagctgcaagactggccgggtcgggggccgcagaccgggcctggccaggccgcggccg

SEQ ID NO: 233391 - DNA, 224 bp, Homo sapiens
catgcatttatttgcttatcatcttcgaccagatgtgagctcctgaggacagggaccagggctgcttgtcaccaccatgcccccagcatcacccagcacaggtttggcacagactaggagcccacaaatatttgctgttggaaaaatacatggccccagagctaacgttcaggctctgctctcacacaaacctgggtccaatccttcactgattcttttttttt

SEQ ID NO: 233392 - DNA, 449 bp, Homo sapiens
gaatagaaatccagagaaacttcatgattcactaactgaattgagcatttcttttgaaacttggcatacagaaacactaaataaaatggatacagtcatactgtttaccatgctgggttaaaaggaaaacaagataatgaaatctggattccagcgcatcaatttgtttcaaccaacctagagaaaaatcactgtgatcaactccccctgtgagaatgtccacaactctagtttcctcggggttcccctcagtcactccagactgaactggtgccaccgacgctcactatccagccctccaacacactaaacaggaggatgctaaggacatttacatgaatagtaaacagacataaggataatctattaatgaagagcagacctaaaatcactcaaggataaatacatttaaaaaaaaatcagcaaatgactcctcaacacataagaca

SEQ ID NO: 233393 - DNA, 484 bp, Homo sapiens
gagaacagaggatatcaacaaaaagaagggaatggtttgcatctgaggagcctgtgttgtttttgacacgggttaccagaaatcctatcctttgttgaagcacagttctgcctcttccttaggacagggtgtgtgtggacaggctgggagacctgcctataatatggagattttttgggcaccaaagggaacccaactatcaaattccccactgagtcaccaccgaacccagtacaggaagcctcaggcaatactgacttggcaattaatgggctaatctggccaagtcacacctcaagacagggcatgagttaacctaattaggccacccatgatgcataaattcaggagtccatttttccagaagggagtgcaggtgagagattgggaaggggggtagggggcatcagatagttctcaagtgcatccctttacaagagttctaaaaattcgacacctttgaggcccgtgcattatcttcctc

SEQ ID NO: 233394 - DNA, 1759 bp, Homo sapiens
  misc_feature (1147)..(1147): n is a, c, g, or t
  misc_feature (1222)..(1222): n is a, c, g, or t
ttaccttgtcacccaggctggagtgcagcctcaaactcctcttgcttcagcctctgagtagctggaattacaggcttgtaccaccatgcccagctaattgtcagattttttttttttgtagagggggtcttgctgtgtttttcccggctggtctcaaactcccggccttaagcagttgtcccgcttcagcctcccaaagtgctaggattacaggtgtgagccatcatgccctgcctaatatactggctttaaggaagctttcaggtgcccacactctgtcagacttgacttaattcttctaggctttaccaacacccccaaccccatggttgggggtggggcattacaaccaggctgtggtcacctctgaggcacaggtgtcagccacaatgccaccttttccggtgagtcagcgagtttgtctggaatacccctccgtaggtgagagctggggtcctgggctgggaccacgatgggccgtagcttctcaggaagccgaagctggccctggccagagctgtcttgcagacttgagatacagatggcttctttccccctcccgttttctttttgaaaatgtttttaactcggagcatgtgtcggcacggcgttctttccacgaggacagaagctgtcactgcacgcagcagagacactggttctgatccaaagccgattgtggcctgcttctgggtctaattatttggcaggtcaggtgctggggtactgtccagggtgtaatcaagactcaagcatttgggcatgggggtgaggaggaaccatggggaggggaaggaaaaaggagggggtgtgtgacttagcctgtccagaccacagagcgagtcaatccccctggaacagtggcgtccgctgctctgcggggagggtctgcccatgacctggtgtgggagccgaggccgccaccaacttgggcgcccagcccagaccctaggagagggaggagcctggagcagcctttccctggcgagattggccacattccattttcctctctgaccagagagccctctcacccctgggtgtacaggctctttccgctaacagaggccctcctccagccccattgtccccactgtgagaccaggagtgcccctttcccagccccaaaaaatgagtgcgctcccantgtgaggcacagagtgaaagcctcgtgttttagaacggcgggtgggaaggacttgatgcgccgtgttcttgcagnaagggcagggacgataccgccttgtgctttgcctggcacatggtaggggcctaggtatttgggcgaatggagtgatgtccagagaaagcaggactttggctcgggcaaggagtgggtggcagtagggaggactgtggtctgtggaagggtcactgtggctcttggctttctcctactgtccctgccgatggtgacagccagccagcctcctggccgcaccattgtaccgcctctttcttggcttggtcctgggcgtggatgtcagatttgctttgttcatgtaaaatgtggtgggatcatgtctccctcaaatcaaattccaaccaaaatcaaaacaaaacaaatcaagcgtctcagtgaagacagccctgagggttctgttgtctcagcctgggagcctgggagcctggtcgacctcacctgcttttcagattttgccatgtttattgcagacgtccccgtcctggtgctggccactcatcttcattacaggttaattctcacaacctccaggtgtggtatgcagtggttttaagg

SEQ ID NO: 233395 - DNA, 321 bp, Homo sapiens
actttttagttttgcttattaagttggtaaaattttgaatgactttctttactcttggacatctaatgatcttttgtaaagaaggggaagagaaccctttctgttcagaaataacacacaacttgattagtaggagaatttttcatgtgattctggaaagaatttgcaacacctgtttccaaagaaagcaagaaatatattgcatatttttctccccaaaatgtattttgtccaaactgaattggacacagagaacattccttaagtttggaataaataaactttctgaaaactgctcaggtaacaaagtagtaaagagcc

SEQ ID NO: 233396 - DNA, 1655 bp, Homo sapiens
gaaaaatgatgctctccccacttctctcccttccgtaagtatttcctaagtgcctactatgtaccagataccattctaggtgcaggggacatgtctgtaaacaaaacaaagtcctttctcttaaggaggttactttctagtagagacagacaaataaattaataaagagaggctctatcagaggtgaaagttctctgcagaaaatcaaagcagggggccaggtgtggtggctcacgcctgtaattccaacactttgggaggccgaggtgggcggatcatgaggtcaggagttcaagaccagcctgaccaacatggtgaagccccgtctctgctaaaaatacaaaaattagccaggcatagtggcatgtacttgtaattccagccactagggaggctgaggcaggggactcacttgaacccagcaggtggaggttgcagtgagctgagatcgcgctactgcactccagcctgggaaacagagcaagactctgtctcaaaacaaaacaaacaaacaacaaacaaacaaacaaaaatcaaagcaaagcaaggtaaggagatatgaagatctccaggaaggagaagtggtcagaaacagaatgagtcaggaaaggtcagggtaataaggtgttgtctgagtaaaggcctttgtagtgaaaggggagcagatagatacctacgtaaggaatgcccctggcagagaaaagagcagggacaaaggccctgtgcaggaagaatatcaaggggccagagtggcagaagcccagggaggtgggctgaggtgcagaaggtacgggcggagtggaaggctgagcaccagatcacacttggggccctggggttgggtttattctgaatgaggtttgaagtcaaagcagagatactatctggaagaacttgctccagcatgttttcaaaggacctttatctccaagaaaaaagaaatcgtatttgtcacatgacatacctttatataaaattatgtatacagtttcttttataatacacattgatggttttaggcaaaattatctatgtaatagttcccttgacaaaggtaacactcaactcggtttttctcaaagtagctgtggaacagatggctgccccagggctttccttcatgttaaaagaacaacagtaactacatgtaatcaaattaaaaataaagcaaatgcacatataatgacactaaaataaaataaatgcctctaattataggtgtgtatgtgattcctatgtctctgggctattctttatcagaactaagaatgaactctggctgctgggtttattccaaagcactatccctcccaaaaaggtctcaaagtcagtttggccaagggcagtgaactttcatattaaaaagagaaaaaggccgggtgtggtggctcatgcctgtaatcccagcactttgggaggtgaggtgggcagatcacctgaggtcaggagttgaagaccagcctggccaacttggtgaaacctgtctctactaaaaatacaaaaaagtagccagacatggtgatgggcacccgtgatcccagctactcaggaggctgaggcaggagaactgcttggatccaggaggcagaggttgcagtgagcctagatcatgccattgcattcctgcctgggcaacaagagtgaaactccatctc

SEQ ID NO: 233397 - DNA, 480 bp, Homo sapiens
agactatccagagactttggcccctgccgggtagactcagactgtaaagacggctgcttccgattcaggatagctctggagccttccccagattttccaaaaaagggagggggatgggggagcttttcccctaatttacatatttaattaaacttggccaggcacggtggctcctgtaatcccagcactttaggaggccaaggtaggaggattgcttgagcccaggagttcaaggccagcctaggcaacatggtgaaaccccatctccacaaaaaattagtcaggcatggtggcatgtgcctgcccatagtcccagctacatgggaggatcacttgagcccaagggttagaggctgcagtgagctatgatggtgccaccacactccagactgggcaacagagcatgaccctgtctcaaagaagagggaaaagagcattttctcacctatttttactaacaatgatgctctattttagcaa

SEQ ID NO: 233398 - DNA, 1672 bp, Homo sapiens
gcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaaggggagaaaacccaggaggaatgagaatgtgtgcatatttgctaatatatgcataaaagaactctgagaggagacacagagaaccgcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggacaaaggacttgttttccagaaagatgatggtttcgataacctatactatgtaaccagagaagacgaagacctgcacagaaagatccaccggatcattcagcaggacttgcagaaaccaaatcacatggcagaaggggctgtcacttcctggaaatcttgggcctgtgctcgcctgagacattccgcccgggctgagcgaggtgctgcttgaacccaaggttctggaagatcctgggagggaaccccagtggcccatggtgcgcaccacaggagggctcatcatcaccaagcgttagtagcaaaagaacacggcgaaccacgctgtggggggaccaccacacaaaaagggggaggtacaaccccccaggcggtcagacctatacaccactaattacgggaggcgaccatacatgagaggcgcagaccccaacaaccgaagtaagcaactacattctcgggcatgagagagggaacacagggtgggcactcatcgccaagaacagtgcagaggagcgacggatacaggcagagcaacaaaacacacccgcgccgccggacgctggtcacaacaacgaaacagcacgagtacgcatactacgcaaccacagcaa

SEQ ID NO: 233399 - DNA, 610 bp, Homo sapiens
gcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagcggatgacagcatctggagctataaactgcatctgctgcccgtcgaaccctgagtctgcatcagctgttccacgtgtagcaagagagctcagcttaaccttactcacttatcgaacgtacatggcgaccatcgggcatgcccaccgcatggcgtcccggctccaccgaccccgtcgtcagacgcagctcttccgtacatcccgcccgactaccgtttagactctatgcccct

SEQ ID NO: 233400 - DNA, 1689 bp, Homo sapiens
gcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactgtaagcacaagatatttctaccaaattggtggtttttctggatgtgcgtccagtaaacctcttgttcagctggaagtcaaactttcaaaaagttcagttaagataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggacaaaggacttgttttccagaaagatgatggtttcgataacctatactatgtaaccagagaagacgaagacctgcacagaaagatccaccggatcattcagcaggacttgcagaaaccaaatcacatggcagaaggggctgtcacttcctggaaatcttgggcctgtgctcgcctgagacattccgcccgggctgagcgaggtgctgcttgaacccaaggttctggaagatcctgggagggaaccccagtggcccatggtgcgcaccacaggagggctcatcatcaccaagcgttagtagcaaaagaacacggcgaaccacgctgtggggggaccaccacacaaaaagggggaggtacaaccccccaggcggtcagacctatacaccactaattacgggaggcgaccatacatgagaggcgcagaccccaacaaccgaagtaagcaactacattctcgggcatgagagagggaacacagggtgggcactcatcgccaagaacagtgcagaggagcgacggatacaggcagagcaacaaaacacacccgcgccgccggacgctggtcacaacaacgaaacagcacgagtacgcatactacgcaaccacagcaa

SEQ ID NO: 233401 - DNA, 789 bp, Homo sapiens
gcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggacaaagataaggtggcattcacccccaggctctgactttcagcatcatgcaggggcttatctgtctggaggcagttacctcataataaactataaaatatagtcatcttgggaat

SEQ ID NO: 233402 - DNA, 1533 bp, Homo sapiens
gcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagtacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggacaaaggacttgttttccagaaagatgatggtttcgataacctatactatgtaaccagagaagacgaagacctgcacagaaagatccaccggatcattcagcaggacttgcagaaaccaaatcacatggcagaaggggctgtcacttcctggaaatcttgggcctgtgctcgcctgagacattccgcccgggctgagcgaggtgctgcttgaacccaaggttctggaagatcctgggagggaaccccagtggcccatggtgcgcaccacaggagggctcatcatcaccaagcgttagtagcaaaagaacacggcgaaccacgctgtggggggaccaccacacaaaaagggggaggtacaaccccccaggcggtcagacctatacaccactaattacgggaggcgaccatacatgagaggcgcagaccccaacaaccgaagtaagcaactacattctcgggcatgagagagggaacacagggtgggcactcatcgccaagaacagtgcagaggagcgacggatacaggcagagcaacaaaacacacccgcgccgccggacgctggtcacaacaacgaaacagcacgagtacgcatactacgcaaccacagcaa

SEQ ID NO: 233403 - DNA, 476 bp, Homo sapiens
accagaattaaacagaaaagataaataataagaaatagagtgagaattaatcaaatggaaaagagaaaatcaataggaagaattaattaaaccaaaagttgtttatttgaaagatccacagcattgacaaacttttagctagactgaccagtgtaagaagaggggattacaaatcaggaatgaagtaacattaccacgaactttacagaaataaaaaggattataaggtaatatttttaacaaatgtatgttgaaaaattggatatcataggtgaaactgacaattcctagaaaagaactgaagctgccttagaaatacgaaatctaaacagtcctgtaacaagtaaagagattgaggtagtaactaccacacacaaaaaaagcacatactcaaaagaatttactggtaaaatttaccaaacttctaaaaaagatttttttataattttttttcacagactcttccagaaaacaga

SEQ ID NO: 233404 - DNA, 511 bp, Homo sapiens
ttttttttaagctgataagttttcatgggtctttgttcttcaaagcctgttttcatttttttcctgttggttctcagaagaagttggcttttccaacatttttagccccaaattactggactttctattctctatatttttgcttgtgacatgactagttcttgtctgacttcatcttcatcttgtaatgccttactagaaggaatgaggaacaacttgcagacaccagtttgaagaatacttacgactgtaacattgtattctatgaataatgacatattgtaattgaggctaggaaatagagtctgtgctaggaagaaaaggagaatatgaatgtggtaatcaggttgtactctctgctgcaatatttaaattcaataaaaatcataaaacttatagagcagaaataaattttaattgtgacaaaaaaatacaaaaaaaatcaacaaaacaaaaagttgttttttgaaaagataagtagaattaacaaacctttgcttgcccaaggaaa

SEQ ID NO: 233405 - DNA, 816 bp, Homo sapiens
gtgaaaggttgtttcaccgacttccacatcgactttggaggcacttccgttggtaccatgttttccggggtgggaagattttttggctgattcctccaacgctgcacaattggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactcttggtgttcggcggaaacatcctgcacagctttaacgtgcccatgcagctgcggatctacgagatcgaggacaggacgcgggagaaaaacaaattgtaggacacttccacccactctcacattttgactttttcaagtccttgagacctgggagttctagatacactcgagaaaccttttgttgtcatctcctgaggtcactcagcttgaagatgacttggacctccgaggaagggctgaggccaggtgccgctgagtgggccctgaggtcctctggtagacggatgacctgcaggctgggagcattgcatgccttgtgactgccttgccttttgttttggactgacgttggttaactcaatttggtgaggctccgagtctgtcaacaaataatgttgagcaaccgtatgtttaatgtccccaggcatgtggctgaaaccttttgaaggcgaagggtggaaggcgacaacctgtttgtaagtcaattctttgcaaatttttgtttcccgcagtcctctcttggaaaaaaaaataaataaataaataaaaatt

SEQ ID NO: 233406 - DNA, 763 bp, Homo sapiens
aataggtatggtccaaatgatcattaaattgccatctctcttatatttatcttttatttatctttccccccctcccagtggctctagtgaaagcagccttcccagaaaaggtaatgccgacatgccccattcccttacagccactgaatctatttggaaattgcaaataatttaccttccctctccccttccccctaccattggacttttttttttttccattgattttttttttttttttttccaggagaaaaacaaattgtaggacacttccacccactctcacattttgactttttcaagtccttgagacctgggagttctagatacactcgagaaaccttttgttgtcatctcctgaggtcactcagcttgaagatgacttggacctccgaggaagggctgaggccaggtgccgctgagtgggccctgaggtcctctggtagacggatgacctgcaggctgggagcattgcatgccttgtgactgccttgccttttgttttggactgacgttggttaactcaatttggtgaggctccgagtctgtcaacaaataatgttgagcaaccgtatgtttaatgtccccaggcatgtggctgaaaccttttgaaggcgaagggtggaaggcgacaacctgtttgtaagtcaattctttgcaaatttttgtttcccgcagtcctctcttggaaaaaaaaataaataaataaataaaaattgaattccttcatcagcatttgttttcacccagctggtttccattg

SEQ ID NO: 233407 - DNA, 218 bp, Homo sapiens
ggcacgagactcggagcctcaccaaattgagttaaccaacgtcagtccaaaacaaataatgttgagcaaccgtatgtttaatgtccccaggcatgtggctgaaaccttttgaaggcgaagggtggaaggcgacaacctgtttgtaagtcaattctttgcaaatttttgtttcccgcagtcctctcttggaaaaaaaaataaataaataaataaaaatt

SEQ ID NO: 233408 - DNA, 861 bp, Homo sapiens
gtgaaaggttgtttcaccgacttccacatcgactttggaggcacttccgttggtaccatgttttccggggtgggaagattttttggctgattcctccaacgctgcacaattggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactcttggtgttcggcggaaacatcctgcacagctttaacgtgcccatgcagctgcggatctacgagatcgaggacaggacgcgggagaaaaacaaattgtaggacacttccacccactctcacattttgactttttcaagtccttgagacctgggagttctagatacactcgagaaaccttttgttgtcatctcctgaggtcactcagcttgaagatgacttggacctccgaggaagggctgaggccaggtgccgctgagtgggccctgaggtcctctggtagacggatgacctgcaggctgggagcattgcatgccttgtgactgccttgccttttgttttggactgacgttggttaactcaatttggtgaggctccgagtctgtcaacaaataatgttgagcaaccgtatgtttaatgtccccaggcatgtggctgaaaccttttgaaggcgaagggtggaaggcgacaacctgtttgtaagtcaattctttgcaaatttttgtttcccgcagtcctctcttggaaaaaaaaataaataaataaataaaaattgaattccttcatcagcatttgttttcacccagctggtttccattg

SEQ ID NO: 233409 - DNA, 615 bp, Homo sapiens
ctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatcta

SEQ ID NO: 233410 - DNA, 639 bp, Homo sapiens
  misc_feature (128)..(128): n is a, c, g, or t
  misc_feature (264)..(264): n is a, c, g, or t
  misc_feature (286)..(286): n is a, c, g, or t
ggtacagcgctggagctagaggaggctcaagagccttcctgccattgccctggacttgcccaagctgaaagtgtggctggagctagaggtggcagagagggggtgaccagcacagctccaacagcagnctcccacactgctcccagtcctgggcacagtggaagctatggaggcagagaccagggtgtgcaacctgggctcctctgcctcactggagagggacttctctcattcagcagagcagcagccctgctgctgaagagnctgctgctactgctgctggggntgtttgcctgcctacaggaggtgctggagagcaagaaaaggagcctgtgagcaggggttccaggaggtcctcctgctcccagaggcgacctcctcctccaggcatggaggtttgccctcagctaggcatctgggccatttgcctctaatgttctgcccaggatggcctcttcttgacaggcagacaggggttgagggggccagggggcatctccaaaggaagatttaaactcagcagctgcaccccagaatctccatgcctgcacctgcccaaggatttattcatagcttaactaagaatctcaaatttctaccataacactgaaataaagtttgactttttgaaacttcaat

SEQ ID NO: 233411 - DNA, 432 bp, Homo sapiens
agatcatgccaaatttctccccaaaatgatggtgctggtgcctgtttctgtcttcagtgttcaagagaccccattgcttcacgccctcaccgatatttgatgtagactttaagacacttgccaacctgaggagtgaaaagatgtgctattgttacttcactctgcgtttttctgagtattattggggataagcatcttggctatttgagttttctcttacatgacctgcctgtcaacgtccactgcccagttttccatggagtttttctttctctttttgatttataagatttctttatatattctggttactctttgtctatcacatacattgcaaatatttatcccagtctgtagtatatcttttaactttgtagggtgtgtgtgggggggcagtgtgtcataataaagcttttagttttgatgcagtca

SEQ ID NO: 233412 - DNA, 331 bp, Homo sapiens
acttgagtccgtcactaaatattttacaaattttaaacgtgttaagtaggccaggtgcagtggcacacacctgtaatcccagcactttgggatgctgaggcgggtggatcacttgaggtcaggagttcaagaccagcctggccaacgttgtgaaacctcatctctactaaaaatacaaaaattagccaggcgtggtggcgggcacctgtaatcccaggtactcaggatgctgagacaggagaaccccttgaacccaggaggtggaggttgcagtgagccaagatcgtggcactgcactccagcctgggcaacagagcaagaccctgtctca

SEQ ID NO: 233413 - DNA, 934 bp, Homo sapiens
ttcagtgaatactctctgtgggcctactatgtgccaggcattatgcaccagacgaaaacatatcttcttgagtaagccagtgctaagtcactgttcttgttcatatttggatcccttcccttttcaggttggttcattaacggaaatattaacagcaacttatacgtacttctccacttgttgctccaagagatttacagcctctttttctgtcttcagatactactttgaaaacaagatgaaagccatggaatctcccgagaaaaatgtacatcttacagactttcagtgagttctggaataccaggaaccagagcccacactaatgaacagcagtttcctaacctaatgcgagagatttgagatttcttctggctcccatgatcttctaattgtcttcttagcaagactaaacacatctccaagaaatgtgcactgccatgaatgtcttccagctatcttctatgacagcacttcccagtgtgttctgtggaataatggtacagggtgatattctatgaagaaaaatacggaaagtaatatactccacagtccgtatattagatcggactaataaaaataaatatggaaagtaatatattccacagtcatatattagatcgcctacacaacagcaatttgatatagtttaataggatttgaatgaataaaattaatgcccacagctactttcttctgccggtaaatatttttctgcccataatcttgctaaacagaattcatctgaacttacgttgtggccacaaatatccaacaattatacctaatcaaaacaaaaaccaactgatgttaaagaaaattaatcatttgctttgaataaatcaactattaagaaagctattataattgagccttacagtgccaaatatgtctgaaatgaaatgctgatgatcatatcaaacagacatttgca

SEQ ID NO: 233414 - DNA, 827 bp, Homo sapiens
tggctctctaatttcactaggttggttcattaacggaaatattaacagcaacttatacgtacttctccacttgttgctccaagagatttacagcctctttttctgtcttcagatactactttgaaaacaagatgaaagccatggaatctcccgagaaaaatgtacatcttacagactttcagtgagttctggaataccaggaaccagagcccacactaatgaacagcagtttcctaacctaatgcgagagatttgagatttcttctggctcccatgatcttctaattgtcttcttagcaagactaaacacatctccaagaaatgtgcactgccatgaatgtcttccagctatcttctatgacagcacttcccagtgtgttctgtggaataatggtacagggtgatattctatgaagaaaaatacggaaagtaatatactccacagtccgtatattagatcggactaataaaaataaatatggaaagtaatatattccacagtcatatattagatcgcctacacaacagcaatttgatatagtttaataggatttgaatgaataaaattaatgcccacagctactttcttctgccggtaaatatttttctgcccataatcttgctaaacagaattcatctgaacttacgttgtggccacaaatatccaacaattatacctaatcaaaacaaaaaccaactgatgttaaagaaaattaatcatttgctttgaataaatcaactattaagaaagctattataattgagccttacagtgccaaatatgtctgaaatgaaatgctgatgatcatatcaaacagacatttgca

SEQ ID NO: 233415 - DNA, 688 bp, Homo sapiens
ttcagtgaatactctctgtgggcctactatgtgccaggcattatgcaccagacgaaaacatatcttcttgagtaagccagtgctaagtcactgttcttgttcatatttggatcccttcccttttcaggttggttcattaacggaaatattaacagcaacttatacgtacttctccacttgttgctccaagagatttacagcctctttttctgtcttcagatactactttgaaaacaagatgaaagccatggaatctcccgagaaaaatgtacatcttacagactttcagtgagttctggaataccaggaaccagagcccacactaatgaacagcagtttcctaacctaatgcgagagatttgagatttcttctggctcccatgatcttctaattgtcttcttagcaagactaaacacatctccaagaaatgtgcactgccatgaatgtcttccagctatcttctatgacagcacttcccagtgtgttctgtggaataatggtacagggtgatattctatgaagaaaaatacggaaagtaatatactccacagtccgtatattagatcggactaataaaaataaatatggaaagtaatatattccacagtcatatattagatcgcctacacaacagcaatttgatatagtttaataggatttgaatgaataaaattaatgcccacagct

SEQ ID NO: 233416 - DNA, 522 bp, Homo sapiens
tatgtgtctgtctttagtgtggggttgatggggagagcggggggtggtctttaccactactttgaaaacaagatgaaagccatggaatctcccgagaaaaatgtacatcttacagactttcagtgagttctggaataccaggaaccagagcccacactaatgaacagcagtttcctaacctaatgcgagagatttgagatttcttctggctcccatgatcttctaattgtcttcttagcaagactaaacacatctccaagaaatgtgcactgccatgaatgtcttccagctatcttctatgacagcacttcccagtgtgttctgtggaataatggtacagggtgatattctatgaagaaaaatacggaaagtaatatactccacagtccgtatattagatcggactaataaaaataaatatggaaagtaatatattccacagtcatatattagatcgcctacacaacagcaatttgatatagtttaataggatttgaatgaataaaattaatgcccacagct

SEQ ID NO: 233417 - DNA, 913 bp, Homo sapiens
ttcagtgaatactctctgtgggcctactatgtgccaggcattatgcaccagacgaaaacatatcttcttgagtaagccagtgctaagtcactgttcttgttcatatttggatcccttcccttttcaggttggttcattaacggaaatattaacagcaacttatacgtacttctccacttgttgctccaagagatttacagactactttgaaaacaagatgaaagccatggaatctcccgagaaaaatgtacatcttacagactttcagtgagttctggaataccaggaaccagagcccacactaatgaacagcagtttcctaacctaatgcgagagatttgagatttcttctggctcccatgatcttctaattgtcttcttagcaagactaaacacatctccaagaaatgtgcactgccatgaatgtcttccagctatcttctatgacagcacttcccagtgtgttctgtggaataatggtacagggtgatattctatgaagaaaaatacggaaagtaatatactccacagtccgtatattagatcggactaataaaaataaatatggaaagtaatatattccacagtcatatattagatcgcctacacaacagcaatttgatatagtttaataggatttgaatgaataaaattaatgcccacagctactttcttctgccggtaaatatttttctgcccataatcttgctaaacagaattcatctgaacttacgttgtggccacaaatatccaacaattatacctaatcaaaacaaaaaccaactgatgttaaagaaaattaatcatttgctttgaataaatcaactattaagaaagctattataattgagccttacagtgccaaatatgtctgaaatgaaatgctgatgatcatatcaaacagacatttgca

SEQ ID NO: 233418 - DNA, 439 bp, Homo sapiens
acaacaacaaaaaaaacccagtggctacactggctacttctggccttatggttggtctcctccgttcctaaagggtacgtataaggcccaagccagagataaccatggtagaaactttccctgctgatgagcatgtgcactcctccaaaaactcaccctagagtagccttttgttcattataatagtaaaaaacacacccctgggtggagattttaaatgctaatgagacatgcgacatgtgtaccagcatgtacaaccacagagcgtgcatgcccaaggagacctcctgaaacatgcttgcgagtaacattcccctcatgcccctttgtgaataatcatgtaagattcgcataaagagaatcctccagcactagctgctgctggcttttttttgttgttgttgttgttgttttacacagagtcttgctctgtcactca

SEQ ID NO: 233419 - DNA, 808 bp, Homo sapiens
cagagtatgtgtattataaatatgttctgttcaggaccttgagctgctggtggtgtggtcgaagaatggcatagtccttgcactcaaaagctacagtatgtttgggacaaccggtcaaaccctgaaaacggtgaacagtaaaacaggagatacagttaaccctctaatgctttgtggcaactcttgttgaatggccgctgagtattcttggtttgtaacacttggtgatggccaagtgctcttgaaacagctaacttaaaatctcagcagttattttatttccagaggaaggaattctctctccctcggcgagatccagtccacagcttgcttcactcttagaacagcggcatcctctatttggtctcgcacggggaacttgctggggtaggggagaggtgttagagctttgaaaaagctttgcctctcggaggagtcaaaggggcagtaactgtatggggtgagaggaaggcctgcgaaataaaaaggcaaaggaaccgtttgaggaggctagttgccttctcggggccggtgtgtgtgcgggggtagtgttaagggggaggaaggagcccgggagcccggaggaccctcccggaggtgcgggcctgaaattccgctgggtgccgggaggctccgccctccggagtactgacggccttcgcagccaatgcgcagccaggacctcgcgttcgggagggcgggtacttcctactccagccctgggctcggagaaggccgcgttagttctttttctagggatgtctgcggaaggggcgccaggctgagggccagcctggagaaagaaaga

SEQ ID NO: 233420 - DNA, 445 bp, Homo sapiens
taaaacaaaagaaagaacaaataacaaatgaaaataaatacccaaaaaccagtcaaatgtgaaactggtgtcaggggtatgttctccatgttgagccccttctgtggaatatgacagtgtctctatttcgggtaaaggaaagaccaaaataactttccaagatgaaaagctaagagtgctgatctcatcacagacatagccagctcttcagttcagaccacctggaaaccctccccatgtcttttcagaacaatgtcctaagaaccataggggaagtggccataaaaaccatctttcctttgcagactggggtggggactctggccaatgccattctgttcttccataatatctttcccatcttgactgagcatcaaatgaggcccacacacaagattctcacccacggccgcataggcaagcaccggaagcaccccggcggccg

SEQ ID NO: 233421 - DNA, 524 bp, Homo sapiens
tcaagtccaagtcaccatactgatagataattggatctcaatgaaaaaaaaaattaggcaggacgtaatggctcatgcctgtaatcccagcactttgggaggctgaggcgggcggatcagttgagctcaggagttcgagaccagcctggccaacatggtgaaaccccgtctctactaaaaatacaaaaattagctgggcatggtggtgcacacctgtagtcccagctacttgggaggctgaggtaggagaatagcttgaacctgggaggtggaggttgcagtgagccgagaccgtgcctccagcctgggtgacagagcaagactctgtctcaaaaataataataataataataataataaaattgctgttactcgagcagtctctctggaacaattcaacctttcctatattttggaattcaggtgaccaaatcagaaccaaacagaacaatcccaaatctggagaaacatggtgattaaggggtatttttagttgcacgaaagagatcaagagagctttaaaa

SEQ ID NO: 233422 - DNA, 447 bp, Homo sapiens
tacctagagccctggactacccagagaagtagttttaagaaccaaaagaagagaagaattcaggagtaaatgaggcctggataacccaagggatcctgtgcttgcactgctgggattcaaatttgggggctgccaccaccacaagtttgtgagaagcccacagcctgcgcatgaagattgtgtcaagggaatagcagctgctgatgtgtggaattgattttttcagcaagggcctgcgattctgaatgcattaaggcagctccagttgtctgtagcagtcctctgtcagctgcccattggaagcatttttactggctcaggaaattcatgggtttgtggactgatgactccaacagattaggtacaaatccaagaaccacaaaacaaaatctaaccaagccaaacaacaatcaaacaataaaacagaacaaaaaaaaacctcaattt

SEQ ID NO: 233423 - DNA, 358 bp, Homo sapiens
ttttttaaaaaagaaaaaataaaaattctggaattggaaaatataatgaccatattgattgaaatatttgctaaggggttcaacagcaaatttgagtatgcagaagaaagaattggtgaacttgaagagaagacattggaaattatcaagtctaaggagcagaaagaaaaaagacaggagaaagtgaatagagcctaaggaagttatgagacatgatcaagtggaccagtatatacattgtggtagttcaaaaggagagaaaaagagataaaggctatataaaaaaataatggcagagaatttcctatatttgaggaagaacatgaataatcaaatccaagaagctcaacaaactcca

SEQ ID NO: 233424 - DNA, 423 bp, Homo sapiens
gagttttgctcttgttgcccaggctggagtgcaatggtgcgatcttggctcactgcaacctccacctcctgggttcaagcgattctcctgcctcagcctcctgagtagctgggattacaggcatgcgccaccatgcccagctaattttgtacttttagtagagacggggtttttccatgttcgtcaggctggtctcaaactcccgacctcaggtgatccgcccacctcagcctcccaaagtgctgggattacagacatgagccaccgtgcccggcctaaatataggtgtctcttacagcaactaggggcttcacaaaggtggcgacagtgggctctggtcttgagggatgactaaaagttttccaggcaggctaggaaggggaaggacattctgagcagagggaacagcatgggcaaaagcac

SEQ ID NO: 233425 - DNA, 465 bp, Homo sapiens
tcagatcaaaaggctagaagagccgtgaactagatgtagactgagtctcactaaaactgaagctcaacacccagctcagctcaacctctgtattaagccaattagtccttaccctctctgcctaacaaaggaagcaacaatctctttggtggaagagaacaacaactgcagtctctacttactacgaagaaaaggagaattggacatccaaagagggaagaccatatgaccaataatcagaagaaaaaaaaatttcaatcaaagtgaaatcacagataagctaaagagagcaaacaaggtctttaatttgattaatatgtttatttaaatgaagaaaaagaatcataaagtggataaaaagaaggagaattttgccaaataactactttataaataaccaagtagacctctagaattgaaaaagtaataatatctaaatattaggtaatagtggataggtttaac

SEQ ID NO: 233426 - DNA, 695 bp, Homo sapiens
gccactgcttattggccccataattgtattttctgcatcctcattgttcctggccacctaatgctgatgaaaaagtgggaagaatatttcttattccccactctaggtcacactttgacacagaagtgggcactcaagaaaaaatacttgtactctccgtgcaccacaaaaggctttgacagtatgcctctataatctgtgcctgatgtcccacttttcacatacacaaacctctgacttcatgtaggtaggcctggaaaccaatatgtgagacaggtatcactgggtccacaaaatataaactcctcccttttttgcctttgcacacacaagacctcagtaaagatctttattggaatctactcatgatggccccctgtaccagtttataaaatatgcatatttttgcctgtcttccaacagagattcaagcttttcctaaagcaagagttggcaaaatatggtctttgggataaatccggcttaccacctgttttggcagagcctgtgagttaagatagtttctatagatgaacatttgattatagggaatgctaattttgaagtaagtgaaatgctatttccccccaaataatattactattttcattagatttaagtcacaaagtaatttgtacttaattattattattatattttgaattttatcaataaaaattttgtggaaatttatt

SEQ ID NO: 233427 - DNA, 290 bp, Homo sapiens
cactcaggctggagtagtagtgccatctcagctcactgcaacttccacctcccaggttcgcacaattcttctgcctcagccgcctgagtagctgggattacaagcgtgcaccaccaccccggctaaattttctctttttagtagagagagggtttcaccatattggccaccattttctaataaaggaactagagatcattggaaaaacagctcattccaaggctagggaagggaaaacacaagatgagaacctggacaatcttgtagtctcagaaagtaaagatgtgctt

SEQ ID NO: 233428 - DNA, 3510 bp, Homo sapiens
  misc_feature (408)..(408): n is a, c, g, or t
  misc_feature (2466)..(2466): n is a, c, g, or t
  misc_feature (2495)..(2495): n is a, c, g, or t
  misc_feature (2568)..(2568): n is a, c, g, or t
  misc_feature (2635)..(2635): n is a, c, g, or t
  misc_feature (2697)..(2697): n is a, c, g, or t
gactccccctcccctcacgcccgcgacctgcgagctcccggagctggggaaggagcggacgccgcagagtccccgtccctggccatgcaagccggcctggcgaccccttcctccgctcccggattagctcccgcccggcacctgccttgccgcgacactgattgaaattcaagccggcccccgcctctgaccccggccggagcagggagggaaagagtgctgggagcggctttgctcctagaaggaggcccgggagtccaagaccgtggcggtgccaggggacggtcccctgggcgaggagagggaggggctgccccgagggcttccccgccgtctgctgctcgggtctccatccctccggtcctgcgggccggccctgcgaagccctgggaactggagtttcttggngttaacctcccgggctaacctacacataagggtgaaaaaccgggcagacaccctgccctgcccactcctccctcagggtggggagatggaagtgaaaccaggcccccaacccacacaacgaaagcgggaaagtctgaatggggttggggggtagtttacgatcttctctctttggcgtctgcggttaaatctatcacttccttctggccctaaacccctggcagaatctgatgtagtcaccacttagactcagccttggaagagaatgggtgggcttcaccgcattcggcattcaccacccccccttccccgcaaaaaaacaaaaaacgaacaaacaaacaaaaaactgcaggcaaaatgttagtgtttatgcagaggtgagttctcctggggggggaggggggggctctagctcccagcaggtgagactcattgcgccggggtctgatggaattgcacctggccatgctctcccaggcctgggagtagctgtggacataagctttaggcagcagaaattattagaggcgcttggacatatttggacgcctttatttagtaattgttgagaatcacttgttctgccagttccagaaccagcaacacccaccttgccgcccccgcccccaccccatcccttactgtgagtttcctccctctgctcagtgtggactcattggggagctcctcccagacttcccctgctctcctgtggccagtccctgagcctggtcatgactcctgggcagccgctgggaggctatgtcagaaacatccgaggactacagagaccttggtgataagtgtgtctttctttctctcctcttcttcctctcctgcatggcctccctctctgccagcactggaaagtcctgtttgatcaggtatgtgagcagttaaccccccatttccttccagccctccctgaaatcggtctcagtctccctgcttgcgtgggcttccctagctccgcgctcctgagatggtgacgtggggtgggggtgtggctttgtgcatctctagggctgaacgacactgctctccaggtatcaggaggaagagatgggctcccctgagaggatctccctcctgcctcctccctactctgctgcaccagagccgggtttacaccatgtagaaattggacgttatatattgaatgcctgggaaatcctccatatgccaggggattgcagtagggggctggagaggtgggggaagggcttgggctgacaatccctctccgtttctacctccactatggagggtccatggccaccgctgaagtcaaatctctgccatccttgggggctgactcacagtatggactcttttgaagtctaattcaatgtctttaattctgtcatagggatgagggagtgctgggaggttacagaggggaaattgtgtgtgattcttcgcaatgcctggagtccaggtgtagggcatggagttgggggtgccaagtattggcttttgaacctggagatggacatttgaccttcagcaaggaaatggttctcctcttagcattcgtggtgggtgctgttatgtgcttccttctccctctttgccccatgttggaggatagttgagtgctatagtcctggggtgagaatgattgtgccatgaagtttgtgcaactttaagaaattggtgtgagtgggccagagggaatgtgttgggtaggagaaggagataaagctgaaaaattagcttgaaccaggacttcgttgtaggcaggggaagccttagaaagttttttagcagggttgttatgtgatccaagccaggcttgggaaagctccagtgtcttaggggataaggagtgaatgggctacggggatgagggaagctaggcaggagctgcagcactgaacagaggcaagaaggtgacagtgaggatggacgggaagagggacatggtgatggaagaattggaagatcttaatagaccgtaggtgaggggaaccacatatctaactttgagattctgaacctaggagggaaagaagttggagtggggccaggtgtggtgactcacgcttgtaatcccancactttgggaggctaaggcgggaggatcncttgaacccagtagttcaagaccagcctcgccaacaaagtgagacctcatctctacaaaaaattaaaaaatcngccaggcatggtagcacactcctgtggttccagctacatgagagactgaggcaggaggattgcctgngcccaggaagttgaggctgcagtgagccacgatcgtgctactgcactccaacctgagtgacngagtgggaccctgtctcaaaacaaaaacaaaaaacaagttggagtgaggagagacgtttggcaaaaatgacaactttggtttgagacaagttcagttagaggagccagccggttgcagatgccggagtgggcgtgatgacacggaattgcagcgcgaaaggcctggggtgaggatttggggtgatcatccacattaaccacgaggtctggctgtggtttgaagttcaaagcatgcactggctcctgtcctgacgggtagagcatctctccctctggctcctaagagtacagcagctgctggcctgatgccccaaggcaggagggagcccgctgcgccactgccaccactaccaccaagctgccagcccttcacacctcctgccagatttagaatcagaacctagaacaaagtgtatcattctttttttttctctgtctgtgtctatctttttcatttgattaatttcctttgccagtccctgtgtgtatgtgtacattttaaaacaaaccatttgggtgaaaggaagagagcttttagtaggaagattttggaactcaagggagcagaaagaatgtgtagcacctaatagtagctagtggtctattaaatcgaatttttccaactgaaggtaggtcctgggtcctgggtgtcacaaagagcatacccctgcttctgggaggcctgcccagaattaattctaggaaagaaattaggccaggcacagtggctaacgccggtaatcccagcattttgggaggctgagacaggaggatggcctcccaaaaagtgagaccctttctcaaaaaaaaaaa

SEQ ID NO: 233429 - DNA, 450 bp, Homo sapiens
tgacaacgtggatgaacctagaggatgtaatgttgaagtcagttacagaacgacaaatatcatataatctcacatgtagaatctaaacaaagtctaacttatagagaagtagagagtagaatggtgataaccagaggctgggaggggaggggtgagtatagaaaaaagggatacattggtcaacaggtagaaacttatagttagataggaggagtagttctggtgttctattgcagagcatgttgactgtagttaataataatgtattatgtatttcgaaatagctaaagagagaactttaaatgttctcaccacaaagaaattataaatatttaaagtaatggatatactaattgctatactctggtgtgatcattccacaatgtgtacgtatattgaaacatcactttataccccataaatatgtaaaattattgttggccaattaca

SEQ ID NO: 233430 - DNA, 273 bp, Homo sapiens
ggaagcaggagaatcagatctttctggcccacagccccagccccagtgtggttcccaagttgccatgtcccttcccatccaaacttcagccggtctggtacacctggtacctggcaggacagcaggagggtagaggaggcagcggggctgggcctgggtgtgtgtggcgaggacgaggtgaaaggtagcgcgctgtggtctccagaacgtgccggcattgttttattttctgccttctaacgagagccacgtttcttgattgaaagcaccagc

SEQ ID NO: 233431 - DNA, 315 bp, Homo sapiens
taaaaaacaaatcaaatctataatataaaataatcaaatgtctaggttctctccacagttctatgacagaggcagggcaggatttattctggtttttataagtgaaaacctgaggctccaaaaaattgggacttcatagacactggggactactagaggagcggggaagagctgaaaaactacctattggatactgtgctcactacctgggtgatggaatcatttacacccttagacatacaaaggtatgaaatatacctttataacaaacctgcacatatacccccgattctaaaataaaagttgacaaaagta

SEQ ID NO: 233432 - DNA, 751 bp, Homo sapiens
ctgctgtctgcccttaataccttatctcaataacttctatcagaacaacaccatgaaataacacattaagtcatttcctaacaacttaacaccaaattgagaaataaattataacaaaggtggaacaaagttggaattctggctagtttatacctgcagtaaccatttcaacgcaccaaagggaggccacttaagagaagtcataattatcagcccattcttgatcctatctccaacacaattcccatccctcgagtgaggacccctaccataaggtatcctggtggtcatattgaggaatttttattgatctggaaagcctaaagaatccctgaaggtttttatcagagaacaaatgcaacagattatggcgaaaaaaaattcttgctgcatggtgagaagtaaatcaaagaagcacaagggagggccttttaaacattccatcaggggcctgtggaggacgtctggcggcgagtcaatcaagaagcagcatgaactggcagtagaatctacgaggaattttaaaatatacatttatatatacatgcatatactcttttttttcgatctgccattcctaggcagacttcctctgaattagcttccgtggtctctccacagacagttgtttttcccactctcccaccccagccccttatgcttccctcaccaccctagcacccccaccctccgccgcccccctagtgctggagacctgtgcaatatcattttccgcataatgaaatccgga

SEQ ID NO: 233433 - DNA, 647 bp, Homo sapiens
aaatggaagcaagaactaacgtctgccaagtcctgattgaggagcctgaagatatccacactgagcattgatctgtgcatcagtaagtctggatctaaagaggaagatccacactggagcacaggtcttctacaatgtagtcatcgtgccctgtgtgggggccaccatgggatgggccccaagaacatggtgtgaacaacaacagcaaaaatggtcttgacctcagagagttcaggtctactctgatgggaaagaaaatattacacagtgcccacctttccgatggagctgaaggagacggagtcagagggacttaaaacagtaacaacaacaacaaagtgacatggaatccatgaaagggagtgtgacagataagcaacttttcaactgtattcgcatttatagagtgttttaggaagggaggccacttaagagaagtcataattatcagcccattcttgatcctatctccaacacaattcccatccctcgagtgaggtctcactgtattacccaggctggagtacagtggtatgatcacagctaactgcaactttgatcgcctgagctcaaacaatcctacctcagtgtcccaaataagctgggaccacaggtgtatgcaaccacatgcggcttttgtaaaaaat

SEQ ID NO: 233434 - DNA, 739 bp, Homo sapiens
ccgcatccagggtgcccctccggcctcgccatgaggctcttcctgtcgctcccggtcctggtggtggttctgtcgatcgtcttggaagccaggcgttgtggtgcgcgcttggctacttgggaggctgagacaggagaactgcttgaacctaggaggcggaggttgcagtaagccgagatcgcaccatttgacacagcaagtctccgtctcaaaactacaacaacaacaacaacaacaaccaaattttgcacccctgcctcatcttcctggcaggcccagccccagcctagggggctccagaagtctccaacccctttgatggcctggaggagttaggaaagaccctggaggactacactcgggaattcatcaaccgcatcacacagagtgaacttcctgccaagatgtggggattggttttcagagacatttcggaaagtgaaggagaaactcaagactgactcatgaggacctgaagggtgacatcccaggaggggcctctgaaatttccaacaccccagcgcctgtactgaggacgccctccatgtgtgtccaatgtggtcacacgcccaggtgtgaccaataaaaatcctatggaaaattctctctggccaggcatggtggctgacgcctgtaatcccagcactttgggaggctgaggcgggcggatcacaaggtcaggagattgagcccatcctggctaacacggtgaaaccccgtctctactaaaaatacaaaa

SEQ ID NO: 233435 - DNA, 774 bp, Homo sapiens
ccgcatccagggtgcccctccggcctcgccatgaggctcttcctgtcgctcccggtcctggtggtggttctgtcgatcgtcttggaaggcccagccccagcctagggggctccagaagtctccaacccctttgatggcctggaggagttaggaaagaccctggaggactacactcgggaattcatcaaccgcatcacacagagtgaacttcctgccaagatgtggattgttttttatacacattcttgactgtgtcagataaactcaacactgactcctgatgacctcatcggtgatatacacctacgttcgtatctccactacccatcaccacacctctctgtcccccctaccccctcctcgcgcccccactcagccagtcacacaactgctctaaacggcggcgttcctttgtataaatacagctctccaggccaaggtcggtggtcattttgctgcgctgctgtgggcagaaacagcgcgcttaacagttgttatgcacggctgcgctactatgtgtaacgcagtacgtagagtggatattatttttacttcactcgaccacccatcgtgcaacctccgctccgtctccaactttcctacgtccctagtcactacactcttccccctcgtcgactgcccccccgcctcctattatagacattcccttccccccatgttaaccctcacacaatcctcgttctccgcttagttcatttcccccgtcccttccctccccgcgcgcccccccgcttgaactaatacacctcaccg

SEQ ID NO: 233436 - DNA, 580 bp, Homo sapiens
ccgcatccagggtgcccctccggcctcgccatgaggctcttcctgtcgctcccggtcctggtggtggttctgtcgatcgtcttggaagggattggttttcagagacatttcggaaagtgaaggagaaactcaagactgactcatgaggacctgaagggtgacatcccaggaggggcctctgaaatttccaacaccccagcgcctgtactgaggacgccctccatgtgtgtccaatgtggtcacacgcccaggtgtgaccaataaaaatcctatggaaaaaaaaaaaaaaaaaaaaaaaaaactcgagtttttttttttttttttttttttgaaccagcaattaataacactttttatttagcacattcacaaaagaaatggatctaaattatcattcattaatcacttttctgtgttttacagtgataacatattaaaaagtcagcattagaaaaggattagcatatgcagcaattaatacaagtgttacagagtatgaataattgcagaatatttgtgcagggacctgaacaactttccttaatggagttggatgccttatggatattggtgaattgga

SEQ ID NO: 233437 - DNA, 381 bp, Homo sapiens
acacactctacgagaacgctcgcacaacttcaattcccacaaaaggcttctaggattggttttcagagacatttcggaaagtgaaggagaaactcaagactgactcatgaggacctgaagggtgacatcccaggaggggcctctgaaatttccaacaccccagcgcctgtactgaggacgccctccatgtgtgtccaatgtggtcacacgcccaggtgtgaccaataaaaatcctatggaaaattctctctggccaggcatggtggctgacgcctgtaatcccagcactttgggaggctgaggcgggcggatcacaaggtcaggagattgagcccatcctggctaacacggtgaaaccccgtctctactaaaaatacaaaa

SEQ ID NO: 233438 - DNA, 342 bp, Homo sapiens
cctaggaggcggaggttgcagtaagccgagatcgcaccatttgacacagcaagtctccgtctcaaaactacaacaacaacaacaacaacaaccaaattttgcacccctgcctcatcttcctggcaggcccagccccagcctagggggctccagaagtctccaacccctttgatggcctggaggagttaggaaagaccctggaggactacactcgggaattcatcaaccgcatcacacagagtgaacttcctgccaagatgtggttagaacccttcccagggcacgggagggctggggtgtgtttgtgtggagccctggaggatgtccaagatgaacagattg

SEQ ID NO: 233439 - DNA, 401 bp, Homo sapiens
ctgagaccctgaatggatccttctgtggctgattcaactcaaatctgagtgatgttggatcaagcgcagccctcttgtcaccatgaagtaataagcttgataaggcactcactgaggatgactaagaagaaattcaagaggaaatcattgtctcttgaagattcctggacctgtgaatcttggttatgggaggaaaagcatcacatactggactttgatgaagagaatgcacagccttccagagaaggcaataccttgccccagccctgcaaggtattcctacccatctggaactgtgatggagtcttcaaaatgccattgcattgttctaccaagccagcggcttcaggatgatggctaatatagtaagaccagtaaaatccacgaccaagggccaaaaa

SEQ ID NO: 233440 - DNA, 375 bp, Homo sapiens
cctcagtccccatagcagatcctgctgcctgcccagggacccactgtgagacatgcccatcagtgacaccagaggtaggcctgaatatttcgatctcagttgtagaccttgaagcagccctgcaacttggtttctgcccctctcagctgcagactggagcagtactgcctgtccaaagtctcacccagtggtccagcaagagccttcctggggacctggaggagtcatacccattcacctgggcaacaggcctattcctgtgcacctgaagtagaccatcagcccagtaccagccctttggaccggtcgtggagacagtagagaccaccctgggcccagacaggatccatgcctgctagggcccctgctactagg

SEQ ID NO: 233441 - DNA, 321 bp, Homo sapiens
acatagatttatgtgtgcttataagtccctatagttgtataccaaatttttcataatgttcaggggttttcttcatcctgtagggaagcagctagattatggggtagacttttattttgtaatctcttgtggttttaatttttgttttttacagtgagtattgcatattttctataattggaaataaaaaagatatgttcattttgagggggggaagcaatatttcaccatacgaaactagaaaaaatagtttattacgcattgcatgcctgtatcaaaatatttcatataccccataaatatatacacctgtatacccac

SEQ ID NO: 233442 - DNA, 575 bp, Homo sapiens
caaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatcct

SEQ ID NO: 233443 - DNA, 582 bp, Homo sapiens
ctagctttcctttctctgctgggaagactccatgtttctaaggaaagtacctagagtgggcatagctttattgactaaaaaaagatggtaacccttatcttttttcctgcctgtaacttcctcagaactttggctagtggaaattcttcctgtttcctggcatatcactgaggaattctcggagtttccagttttacagaaactagtttctctttgttttttcttagttatatcacaggaagttggggagagaaaaatcagaatttattagatttttaaataaaaagataatacaattaattcataattatttacatttaactgagttctgtacttaccagtagcctccttttcacatgtctttcttatctaaattctttactttggtttgtgtttcggttggcttgagtatttaacactttaaataacgtaactgaggagggcttgtgttcaggatatactttctgaacctttacagacctaaaattagttgccagccaagctggactaaaaatcaggtcccctacaaaattagctactttggcctttcctacaaaattagctacattgtttatctctcta

SEQ ID NO: 233444 - DNA, 462 bp, Homo sapiens
gtaaatatctccaaatgggaaaattagacttatacataataaatagagtaatacatgaaatatcacaaagcaacttgtgactaggtgccaaatgtgtgggatgggcagaagagcaatagggacttaggaaagagaaggaatgtcatgctggtagacttcagggaagtttcataaaaggaagaattttaactcagcgtagaaagatgggtaaattttcctcatgtgaaggtgtactgcctggggtgctgcaggctggagatgagtattaaaataggaggagagtgagtgaaagcacaggaggaggaagggtcaggcaagtttggtgaacacagcaactggctatagaacaggagcagtgggagaaagtccagaaaggtctgctgagcttcagttgtacaaagctgtggagtttggcctttggtcatggctagattaggtctgaaagccttaattaaaaaaaaa

SEQ ID NO: 233445 - DNA, 506 bp, Homo sapiens
  misc_feature (425)..(425): n is a, c, g, or t
  misc_feature (444)..(444): n is a, c, g, or t
cacactgatttggcctgtcttccttcctttttgaatttaaatggaatcttaagttaccatgaacgttcctatttctcaggagaggtgtccatctacccatgccattttttttggcctttcactatctccttagacaactccaatttaggttccactcctgcacttcaataaaccttgaccaaacttcccaaactgctaaattcactggttggttttctatgctcatcttacttaatttctcagtatttgacactgactcccatttcctcaacacactcttctattggcttctttgagccacgttctcttcattttccttctgcttctctggttttccttctcagtctcctttgctgactcctctttttctgctgatctctaaatattccagttctctagggttgagtctagtatcacttcaaatnaccattcaagggtcttccnatttaaggaggataaagtaatgatatcttggccccctttctaccctcagaaaatcaacaaga

SEQ ID NO: 233446 - DNA, 1515 bp, Homo sapiens
tgcttgaagcctaactgtccaccagaaaggactgctctttgggtgagttgaacttcttccattatagaaagaattgaaggctgagaaactcagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagctttttccccaagttttcagtgccaaggggatagtgctggcactggtgagcacctgggttgtgggcgtggccagctttgctcccctctggcctatttatatcctggtacctgtagtctgcacctgcagctttgaccgcatccgaggccggccttacaccaccatcctcatgggcatctactttgtgcttgggctcagcagtgttggcatcttctattgcctcatccaccgccaggtcaaacgagcagcacaggcactggaccaatacaagttgcgacaggcaagcatccactccaaccatgtggccaggactgatgaggccatgcctggtcgtttccaggagctggacagcaggttagcatcaggaggacccagtgaggggatttcatctgagccagtcagtgctgccaccacccagaccctggaaggggactcatcagaagtgggagaccagatcaacagcaagagagctaagcagatggcagagaaaagccctccagaagcatctgccaaagcccagccaattaaaggagccagaagagctccggattcttcatcggaatttgggaaggtgactcgaatgtgttttgctgtgttcctctgctttgccctgagctacatccccttcttgctgctcaacattctggatgccagagtccaggctccccgggtggtccacatgcttgctgccaacctcacctggctcaatggttgcatcaaccctgtgctctatgcagccatgaaccgccaattccgccaagcatatggctccattttaaaaagagggccccggagtttccataggctccattagaactgtgaccctagtcaccagaattcaggactgtctcctccaggaccaaagtggccaggtaataggagaataggtgaaataacacatgtgggcattttcacaacaatctctccccagcctcccaaatcaagtctctccatcacttgatcaatgtttcagccctagactgcccaaggagtattattaattattaataaatgaattctgtgcttttaaaaaaaaa

SEQ ID NO: 233447 - DNA, 214 bp, Homo sapiens
ttttttaaaggttgacttattcttatagcccacagatctgaagtaacaaatcaggtgtgggcagttcatatctgccagaggttctcattcatctttttttttcttttcgtgggatggtttttttggtgagttgtttagtaccagtcttcccatttatgacctctaacaagaaacacagaaaagtattattgccaaagactaatactagttttcc

SEQ ID NO: 233448 - DNA, 290 bp, Homo sapiens
acttctcattcaacagtgaaattttgtctatcagctagtaggtatgaagttattttttagatttggagttatacaacagaattcctaactttgttttgatatgtagataagccctgatccagcttattttttctttgctaagtaactgaaactcttcacagcatgagttcaaactgacaaatttcaatttacagcaaattgaagtagaaacttaaagctcaaaaccctctaagccaagcatttttctgggcattgatactcctcttgggcatccccttcagtggtcttgc

SEQ ID NO: 233449 - DNA, 434 bp, Homo sapiens
atagcaccattcctattccaggaggcccaagccgactttctgaataaggttttacaggtgagcccaacagacatatttttctcttctaccaagagcttgtcctctcagttttgtatttctggagaaacaagactctctccctagtgaatgatgccagcaatggcctcaatcatttccattctcagcgcacaaatgcatgggtcacctgtgcagcatgaacacatcttagcatgaaaaccgttgcatgggattcaaacaacaggaactgctaaacatagaaacttgaatgttatttaatctttattttagataacagaggacagaaaacggtacatagatgaattaattcaaatagtttaactttcaaaaattccattctgaatgtagaatttctgaattaagttgacatttccaaaaccagttcagttattcat

SEQ ID NO: 233450 - DNA, 483 bp, Homo sapiens
ctattgcaacaggatttgacatgattagatataatgtttgttcttgacaactatttcttttttacctttggacttttgaaaacttgcattgtaatgtttttagaagaaacagatcaacacagaattccctttggttttataaaagagaaattccatcatgtaaactattttgctgccatctctagaaatgattagaatgattagagaaattcaagagttatatggtatggagcagccacaacggttatttggacaatttgaaattgataacaaaatattttaaaagaatgttcttagtatttaggcttcatagatatctctcttaatatctgtaaaaataaccatacaactgccttggttgtaaaccttagtagtaaagtgtttagatttctaccatgagatgtatgtttattaatcaattttgtgcatgactaaattgtattatagaagttttgaatgaggttaaaatacaatgtttaaaaa

SEQ ID NO: 233451 - DNA, 444 bp, Homo sapiens
gccttgaggcttcttcctacccacccaccgccatcctccgtccagttccataatgacagcgaggaggcagaaaccctaaatcctgaaacattttgagtggaacccagcacgcaggaacctgcgagattcttccgtttcgtcgaggtccgcatcgattgtattgacctccccgtgggccagcttgtctccttcatcgatcagccgaacgaagtctaggacagaactgtagaccaaaggaaatcgcaggcgtctttgcaaagctggtgggaagtaacccagcggctgctggaaaacgaatgggtgacctaagccggttccaccccctcccagggcgtcggcaaaaggagcttctcaccccactgcctcttattcgatcactaattcattttttagtttggttctgtttttaaaacaaaaattaaagaaaaaatagtttatttggtc

SEQ ID NO: 233452 - DNA, 325 bp, Homo sapiens
tcagggactagcatcctgactgtgctaacgcagtgtgatgtatttctaggaggcggggcaggcaggaagagatagctttctagaatatcaatttgtggtgagggctaaagataatgaggtcaggactcatgggggtcaccaaacaaagcctgagttcaaataactgcccacctttgggtgttctgagtttttagacttctttcctttaaattgtatttaccttccaatgaaagcaatgtgaaagggtccccattacacattctttttttttttttttttttttttatgagacagcgtctcactctgtcgcccaggctggagtgca

SEQ ID NO: 233453 - DNA, 384 bp, Homo sapiens
gtaaatcttaccagaaatgaggatgactggcttacaacgttagatactctaagttgccaataatttgtacagagcctgtgattgcaaaaccacaaacatttcacaatactggaaacctctaattaaccataataaatgacaggatgggtttgttttaaatacatggttaataatgcttactgctttaagaccataaactgtgtgattctctatggaggtgacagaggtaggctgcaaatggttttgcaaagtacgtttctacctctgcatgttaagtctgacccagaacattctactaatattggatcagcctctcatctgacgtaatttgcctgtgggaattgtatcggctgttaaactagctcctcttagtagctgtttgaa

SEQ ID NO: 233454 - DNA, 482 bp, Homo sapiens
ttagagatcgacaaacctagctccttatgttattgataagaaaactgaagtctaaagaatctaagtgattttgcccaaagtcacgtatctgattagtggcagtgttagacatagagtctcaatttaatccactctgcttcctctctgattctatttgcctgtggcccactcgacctccatcagtggtgttataatggcacaacgtaattcccaaatgccctcatactttgggatatatatgaagacttggcttaatcaactctaaaataatcagtaagttgagtcactaaatgaaaatacattggatcaacagggtgacttgagccatttgcaggtctaaatgctatttgatgaaaatttttaactttttgaaatggttatgctggtactattataaacatcttacattactgagccccaatgacatcaattgatagtcaccgtgttggtacttttattacatataaaactaggcacctaaa

SEQ ID NO: 233455 - DNA, 318 bp, Homo sapiens
catagggtctctctttcacaactactcaattctgccattgtagagtgtcagtagccatagacgatacataaacaaatggtcatggctatgttccaataaaattttatttacaaaaactgatgtcaggtcagatttggtctcttagctcatagtttgggaccctgctctagacaactctgcttctagccaaagctgccatctgattgcaattgcatgagagaccttaagcaagaccagtagaaaactgccttgttaagtctaatcagcccaatggatggtgggaaaaaataaaatggctgctttttaaattccattcaa

SEQ ID NO: 233456 - DNA, 149 bp, Homo sapiens
taaagatgaaggaaactaccatgagctcagaggatataaggaaatgaaatgaaagaaaattagattcagtggaactaagagaaacatagatgtaatcaacccatgtgcatctagtcagaggccaacttctctctagcaaaagtccccca

SEQ ID NO: 233457 - DNA, 503 bp, Homo sapiens
agtgtttcctgtggtaataagtttcttttttacggaagtgacattttctatctgagttaaataaaaggaatttcaccgtattaggttttattttggtttatttatttttttttactttttattatgaaaattatcaagcatatagaaaagtagaaacaatagtgtatcaactcccatatacctgtcatctagatctaacaattattatagttttccacatttgcttcatctattttcttatagtattttcagtatattagacattttaaatctaattttttaattttaatatttgtctctgcagtcatatctttataacacttaacgtaattagcaataattctctaatatgtgatattcatttcatattcagattttcccggatgttccgtaaaggtcttttacatgtggtttctctgaagcagagtacaagcaagagtacacattgcatttagttgttctctctcttaagtcttttttaatgtaaaactgcgtccaccttc

SEQ ID NO: 233458 - DNA, 558 bp, Homo sapiens
cagatgaggggaagaagtaaagatggaggctgtgggtccccatgtggcggggccctctgtactcctgccccgccgtggcggataatgggaaaccgcaaaggaacacactgtggccgtttcttcgggatggacccgcgcgtcctcactgcctttctctcgggatcctggggctcaagtgaactgatgccatccttggttcatcgtttgttcatgtaaggctccctcgtattttcatccgttcattttaataacgtgatgagcacttgtgaacctaccccactccaagaagtggacagcagagaaagcaatcaacatgcttctttctctcccattcccaccctgcctggcaacctccatctggagttttctccttctcctttttcttaaaagttttaacacatatacacacacttgctgaaaaacacacggcttgttgtgcttgtttccaagctgtatgggacggagtcacacagagtcttcgggacttgtcatggatccgatgatccactaattctagaacggctaataataataagcggccgctctagaagatccaag

SEQ ID NO: 233459 - DNA, 376 bp, Homo sapiens
ccagcaggcggcgcggggagagcccggctcggcacgtggtcagctccaagtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctcataaaaaaaatca

SEQ ID NO: 233460 - DNA, 432 bp, Homo sapiens
tcgcctgcatcttcggagagaggtgctgagcccttcctcatggatacggggtcccgggaggcagccttcaccagggacctgcccaggaaaccagcagatgcccaggtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctcataaaaaaaatca

SEQ ID NO: 233461 - DNA, 538 bp, Homo sapiens
cggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgcctccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgc

SEQ ID NO: 233462 - DNA, 822 bp, Homo sapiens
gatcatgccattgcactccagcctgggtgacaagagtgaaagtctgtctcaaaaaaataaaaataaatatatatatatatatatttttttaatttttattttttagagacagggtcttactgtgccacccaagctagaatgcagtggcacaatcttgtctcactacccaatctcaaactcctgggctcaagtgatcttctccactcagcctcatgagtagctgggactacaggcatactccaccgcacctgggttttttgttttgtgttttgtacagacagggtctcactatgtttgtgttccctggatggtcttaaactcttggcctcaagcgatccttctgtgtcagcctcccaaagtgttgggattacaggcgtgagccaccacgtccagcctgtgtgtgtgtactaatagctacctagataacaatacttaacagcagttacctctagattacctcagcaccattgacaatcagcccgaagactttgtggtggggctgtcctgtgtgttgtagggtgttagcagtatccctgggtgcagtagtgtaacaatcaaaaatgtgtttggtagcataaaagtacaactatagttaacaacaatttattgtatattttagagtaactaacatagtgaaattagaatgttcctaacacacaaaaaagatacatacctgagggtatgaatatctgtcaccctgatttgattattatttattatatgtttatatcaaaatatcacatgtaccctgtaagtatgtataaatgttatgtataatttagatttattttaattttaataaaaaataaatatttaaaaatg

SEQ ID NO: 233463 - DNA, 416 bp, Homo sapiens
caaaatggattttttaaaaatagaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggtaattattttgtgtatgactacttagtgttcaaacatttcattcattttaaaagtgtgggaggtttttctcaccttgtcaagcctttacagctgaatacagtcagtgactgacaacgttcacagtcatggcctcacacccacctgagattttaaaacttggtaaa

SEQ ID NO: 233464 - DNA, 268 bp, Homo sapiens
ttcctcctttttcctgtcttcctccctccctttagcctctctcacacaccctttctcactccctgtctcctctctccctctccccgctacctcctccctcctctctctctctctctctctgtctttcacatcacagtaaattttccttgttggaacttttccttttatcttctttatcaattaacattcatgtgttccagcatttagagcaatctgttctctttctgtccttagagcagtaattattttctgactcctaatgtcaaag

SEQ ID NO: 233465 - DNA, 441 bp, Homo sapiens
agcccggtgaaggcacctaggagtagggcctgcttaccctggaggagtcgggagcagcttccacagcaaggaggcttctaagaaatgatctccagtgcccaggctctgatgcccaacagacctgaagttacatcccaacctgaacaggcggcttttgctctccaggccttcattgccccacagtgggaacaataataatatgcaccttctaggtacccaaaagcacaagagacagtgaacggaaagtgcttggaagccccgtgcccaggtggtgctggccccagctgaactgcggggatagatgttgagtgtccaggttctagcatcatagaacagaatccggcctgttgggaaatcctgcctacaagtatacctccattaattagtgtcttctgtgaacatttttattaaaaaaagaagaaaagcttctcaacccaagcc

SEQ ID NO: 233466 - DNA, 476 bp, Homo sapiens
aagaactggaggaccaacattagcaacaggacctcccatttggcattttgttttcagatgtgcctagaagaaggagattacagcttcttggactgttgaagcctgggttcttcttgagttgtgaagatatcacctaaatcctatccacattttgtgcaccaggtttgtggacgcctaccaccattcattcattgcagtggctcagagaagatgaaaacaggactctttggggccaatgaagatccccaacagagctcagatgaccagagtggactggcttctaccctaaatacatacaacaatacttcccactctgaccttgctcactttatacaacaccacacaactagagagtggcagagctgctgtgggaacccaaatgccatctgactccaaagccttactctcaaccaccaccctgctgcctcctattctttcctgaaatcttcagtatagtcattattatgaagtaaaaa

SEQ ID NO: 233467 - DNA, 472 bp, Homo sapiens
atttgaaggaacgtaatcgtccttgcaaagtggaaaaatgacgggttaccagaggctgtcagaggcggctcgggtgagctgtcagcccatgcacaagtgactttttaattgaaatcggtttctgttctgcttcgctgggtccctgctctcttttagaaggctcacatccttcggcgaggacagacacagacaccacccagggaggcggtgtcaggaataaagtgagcttgtctcagcccacaaacagccgcgaatgtcagggcatgggagaataattagctattccaggagatagatttgttttcatttctaaccccaaagctaattgtaagaaatgaaatctgtgtttgtttttctttaggtatgtttgaatttacaagtcttaagtctttgggaactaggtcaactagaccttgcatatgcttacaccctggatgaataaagtctttatttacacctccacctctctcca

SEQ ID NO: 233468 - DNA, 468 bp, Homo sapiens
aaaagatgtccaagatagcaccatctagtctggtagttaagaacaaggctaaatctgggagcatttggtttataatttcatatgtcccccatcttgctcactggttttggccataataccttttgcaccgttgtatttgctgaccctttgcttttcttatcctacctcacctgcataaaggttacagctgtacacttgtagaattcctgattcaagagacttaagggctgaaagaatcttagagtcaggttcattcaaagcttatgtttgacagatgagaacattgaaattcagacttaaagctgacagtagtcattcaccaactagctttaaactagtaaacttctgattatgacatcaacttttgtatatctgaaattagaaataccattcaattccctaataccgcaagaaaatataaaaagtaatcatctcaaatatgatcattgtaagtcatctaaatgaata

SEQ ID NO: 233469 - DNA, 512 bp, Homo sapiens
tcaggtgaggtgttcaattggagatggagggatgggttcctacattcaggcaagtctgttataaagctgtataaaactacttgaaatagatactatcagataattgaggacaaaaggtctgccttatttcagctggcaaaaatggctttttagcaatttcacctagtgtttattaagcttgagaagaaaagctaaggatcttctggataaatcctgagatcatgggatcagttcagaaaacaagttctcttaaagggagaaaggaataaaaaatatgaatgtaataatatttaaactaacatcatttagggaatgatatgctgcatatatgtgattccatgtaattgaaaatacataaatactaaaacattgtattcattttcgacagaccctctttctaaagcgtttgttgtgttgtattacacgttaacactcatatttgtatgtagcaaatatttatttgataactgttacttgctggacactgagattaaacataatttaaccttctc

SEQ ID NO: 233470 - DNA, 218 bp, Homo sapiens
  misc_feature (210)..(210): n is a, c, g, or t
ggacaggcggggaggcaagaggctgagattctctatcagtatggcctgaacgctgggactctgagacctgggagaccaggtcttccctaacaactacactgcagtggaaagcctccctgaacttttttttttttttgagacggagtcttgctcttgttgcagtgagccgagatggcaccactgcactccagcctgggcaaaggagcaagnctgtctca

SEQ ID NO: 233471 - DNA, 433 bp, Homo sapiens
atgatgcatgcatcattctagaaacatccctttaagatcaggaataagacaagatgtccagtattacaattaccactgttgattaacattcttttagacgcataggccagtgtaactacaaaagataaagataagagatgaggaaaactgccaggtgcggtggctcatgcctgtaatcccaacactttgggagaccaaggcaggaggattgcttgagctcaggagttcgagaccagcctgggcaacatggtaagacctcgtctctacaaaaaatacaaaaattagtcaggcgtggttgcacgcgcctgtggtcccagttatttgggagtccaaggtaagaggattgcttgagcctaggaggtggaggttgcagtgagctgagatcacgcaactgctctccagcctaggcaactgagcgagactgtctcaaaaa

SEQ ID NO: 233472 - DNA, 476 bp, Homo sapiens
cagtttggttgatatttaaggtattcaatgggactttgtaacttcctcactatctgcgggtgtctggtattattgattgttggatcatcttcctcaagaatcagctcaaaaaggtttctggtttccccttcctacctcttcctgatccacacactttatttatttattttttgagacagatcaagactccgtctcaaaaaaaaagtacaattttgcccgctgaccattgttgggaatgatgcatctttctttccgctggacagcctggtggtcatgccctccagatggcagttgagtcctgagggggccaagtaggggattcaaactaatgctggtttaggcaccagaatccccttgttggaccgacatggtgctagatcaggagttggcacactatagcctgtgggatacatctggcctgtgacctgtttctgtgtggtctataaactaacaaagcttttcatatattttaaaga

SEQ ID NO: 233473 - DNA, 313 bp, Homo sapiens
gggtctcattcctgtgtcttcaagcttttccatggagtggcaaaatgattcaaatccagaaaggaagggagtgaagttattaggagctaactaaagttaaaaaaaaaaaaaaaaaaaaaaaaaggaagtgttttcttattgccttagactgcctgagctttcctggagaaccatcagcaccagtttcctttctgtggactgagagccactcagtagtagacacgaacagggaatgaacggcaatgaaggtacattttgctgatcaaataaaggatagatgctcactggatgtctgagaactttgagagaccga

SEQ ID NO: 233474 - DNA, 554 bp, Homo sapiens
tagatgttggggaaagaaacagaaacctaagaacagcaatcattaacacatgactgtcagccatggcaaggtaaggggtcaaaaataactcagcatgacagagagctagtaacaggaggtaggtcttagggacattacatcaaactttgtactccaataatagagattatactttcttcttaaacatacttgaaacattcgttaaaaaaaaaaaacaaacaaaaaactagcttgtattagggcacaaagaaaacctcagtaagttacatgaaatagaaatggcacagacagcagacagcagtctatgctaacaatgcaagaccagaaaataatgaactttaaccaaaggctatttccttggtaatttatatcattttagaaacacctaaggggaactggttcatgatgtatatctatcaatatagttctagatatctccctaacaagtccctaaattggtaaggaaccccatgagaccagacatcgagagagtgacatgacagaacgacacattcctgcagtgacccgcctcttccaacctcacgcacacgccc

SEQ ID NO: 233475 - DNA, 603 bp, Homo sapiens
ccttctggtctagacgcctctagtccctagagagtggcttaagcgaatcaaccataaggcctgtgtgtagggagctgccagggagcaagtttagggccacagtcctggactgctctcagttttctgtgcatttcacccctttgaaagtttctccctatatccctgtgcacgtgcctttctcttgatgggcacacacagtgagtaccagtgaagaagggcaagccaatgggctcctttcccagtgacactgacacctagccttgcaggtaaggaaacgacgtgctatgagaacattcgacctggaacatgcagtggggcctccctccttctcacggatcccagagaaccatctgtaggggaggtacagggggttgagttgtgttcccccgaaattcatgtccacctgaaacccctgaatgtgaccttatttggaatgatgacagagatgaggtcatgctggattagattgggcctgatttccatgactgggttcttgtaagaagaggagaggatgcagacacagggagaaagccaggtgatgacagaggcagaggctggagccacgtgtctgcaagccaaggaacctcaccaattgtggcagcc

SEQ ID NO: 233476 - DNA, 426 bp, Homo sapiens
acatgatatgagcgcaaaacagaaggggttgagtgacagaaggtaacatgatttgggagagagatgcaagattgggtatttgtggtcagagaatagtgatccacttgaattaaaggattcattaaaatgtttgtagcaggctcaatcatctcaacctttgataattttatcacatacatatgggattatatttagcctgaccaatttcaaagactttatttatgtttttgagacagagtcttgctttgttgctcagggtagattgtaacggatccatcacagctcactgcagccttgacctcccagggtcaagtgatccttccacctcagcctcccaagtagctgagactacaggcttggtggcacgctgagatcctgccactgcactctagcctgggctacagagtgagactccatctcaagaaa

SEQ ID NO: 233477 - DNA, 556 bp, Homo sapiens
tgtttttaagtattgagaaaaaccactttcatccactgcgtcacttttatggaggctacaataatcccgaatgatgattcatgtgggatgtaagggccacatcagtcttttcatcagcaccagcatcactgttattattttaagtcagggaaaactcagcaaaatgttcttgatggagggccacgccaccagggaactaactataggaaatttacacatttcagaagacatgctcctcagctcaagcacagacttctctagtgataacccctgttttcaaaactacctgtccaggccaggtgtggtggctctcacctgtaatcccagcattttgggaggccaagacaggaggattgcttgaggctaagagttcgagaccagcctgggcaatgtaacaagacacctccccgcccatctctacaaaaagaaaaaaattagccagacatggtggtgcagacccgttgtcctagctactcaggaggatagcatgagcccagaagtgtgaggctacaatgagtcatgatggtgcctgggcaacagagtgggaccctatctc

SEQ ID NO: 233478 - DNA, 649 bp, Homo sapiens
ccatgttggtcaggcaggtcttgaactcccgatctcaggtgatccacctccttggcacccccaaagtgctgggattacaggcatgagccaccgtgcccggcctactgagatattttaattgcctcaaatgatagcaggagttggagtggacagaaaggctaagtgcaaaaatcatcagtgtggggatataatctataggacaatgaatgtcaatgacctttaagacaatagcaagagtagaggtattgaggtcagaacaagggattttacaagagtgctgtattaatggttttggaagttaagatgacactgctcacaccctctttcacatggatttttggaagaaagaacacttaggaagactgcaagggaaattgagtcctcagggttttaactctcattgaatatcctctggtaaggactccagttagaagtggtcaactcagacctccttgaggggtctgagttactattaggaagaagcagaggtctggattcattttatccacctgagcccagtacacaatatgtaagatttttccatggttcttacaacaaagccgttttctttgaaaaccttgggaatccttaataaacaggaccccaactaattgtagacctgagaagccattaaaaaccagaatctgat

SEQ ID NO: 233479 - DNA, 476 bp, Homo sapiens
acaaagctgaggttgttggcattgtcagctccctctttgggatgctcctcagcttcccaaaagactcattataagtgccttgagagttcagctcaggaacttaacacacattcgaaccggcatttcggccactttgggggaatttttggtattatctcaactctactgctcttcatatgaaatgcagatgcccctgaagctccagagctgattccgtaggagtgtttgaaatagtagctcacatagtagattatcaaaactaaacaaaataatttgcttctgtatgtctctcaaaaataggttggatttcaatgtagtacttctcaaactattatattttaaggactgacctgatatttgaattttactcatcatttgacttttctagatggaatatgttgagggcaaagaccgtatctcacacatatttatatagtacctggcacataatactgtcaataaatgcttattgaata

SEQ ID NO: 233480 - DNA, 302 bp, Homo sapiens
tctgtatgttgctatcataatgaattcatatcatacatttttcaaaacccatagaatgtataggaccaaggataaaccctaatataaactatggaccttgggtgacaatgtaggttcattgattgtaacaaatgtaccactctgctgggggaacgttgatagtaagggagtgcgtatgtgtgtgtataggggaggagggaatatatgggaaatctctgtattctctgctcaattttactgtgaacctaaagctgttctggaaaatagtctatttaataaaaaaatatatatttaaaaatata

SEQ ID NO: 233481 - DNA, 464 bp, Homo sapiens
caatgcccctggcctccctcaatacccataaccctagaaaagaggaaagtaattgatccatagattccatccaagttctgctttcaaacacaactccatacacacacacaaagtggtgagcaaattctatctatacacttctataataactgacattcatattttcttctggaaaaatgccctatctgcctttaccactcacatccctgaggtatcctatgcacactgcctcaccaaacgacacctctcccttccaaggccagctatgatttctctcttaacgcactcttcagaggcctttccaggcctgttattctaatcaacttggtagttcctactactttcctacctttagaccctctccaagtccttagtacaagtataaaaatcctgtatggttgccgctgtgtctctatcatccatgtgtacaacaggaactatcataaccctggagtgagaaggaa

SEQ ID NO: 233482 - DNA, 521 bp, Homo sapiens
gctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcaggg

SEQ ID NO: 233483 - DNA, 530 bp, Homo sapiens
ttttttttttgagacggagtctggctctgtcgcccaggctggagtgcagtggcgcgatctcggctcactacaagctccacctcccaggttcccaccattctcctgcctcagcctcccgagtagctgggactaccggtgccctccaccacgcccggctaatttttttgtattttttttagtggagatggggtttcaccttgttagccaggatggtgtcgatctcctgacctcgtgatccgcccgcctcggcctcccaaagtgctgggattccaggcgtgagccaccgcgcccggccgaaactatcagtgcttttaagtcacaaagctacccttggagaccggctgtgaggaaaaatccttcctaaaggtatccttaggctcgttcccacaggcctgtgctctgtgcccgccaagctcttctccttgtctccatgcatggcccctggcctcacatacaccccaatttttctcacctccagatctccagtagtttgaatttcttcccctaaaacacccttctgtcgtcttctc

SEQ ID NO: 233484 - DNA, 341 bp, Homo sapiens
gggtgacagagtgagaccttgtctcaaaaaacaaaaataaaaacaattaataaagtaagcagacagaagttatgaagcttaaaatctttaaacaaagattttgcctctaaaaatacatccaattttaaataaacctgttaagtaaacatcaagaatgtttctaaaccaggaatatgtcataatacaatagacatcttaacttcacttatcaaccaggtcaggatggataatttaaaaacaaacaaacaaacaaacaaacagaaacaagaagcaaagagaccagttaaaaggctattgtattatatttagtcatgagattaaaaaatggtggtgggaaaaaa

SEQ ID NO: 233485 - DNA, 179 bp, Homo sapiens
ctaaaacttcttttctcctctgtgtgaaacactttcttcctctttttcaatctcccctcaagcctattcttgttgtccttggccagtgcggtgaagcagttccttgcattgtgtgtaggacctcgccaaggacagagagagacacagcgtgggttggtgttgcattgcattagaggtgg

SEQ ID NO: 233486 - DNA, 718 bp, Homo sapiens
ccctctctctgcccgcaggtcggctgcctccaatcctgaggtcatcactcatcaagaggggataatcccagggacagcaggatctgcttcgttacttggatttaggagccagaaacccatcaggcaactaaacagtaacaatgacccgccattaaacacactgagagaagagcatgatgaagagtttgtacaagaagaagccaggagcacttgctgacaatgcttacagagacgcaggcttctatgagctctgcctgttgaactgcagtaaaaatagatctccttccccagagaggcttggatgtgggcacaatatcagttcagacgatggtcaatgcatgtacttaatagagtgaaaagactttggactgtgaagtcagattacctgggtctgaattgttattcttctacttctttgtagtatgctttcaccacattaaaaattgtctgagcctcaatttttttatctgcaaaatggagctaatacctacacaggggcttttaagagaatcaaatgcaacaatgtttgaaaagcaacatactcccctttatggaaaaagagcctgtaaaggaaccaatacaatggctgggcgtggtgactcacacctgtaatcctagcactttgggaggccgaggtgggtggattgcctgagctcaggagttcgagaccagcctgggcaacatggtgaaaccccgactctactaaaatacaaaagat

SEQ ID NO: 233487 - DNA, 268 bp, Homo sapiens
gcttgaaattagctttgatttttaaacttttacacttaacagcaaaatcaaccaaccaggaatattttttctgcatcttccatgaatttttcttctcttggtaatgaaaacaaagtcataggacagagaaacaaaggatttggagggcgcacaacaattaatttgaggtttatttcatcaaggaagaagtagttcaagttcaactctcaggaacttgtgataaatctatgttcccataaagaaggattgcattcacaatattgcactc

SEQ ID NO: 233488 - DNA, 327 bp, Homo sapiens
acatgggtcttttgcttttctaaggggttgcagaggaaaatatgattgaggactttggttatggcatcagtaaaggatctacaggggccttcttcagctttctgtcttctgtgcctccacccctgtccccatcaccaaaaacaaactcaacttgaatcgtccctgactctgattaatgtttgagaattcctatagtgactgaactatagttaagagtaactataatttatcgtctaaacttggccatttttgagagtgaagggaagtctggacaacaggtgtagaaagggcaaaccaggacttgcaattacccttgacatattttag

SEQ ID NO: 233489 - DNA, 766 bp, Homo sapiens
  misc_feature (664)..(664): n is a, c, g, or t
  misc_feature (686)..(686): n is a, c, g, or t
  misc_feature (701)..(701): n is a, c, g, or t
  misc_feature (707)..(707): n is a, c, g, or t
gttctggtctttctgggccagatttttatattggttttcagtaaatatctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttggtccatctccagtcattaaaatcagtgctgctgcatgacactcctaactcctgacttttaaatccaagtcataaagttgactttcagcacaanagatacttataaacaaataaanatttttaatttcccncctacngatgtaagctttgggactcctttgaccgggtgccattagacatcctgattatggtgaca

SEQ ID NO: 233490 - DNA, 162 bp, Homo sapiens
gaaatttataatttatttattatacaatccagtatcatttttacaaatatatccacatttcttcctcttttactctcatgcttcaaatttagtcaaacgaaagttatgcagactgtacatcaagtaaatgttccttaaatacaattccttcccactactgcc

SEQ ID NO: 233491 - DNA, 473 bp, Homo sapiens
cgaaacatacaaaagcttatcctggacttctggagatttcagaggtcacttgccagatagggttcatatgtatgaaagataaatccaccctgttttcctgtacattctaacactttgttttttagggctaagacagtatcttcccaactcccacaaatgcttcattgcatacaaacctcaataaccattaaccaaccagtttacttgggcaaagcctaaggctaaggaagacaaggtcatctgatgatcattcaataaccttagtactacaagacattacaagaccacgcattctgcctgctgccctcccaccgagtcaaccattccacaaatatacttctttgccatctaaggaaaaggttaggagggatacttgatgaactacggtactccagaagtactgtagttctaatgaagtacttctaaagaacagaagacttggaaggctaatgttccccagtagcatcaagggt

SEQ ID NO: 233492 - DNA, 344 bp, Homo sapiens
ccatgcagaggcacctttggtgatggtgaacttgagctccttgctatgagtggcaggtgagggacccctggagaactggcatttctcacctctgcacttgactctgcccctctcgcaactttgagggatgaatacgtcactttttccattccagtattggtgggtctctaacatttccagagaaggaagttctctagttatccccatgttccagggtctcctggcacagggcccctgaccctaggatgaggacttcccagtaagctgggcttggggcctccccacccagcttggggagccatcaggcctgcagccccagccagaccacccttgccacctctggg

SEQ ID NO: 233493 - DNA, 323 bp, Homo sapiens
tgagtaagagttttccaagtggcaaaaagagaggacattcaaaacacaaagacaaaaggtgcaaaggccatgatatgcccttgtgccttctctgctttctcctcagacaagcagctgggacagacacaaccaccccagcccatggccagaatgtaggacccaatcaacagagggagccagagggagggaggctgtctctgggctcctcttcagcctgggagagggagaaactgatatgaaggcttaaaaggagaaatatgccaacataattgagaagcattagttaaatcaagcctgctttgcagtttagcctgcattcttct

SEQ ID NO: 233494 - DNA, 1709 bp, Homo sapiens
  misc_feature (1111)..(1111): n is a, c, g, or t
gaaagaaaaagaaaaaagaaagagagattccaaccagcctttcttccctggttccctgacagctcagagttaaccattgtgcccctaagcctaacagcagctggagctgatagcctttcacagggcctgccagcagccttggagaaaccacgagcccatttaacaggcaggacgctgaggctctgataacaagtgcggtttcggacaagagcgggagaggagatggagaaacagaccctcgtgcgtggctggtggggatggaacaaggcccagcctggcagcttctcacatggtaaacacggaattaccatagggcccagcaatcccactcctggggatagaccccacagaactgacagcagggactgaaagaggtgtttgcacacacaagtgcacagcggcatgattcccaacagccccagggtggaagccaccccaggcgcccatcagtggataaacacagcatggtccaaccagacagtggaatattacgcagccatgaaaaggaagggaatccagacacgggctacagcgtggatgaaccttgaggacctcacgctcagtgagaggatccagacacaaaaggacgtatcctgtgtgatcccactcctgggaagtccctagagtcgtcagattcacagagacaggaaataggatgagtgagtgccaggggctggggagggggacagggagtgagtgtttcatggggacagagtttcagtttgggaagaggagaaagttctggagaggatggtggtgatggcggcacaacattgtagtgagaaaagagagagggagaggaagggctgaaagccccaagccccatcttccggctccagcgtcatatgagatgcgtgttcccgcggcctcaccgttgagtttgaaggcgtgatgtcagaatgcaggcccagcagggacaccccgggagatggtgggggtggctggcagggcgggtttcacctggactgcaccagcccaggtgtgacgggctctgggccagacccaggcacccaaggtgagaaggcagcatctctggtctcgggatacccaggcctccccgaggcggcagaactccggccgtacctcgcagcagctggtccgtggcacccanggtatgtcccattcatgcagtgcctttccagcctcttccagaaagaatttaattcacccgttcgcatatgaccacgggagaatcgcttgaacctgggagacggaggttgcagtgagccatgatcgcaccactgcactccagcctaggcgacagggcaagactctgtctcaaaacaaaaaaaaaaaaaaaaaaaggagaaatttccagaacaggcagatccacagagaatatgcatggatgtgtggttggaggagacgggggtgactgctaatgcggacggggtttccatttaaggcgatgaaacagttctggaattcagccagcacagtggctcacacctgtaatctcagcaacctgggagtccgaggtggggggattgcttgagaccaggagttcaagaccagcctgggcaatatagtgagaccccatctctagaagaaaagaattttaagttagccgtgcatgctggttcatgtctgcagccccagctactctggaggctgagatgggaggatcgcttgagcccaggaattcaaggcttcaccgagataaggaggtgccactgtagtccggcctgggcaacagatcgttaactctt

SEQ ID NO: 233495 - DNA, 337 bp, Homo sapiens
aagaatgaatgtttccatgttttacatccacagaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcttcctcctccatccaggacttgggggtcatcctcctccatccaggacctgaggggtgtccttttctgcgcttccttggatggcagtctttcccttcatgtttatagtgacttaccattaaatcactgtgccgttttttcctaa

SEQ ID NO: 233496 - DNA, 578 bp, Homo sapiens
tgtatgaatgtgtcaatgcacagagagatctctgaaaagatgttcctggaaatgtcaacaatggttacctctgctggcaggatacaaggtgtttttctttttaatatttttctgggttaattaaaatgttctacatgagtatataccatctttataatccagaacaacaacaacaaaaaaaacagttaattaaaaactgaccctgagattgaatacagaaatggacagtggccaaccacatataaaaatagcacttggacccacagcctgcagccacctgcccaggaaaccaactgcttttctacaataaacaacccaggaagccagcctgttgtaagtcagccttgcaagaaaccagtgacactccagaaagctaaacaataacttctgtaacaattggcccaaatgaccaggacttggttaataaccaaatttccctgatttttgctcctacttccaacttaaggccaattggtaaaagtcaaatatgccccctcaccaatcacacaggatgtccatttctaggtagctcacctgcagcttccccatgatgacagtttccatcagggcatgcctga

SEQ ID NO: 233497 - DNA, 777 bp, Homo sapiens
tcccagctacccgggaggctgaggcaggagaatcacttaaatccaggaggtggaggttgcagtaagctgagattgtgccactgcactccagtctgggtgacagagtgagactacgtcttgaaaaaaaaaaaagagagaaaaaaaagaaagctgaggtgtctggacctgagccgggaaaggtgaggacaggataggccctgcagggccctggaccgtgttaagcagtttggtttttagcctaagagcaatggcatttatgactaagtgtgcaatttacaaaaactcctgtggctacggggttgttttcctgctaagccctgccctgccaagcaagcagaaaggtctcagagtgtgaatccacgagccatggaccgggagggcctcaggccagacaacaagtccctttccacccatccaccttgcgttctgagatggctgagctgtatgtgtcgccgtggctgggctgtgggccccagttgtttggtcatgcattagtctagatgctgctgtgaaagtgtgctgcagatgcggctcacactgacagtcagctgactgcaagagaaggagatcgccctcaataatgcaggagcctcatgaagtctgttggcagcctgaagagtaaatactgaggtttcccagagaagaaacccagcctggaatatcaactcctgcctgagtccccggcttgctggcttgcccttcacattgcagaattgccagcctgcacaattgtgtgggccaagttcttaaaataaatttcttagtatatggctgtgg

SEQ ID NO: 233498 - DNA, 196 bp, Homo sapiens
accaggtgaacacagaaaactatacctggctgaaatgagccacgtaggaaaacacaaaatgcacaacccctcaaacttccaccatctacctcagttcaccaccatgggtgttattaaccacacccaaacacagctgatgctacagtttttcatccaatttcagataacctccttccatgacttcacagtcaagctg

SEQ ID NO: 233499 - DNA, 469 bp, Homo sapiens
tagctctccatcccttgggctcctccaccactctgcctttactcctattgtagcatcctctgcactgagctgcttgccagcctccccgctagatcctcgagggctgagaaagcatctgtgttattcaactctggttgtgcctggcacccaggaagaatttatagaatgaaataagattcatggctgggtatggtggctcaagtctgtaatcccagcactttgggaggccgaggcaggtggatcacctgaggtcaagagttcgagatcagactggccaacatggtgaaaccccatctctactaaaaatacaaaaaaattagctgggtatggtggcatgcacctgtaaccccagctactctggagggtgaggcagaagaatcgcttgaacccgggaggtggaggttgcagtgagcggacatcgtgccactgcactccagcctgggtgacagagggagactccatctcaaaa

SEQ ID NO: 233500 - DNA, 430 bp, Homo sapiens
tcggggactgcagtccttctctcctggatgggttgggggtggggggctgttgagagctttcctcctccttttcttcttcctcctcctcctgtctccctaaccctggaagggggccatccactgaacttcggaaagaggtcaccctccctgaaagggggacttggattgctgcatccagagccaccccctgtggtccctcaatctagccacactcagttgctaaagcagggagaggtttcctagtccggtgttccggccccacgcaaacggagctcaggatgacgccacatgtgtgtttgggtcaaagcgcttttaactgtggctccaagaacagcctgtacagccacttgagtttcccagtaagaaggaatgtacaatagatgagactttactggcaaaacaatttttaaaagtaaagggagaagcagca

SEQ ID NO: 233501 - DNA, 606 bp, Homo sapiens
  misc_feature (243)..(243): n is a, c, g, or t
gggagagatatgagatgtatgaagagaatgaaaggggagtagaaaagtgtgatagatagagaagtgagtaatagggtatagagggtaaaggggaagaaaaagatagaatgtgattaataggaaaggaggggtttaataaaaatgattagaaaggtataaaaataataatataaatttaaaaataagtaaataatataataattaattaaattaaaaatttaaaaaataaataaaaaaatgatntaaaatttaaaaaaaaaaaaaaaaaaaaaaaaaaataaaaaaaaagaaattttcttcctctgcactcccactgccaccacaatttcacagcatcgctgagctaacactctcaagttgtgtccctgctccagggtcatgacagcatttcgaaaatgaagttttgcatatgttaaaagggcgttacaatgcgcttagtaacctgaaagctctagactttcgaaatactatagaagaatggagtgggctttaggcaggcacatagatgtcaggaagccctgtctttaaaattcacacacctctatcttggacactcactaatgggcatatttatttatttatttattatttattttttattttttg

SEQ ID NO: 233502 - DNA, 660 bp, Homo sapiens
tctgtctatggagcagccattcttttattcctttactttcctaataaagttgctttcactttactctgtggactcgacctgaattctattactcttttggggtctggattgggaccctttcctgtaatagaatcatatgcacttagaaggcatgcaatcaaaacttcttgaataaatgcatgataattatttgcaatgaggaccttgagtccttccttatctattttgtgcccccagcgaccagtgtagtgccaggcacatagcagatgctcagtgaatatctaccaaattaattagtgaagacctttgcttcctttgcaattactgctctgaagaaaaaaaaaaatcttgccatcttaaaaaaaagaaagaaaagaaacccatatagcagtgccaaacaaagtactgtggaatggttctcaaaaccatagctccctgatgggataatgtagtttaaatatagcagctatttttccctctagttggtttgttctttgatttttgtggaaagatttcaaaagttctcctccattgccctccttcctcaccccccaaggtgcttagactttaaatggtgaaatacttaaaatgcagagatggcctggcctcctgagcctggtagaagaaagaagagtgattaaatgcaattttaattttaaa

SEQ ID NO: 233503 - DNA, 384 bp, Homo sapiens
gtgtatattaaacacactactaagtaaccagtggttccaaaaataaatgtaaactaaaaggaaaactaaaaaatgttactaaataaatagaaacaaaaatattccaaaaattatgggatgcaatgaaagcagtgcttagagggaaatcactagctataaacatctacattagaaaaggaagaaaaatcttaatagcctaactgtacaccttcagactagaaaaagaagggctaactaaactgaaaacaaggagatggaagaaaataataaagattaaagtagaaataagtgaaatagagaatagaaaaaaaaatcaacaaaaccaaaagttgggattttttttaaagcttaacaaaatggacacatctttagctaaactgatac

SEQ ID NO: 233504 - DNA, 249 bp, Homo sapiens
aaggcacagactttacagtcacttatgtactttagaacttcaccaccactagggtagtcttactgatttcttatctttttgtaatgtcaagcacattttgcagggagtgagcacacaaatctttaaagtgatgtaaattgtcttctatcttctattggtgcatataagtgggtaaatagtcccgtttcctttgtgacccatttccatgctgcttagaatccctttatttcccctctctcttttgcccca

SEQ ID NO: 233505 - DNA, 470 bp, Homo sapiens
ccagaatgtcaccctttgaagaatgagtctttgtactttcctgtatgccacgatgtataatttataggatgtgttatctctgacctgatataaaagcctgcgtgtacaggttgagcagccctaatctgaaaatctgaaattcaaaatgctgcaaaatccaaaaccttttcattgccaacatgatgccccagctggagaattccacacctgactctgtgtgacaggctgcagtcagaacacaggcatacaacacagacattcagtgtccccccaggggaaaaggaaccctccccttcagctcagctatatccttctttttttttttttttaccctgagatcacaccacagcactccagcctgggtgacagagtgagactctgtctcaaaaaaaacaaaaacaacaacaacaaaaagaaagtattaagtaaattagcattcagaattaaatttatgtatagaaaatgttcac

SEQ ID NO: 233506 - DNA, 663 bp, Homo sapiens
aaagcatgcaagtttttaactcaaaatggcatggaatgaggtgggacatgaataaataatttaaacaatatagcccagtctccagtccagcagtttacagtcccgccctctcgctgtcgcagttctatgccttggcctccagagggagctcagcatctcagtcctgaggcctgaaaggggctgccttggatcatggatgcgctgggttttcagtctcagcaggacgaagtgataagtatgaggttgatggagccacgcgtcattgttcagataccatttcttccactttctaactgtatagcacttggcaggctgctcaaggctcaagttctcacctaaaaaatgtagataaaagtgtacctcacagggatagatgaggaataactgacttcatgtaagtgagtacagtgcttacctataaatggaagccagttagaggtgggttttcattgagaggggtgaagaggttaaaggctgttcttgttccatggggcggtctcctgtatttcattcttgtctcaagtaggaatttaaatcgttggaaagcttcttccacggtattgctgcactgctgtgtgcatggacctggcccctcccactccccctgcagccctacttcttgcttcccaaggtctaccaggactcagggctggggtcggaagg

SEQ ID NO: 233507 - DNA, 364 bp, Homo sapiens
cccgcatgtccagtgctcggtaggtgttgtccttccagcgagttgacgtgggagcttggtgacgagagcatcttgctgagctgctcaaagggctctggcccatgtgatccagccacgccttgaacccacaaccaccgggggcgggagggcaggaagagaactcagaatggggaggcatggagtaatgatacccattgctgaagggtgggggcattgcagggacagcctctctgggaatcctctcatctcctacagtcccaggtctcacccttcctcttctcctctgccctgggtctgtatcctcaggccaggtgaggcttcgcttatttgttcacttaacaatgagtttactgagcatttaaaa

SEQ ID NO: 233508 - DNA, 507 bp, Homo sapiens
tgtatctcattgaagctctcattagatggcagggaatgtgtgcttcttattcacagttgtatcctctgtatctagtgcagtgtttggcatagatgagggacacaggaaatgtatttgaataaattaatatttctgaagaaatttgtctagccttataagtgtattgatttaaatatgtattattaaggcagtaattcatattaaggtaaactttgttctgtgttaaacttttataaaaaaattaagatacacaataggctatatattgtggcatttttgcttctctcaattattcacgcctattctgctttgtctaagctttaacagccacagtcttgtggtagcaacccccacaatagctggcataatgcctggaaggaaataagacttcgaatgcttagaaggaaataaaagacttctatagggttgatctggtctggaagaaaataaaatactactaaagggctaatagtgcatttttaaaatctattgatgaaaaaaaaaaca

SEQ ID NO: 233509 - DNA, 1551 bp, Homo sapiens
tcattgtgaactagacagaagctagaagaaacatacaattctaattttaaaaggaaattgtactaaccagagatattctatcccaagtgaaattcaagtaaataaacgaaactactactactgagcacctattaaaggtcagaaattgtactggcactttcatacttaccattgtatttaatttagatcacagctcattaataaaggtattactgcccacaatatacacatagtagtacagaggaacaaaaaagtaacttgtcccactaattagctcaagagctgagactttaacttaggactcccgttatagctttaccactcatctcattgaaaaaataaaaaattaagagaattgtcaagagttagacatattagctagcctgattttcttttgtaataagattagtatacaagtagatattggaagtatggggaacatagtacattacgatttcagcaaagcatctgtcagaagtaatatagtattacaaactaacaattagggctcttaacacagataaaactcttaaatgctgcttctatcacttactctttatgtcactctgtccaagcatttaaactctctaagctatagcttcccccttatctctttaaaggggaaccatgatgatactatctcaccaggttttagttaagaccgaatggtaaaaatctacagaatgcatttagcatagtactgtcacatagtaaatggtaaattagtgttaactattattattaaggcatgatatctcttgaacaaaaataattggaatataacataattatgaatattcatgaagtattgtaaacaacagttattaaccccattcctattcaacttctgtcaatgtctgctttgttttataattcaccaagtatcttccagaaaagaaagattgtaatgggttcactacagaattatacagaactgctggctcaaaaagaaatatgattatttataataggaaatcaccagcaatgacaagaatgcattcacagaagattgcttaaataaattatgatagactaatcttgcacatgtagtgtaggaggaaataaaagactagaaggagatacaccagaagattaacatgattcatatctcttcaactaattaacaaacatattaaataccatttgggaaaagattacatttttttcaacagtatttggattcagatttccattttggaatggggtgggtttataaggagccattctgggagacagaactatctccaaggtgactggaaggggatgcctcaagttataagagctcaacagaccaagcacagtggctcacacctatagtcccagaactttgggaggccaggaattcaaaaccagccttgggcaaaaaagtgagaccttgtctctacaaaagctacgaaaagttagccaagcatggtggcacgcgcctgtagtcccagctactcaagaggctgaggtgggaggactgcttgagcccaggagttcgaggctgcagtgagccgagattgcaccactacactccagcctggatgacagagcaagatcccatctctt

SEQ ID NO: 233510 - DNA, 1105 bp, Homo sapiens
gctatgttggacctcttgtttcctagaatataagacactgtgtgggctcagatgctggggtcatggctgtatgtagtcttctgtgtgtatgtagtggaatgatggcagggaccaaatgttgtggaggtgtaggggctattaaaccccaggctatgatgtactcatgtactccagaagtagctccattcccaacatggttttgtctcatagcagttttggtcccagggagttgggtggtagtggtgggaggactcggtgtgtgttccttctctggatcaacgaaactgcatggacttcaggcaggtccctgaatccattgtgagaattgtgggacttgtctgtaactaggattacaggtatctccagtgctaatggcaactgctgaaatctctagcttaccttttctttctaatggggagtccctcttggctccaggcagatcttatttaggtgttttgcttccctgtgtatgctatcacactaacttgctcataaacacaacttgaacaacatctgtaatgcttaaacctaattattttaacatctgtaattcttaaacataattattttgttccctaacctaggaagcattacgtttttaaaaatttttttcaagacataatttaaaattcttaagttggtgaagaaaattcaccttacttggaagtcactgggctattaccattatcacattgtctgttgaaagaatagagtttggctatatgaataaagtaacaaaattacatatttacctactgaatcattcgtagaaatcatatgtacttcacatgatgtaaaagaaaatttctggccaggcgcggtggctcacgcctgtaatcccagcactttgggaggccgaggcaggcggatcgtgaggtcaggagatcgagaccatcctagctaacatggtgaaactccatctttactaaaaacaaacaaacaaacaaacaaaaaattatccgggcgtggtgaccgacgtctgtagtcccagctacttgggaggctgaggcaggagaatggcatgaaccaggggcggagcttgcagtgagccgagatagcgccactgcactccagcctgggagacacaacaagactccatctcaaa

SEQ ID NO: 233511 - DNA, 531 bp, Homo sapiens
cttgaggccaggagtttaagactagcctgggtaataatgcaagaccccatgaccccatctctatgaaaaactgtaaaaattaaccaggcatggtggtgttttgatttggtattaatttactcttagtaaacttgataaaatcagcactcttctcatacttttgttaccattactgtaagtaagtgtaataaggccttccttggtaaagagtttttgtgtatattaagtaaatatgcacatgaaagtatctcaaggtttaaagcactgtatagcactgtgtctatttcatttgaaaacgatagttgatacatgtacacaatgaggaccttatcagacccaagtgggctttttttttaaaaagacagaatcttgctctgttgcccaggctggagtacagtggcacagtcatagctcactgcagcctcaaactcctgaggcaggagaatcactagagcctgggaggcgaaggttgcagtgagccgagatcgcgccactgcactcctgcctggagacagagcgagactccatctc

SEQ ID NO: 233512 - DNA, 510 bp, Homo sapiens
cttgaggccaggagtttaagactagcctgggtaataatgcaagaccccatgaccccatctctatgaaaaactgtaaaaattaaccaggcatggtggtgttttgatttggtattaatttactcttagtaaacttgataaaatcagcactcttctcatacttttgttaccattactgtaagtaagtgtaataaggccttccttggtaaagagtttttgtgtatattaagtaaatatgcacatgaaagtatctcaaggtttaaagcactgtatagcactgtgtctatttcatttgaaaacgatagttgatacatgtacacaatgaggaccttatcagacccaagtgggctttttttttaaaaagacagaatcttgctctgttgcccaggctggagtacagtggcacagtcatagctcactgcagcctcaaactcctgggctcaagggatcctcctgcctcagcctcccaagcacgggcactacaggcgtgtccactgtgcccagctaattaag

SEQ ID NO: 233513 - DNA, 575 bp, Homo sapiens
gattgctactagcatctagcgggttaaggccagggatgctgctaaacatcctacaatgcacagaccccccacaacaaaaaaattatccagcccaagcagtacttgaaataatggaaagaatattaggctaggcattggagagttggactggaatctagactctgccattcgttagcagtgtgaacttcggtttatctaagtctcaaatttcttctttgggaagagtcatctgtaaatagatataagcgcattatgtgtaaataaaaggcataggataatattgattgagttgttaatcctagtccagttgatttagtaaagattatttctggagatctttacaaatggaatactgtcttaactgtgagtatatcttgaatgtgatcttgactaatccatataaaccagatgtcttctactttggccattgtgttccagaaagtaactgatttctttttctgttacatcttctttaagtgctcctagtctttacaggtattaataaacagtgaaatgactgagagtaacaggaaaaaacaagaaatactccttgaagaattttgatttgtagtctg

SEQ ID NO: 233514 - DNA, 431 bp, Homo sapiens
ggttgattctatatctttcccattgtgatttttcagtttgtaaaataacagtttttatgttaattttaattttctcttcctgtctcttttttataacattttgtgtatgtatataacattttacataaatgaaataaaaacatatatataaatctctaatccccacagccatgataacatcttggtataagttcttctatatttttctctatattcataaacatttagggtttttgattgtttaattgagtctttttttgttgtttgttttgagacaaagttctgtcacccaggcttgaatgcaatggtgtgatcatggctccctgtagccttgatctgtcaggaggattgcttgaacctgggaggtggaggttgcagtgagctgagatcgtgcagctgcactccagcctgggcaacagagtgagactaaa

SEQ ID NO: 233515 - DNA, 420 bp, Homo sapiens
aattgtgtaagctttttcccctttttgccttaactgccaagaaacctggagccactgtaatcagttcatctcaggtgcctgttaacatctaacccgtgttcccgacggccttgcttgtgttttcatccctaattgggtttagttctgtaagctgaatcgcattcctttataagtccatagcaaactctatataaattgaatagagctgaaaaatatattaactcgaccaaggttttatagctaatttacagttgcctacaatagtaatgcatgattgaactaatgacagtcctataacaaaaacactaatgacatttgtttttaacatttcctttagaatataatcatgggaattgaagagtgagttaaggtttagacctatgtctcttttcttccacttttatgactctgagatttaaa

SEQ ID NO: 233516 - DNA, 384 bp, Homo sapiens
agagctttggggtcatatcagaattcaaattccagctctgccatttcctacctgcatgatgttgggcaagttacttctctctctaatcttctgttcctttatcaataagtacagtatctaatgcataaagttaccttaaagattaaatgagataatgtatatgtggttggtacatactaaagtgcctcaacaaatgctaacttttattattatattaattattattgagattcagatctgtgaggcatctagggagaaataattaaatagaggcctgagattatgacaagagagtacactgagtaaaagagaaggaacaagaaattctgaaactggtgaaacattcagagattaacagagataaaagctagaaagaattagaga

SEQ ID NO: 233517 - DNA, 1837 bp, Homo sapiens
  misc_feature (1691)..(1691): n is a, c, g, or t
taaatttttatttcaataatttttgggatacaagtggttgtttacatggataagttctttaacggtgatttctgagattttagtgtacctgtctcccaagcagtgtgcactgtacccaatatgtagtcttttatccctcacccccgtcccaaccttccccctccgagtccctaaagtccattgtatcattcttacgcctttgcatcctgtgcttctttcttgcctcccatcaacacattctcctactgaagtatggtctttctaaactataaatgtaccactcccctgatcttactgctgccaagccaaattcctaggtcttataaacaagactggcttctttattgctccaaacttatatccctagcttaccatgcttttctcatttttatgccctcactcatgatgttctctctgcttgaaatctatcacatccttctgccccaactccttttacaagtaaactttctcttgaaagctgagccagatcaaatctagataggtgcctctcctcctagtgcctaaagtcctttatctagctgaattgtaattgcctcttatctctcccattagactatgtgtttaaagaagacagacctatgtcttagtttactgtatattcatagtgcctagcatattcatttaataaatgaatttttaataggcacttgattaatggttattgaattgtgttttcagagaattaaaaacaaagcctaggaaaacaggttaacaatgggaaatcatggaaggttcatgatcaggaaagtaacaggaatatgaagaagactggtcagattccacaactctgagccacaattatctttggaaggagtcatttacctgcatgtttaaaggtcacagcataactgtttcccttccttattcttctatccctgcaattatcttctctttctaccctctcctttagctatcacatctactgctaccacttcctttttcacttctgcagatgagttcctaattggtttcctgaagtaatttttaaatgacctctaaaatacaggattttccagtatcgacctagtctcctaggactgtattttaacccagcacttccacactggaaagtactattaaaaaaataactaaaaatgtgtaaaacaatttagcttcaagaatattacacaccactgtaaagtcagaaacctaaatgtatgagaatttagtatataaataatagcattaatatcgtagcactttgggaggccaagacagacagatcacctgaggccaagagtacgagaccagcctggcaacacggcaagactccatctctaccaaaaaaaaaaaaaaaactttaaaaactagacgggcatggtggtgtgcacctatagtcctagctactcaggaggctgaggcaggaggatcgcccaggtcaaagttgtagtaagccataagcacaccactgcactccaacctgggcaacagagcaagaccctgtttcaaaaaatatatatagcattaccacttaaagaatattacacagccaataaaaaaggatattatatagaatatctaaggagagaaacaagatggttaggggacagtgatgagacttactttttaccacatactcttttgtaccttttgtatttgtacctcatacatgtattacctagtcaaaaaaaaaaagaaaatttaaaaaaataagcttacttttgaaatantatataggtgtattacttcttgattcacaaagatgtacaacacattgttaggtgaaaaacgaaaccacaaaacagtattacagtattgtaatattaacgtgggcaacgggtgtatacatttaagcataatattcactagaggattg

SEQ ID NO: 233518 - DNA, 1010 bp, Homo sapiens
  misc_feature (404)..(404): n is a, c, g, or t
  misc_feature (439)..(439): n is a, c, g, or t
  misc_feature (441)..(441): n is a, c, g, or t
  misc_feature (747)..(747): n is a, c, g, or t
  misc_feature (834)..(834): n is a, c, g, or t
  misc_feature (852)..(852): n is a, c, g, or t
  misc_feature (865)..(865): n is a, c, g, or t
  misc_feature (868)..(868): n is a, c, g, or t
  misc_feature (881)..(881): n is a, c, g, or t
  misc_feature (964)..(964): n is a, c, g, or t
  misc_feature (980)..(980): n is a, c, g, or t
atcccaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccantcttcatggaccagagatcttggatgttccttccncngttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcaagacaaccatctcatgggccccattccaggacacttctgagtacatcatttcatgtcatcctgttggcactgatgaagaacccttacagttcanggttcctggaacttctaccagtgccactctgacaggctcacagaggtgccactacaacatcatagtggagcactgaaagaccaacanaggcataaggtcgggaanaggttgttacgtnggnaactctgtcaacnaaggcttgaaccaacctacggatgactccgtgctttgacccctacacagtttcccattaggccgttggagatgagtgggaacnaatgtcccggaatcangcttttaaactgttgtgccaattgcttaag

SEQ ID NO: 233519 - DNA, 1028 bp, Homo sapiens
  misc_feature (765)..(765): n is a, c, g, or t
  misc_feature (852)..(852): n is a, c, g, or t
  misc_feature (870)..(870): n is a, c, g, or t
  misc_feature (883)..(883): n is a, c, g, or t
  misc_feature (886)..(886): n is a, c, g, or t
  misc_feature (899)..(899): n is a, c, g, or t
  misc_feature (982)..(982): n is a, c, g, or t
  misc_feature (998)..(998): n is a, c, g, or t
atcccaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcaagacaaccatctcatgggccccattccaggacacttctgagtacatcatttcatgtcatcctgttggcactgatgaagaacccttacagttcanggttcctggaacttctaccagtgccactctgacaggctcacagaggtgccactacaacatcatagtggagcactgaaagaccaacanaggcataaggtcgggaanaggttgttacgtnggnaactctgtcaacnaaggcttgaaccaacctacggatgactccgtgctttgacccctacacagtttcccattaggccgttggagatgagtgggaacnaatgtcccggaatcangcttttaaactgttgtgccaattgcttaag

SEQ ID NO: 233520 - DNA, 744 bp, Homo sapiens
  misc_feature (481)..(481): n is a, c, g, or t
  misc_feature (568)..(568): n is a, c, g, or t
  misc_feature (586)..(586): n is a, c, g, or t
  misc_feature (599)..(599): n is a, c, g, or t
  misc_feature (602)..(602): n is a, c, g, or t
  misc_feature (615)..(615): n is a, c, g, or t
  misc_feature (698)..(698): n is a, c, g, or t
  misc_feature (714)..(714): n is a, c, g, or t
atcccaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaaggacaagaagctctctctcaagacaaccatctcatgggccccattccaggacacttctgagtacatcatttcatgtcatcctgttggcactgatgaagaacccttacagttcanggttcctggaacttctaccagtgccactctgacaggctcacagaggtgccactacaacatcatagtggagcactgaaagaccaacanaggcataaggtcgggaanaggttgttacgtnggnaactctgtcaacnaaggcttgaaccaacctacggatgactccgtgctttgacccctacacagtttcccattaggccgttggagatgagtgggaacnaatgtcccggaatcangcttttaaactgttgtgccaattgcttaag

SEQ ID NO: 233521 - DNA, 294 bp, Homo sapiens
aaacaccagtattgattccttccacgacgaatcgatcctgtggcttgaaagaagcctctacctggaagctgtgggggagggatgaagtgcaagagaaaacatctgttaatctggacagaggcagcgtggcctgaaatgaagacataccaagcccatcctgggaagaagtgtttctccaggtggcagcctgcaggaagcagagctccttctgaacaggcttcccactggctcctttctttttgatatttttttccagctttgttaaggtatgacaaataaaaattgtgtatattt

SEQ ID NO: 233522 - DNA, 437 bp, Homo sapiens
tgccaagcctcattaatccacttaacaattattttttgagtgtgcctattatgtcagacactgttgtaggcacctgggatatgtaacaggataaaacggatacaattccttgccttttgggagtaattttaaatgcacttcaaaaattgatgcatttaagtagacagaaaagaagttgaattacataaaaccattaagagatggcatagtgtgtgtgctaatttggaatagtgaaagtcctttaggagtgactgaaatttgggaaactctgttctggtatttcagaacttttctgctgccttttcagggggaatgactctttaagaggcagagggggcctcgggggcagggtaggattcagaagaattggggatgccccggtggaataagcagccaaggggcactagaaccgaggcagatcccgtggcaggcgggag

SEQ ID NO: 233523 - DNA, 394 bp, Homo sapiens
aaaaaatcaaatactgcgtgttcttgcttataaagtaggagctaaacaatgggtacagacagacataaagatggaaataacagatactgggaactccaaaaaagtggagtttgggaagggggtaagggatgaaaagttacctattgagaaccacgttcactatttgggttaacgggtatgctagaagcccaatgtccaccagtacacaatatactcatgtaacaaacatgcacatgtacccccatatctaaaataaaatttaaaaaaagaaaatgatatacatgaccacataccaaatagaatgcaaatttatagttacagaagaatatttaggacattgtatgtaatttttgcatacagcaaggctaggaagccacagtagatttgagttaaa

SEQ ID NO: 233524 - DNA, 469 bp, Homo sapiens
aaaaacacagacaacagaatgaaaaaattggtcaattggacttgatcaaaattaagaacttttttgcatcgaagaatactatcaagaaagcaaagcaacaacctactgaatatgataaaataattgccaaccatatgtctgacaggatagtaatatccaaaatatataaagaacatgaataacgccaccacaatcaaagagataacctaattaaaagcaagcaaaggacttgaaaattctttgacattactcaaagaatatacacaaatgacaaacaagcacttgaaaagatgcttaacatcagtagtcattagagaagtgcaaatatcaatcacaattagatacccctttctacttagtaagatgtgtatgctaacgaaaaatggaaaataacatgaagtgacaagaaagtggtgaagtcagaacacttgtgcattgcttatgggaatgtaaaatggtgcagctgctg

SEQ ID NO: 233525 - DNA, 417 bp, Homo sapiens
agtggagaagaagacagaaaaggctgtggcctgatgaagcttacattcagacagacaactcacaattctgatgactggaaagtccaagatcatggcactggcatttgctcagcatctggtgagggccacgtactgtgtcaagacatggtagagacatggaaaggggctctaccgagttgctggaatagttggtgtgtgtcagatattatcgtaagacttggggaaggtaatcctgggctttacaagatgagtggagagaaaatggctctatctaattggcccttacacagagaccagcccgcttcatagttcaagatataaacctgccacacatatgaatgtaaacagctgtagatacagagtattttacaattgcacgctttcaagttattaaaatttctggatttgtttaattta

SEQ ID NO: 233526 - DNA, 219 bp, Homo sapiens
gtaacacttacatatttgtattgattcagtctactctctcaacgtgtaaccccgaattacacatttgggaggcagctggctagacttagaaaagaccatggaacaccccatcctcctcactctcaagcaaggtctgtaagatgaatgaacctgatttttaagctaatttatgagtcacacacttaaatatatatccgtaattgtaactttaatgtggcc

SEQ ID NO: 233527 - DNA, 351 bp, Homo sapiens
tgccccggaagcattgtgaagatctgaggagagagtaccactgtagaaaatgtgtcatgataggccaagcacggtggctcacgcctgtaatcccagcagtttgggaggccgaggcgggtggatcacgaggccaggagatcgagaccatcctggctaacacggtgaaaccccgtctctactaaaaatacaaaaaaattagccggacgtggtggtggcaggcacctgtagtcccagctactcgggaggctgaggcaggagaatggcgtgaacccaggaggcagagcttgcagtgagccgggatcgtgccactgcactccagcctgggcaacagagcgaaactccatctcaaaa

SEQ ID NO: 233528 - DNA, 469 bp, Homo sapiens
catctatctgcctctgcctccccaatgctgggattacaggtgtgagccactgcacccggtcgttaattagagagtcctgatctcagttggattgtttaaaagtgaaagtgaatgatgataatatttagtaaaatcatcttaatgcattttgacttttaacttcttcagatttttattaaagtatagagaatttagatgttttagaaaatcagtgcaatatgtttggattttggaaaacatgaaatttacataatttgaagacaaacctcattgcatttaatattctgtttccacatttgtgggtgttctggctacactggttattggaagacatttaaagatggcgggcggggtgtagtggctcacacctgtaatcccagcactttgggaggccaaggcgggcggatcatgaggtcaggagatcgagaccatcctggctaacacagtgaaaccctgtctctactaaaaa

SEQ ID NO: 233529 - DNA, 402 bp, Homo sapiens
cagcctcctgttgtaaggcactgaaacagcctgttcccagtaatggctccatctctgagcatggaggtagggatggtgggtcggggctgacctcgtacctgctgggagagcccacacctttgggaagagatcatggtcaatccccgccctttgggggctgccctccagaccaaagcgaaggaacccagaggcagaaacttcagcctttgtcaaacagacctgggtttaaatcttgatctaagttcctactagctgaatgggttcagtaagtctcttaacctctctgagcctcagtttcttcatctgcaaaaggggaataagaatatctttttctttttttctttttttttttgagatggagtttcactctgtcacccaggctggagtgcagtggcacgatct

SEQ ID NO: 233530 - DNA, 671 bp, Homo sapiens
tcacagaataaggtgtgtctagggaggggtgctttctctttagtggatagcaccttctggctctgtcctcgcatggtggagaggcagaggccctcccttgggcctattttataaggaccttaatcccattcctcacttcccaagatgccacttgctaaaaccgtcagttcgggagttaggatttcaaaatgtgcattttgagggacacatttagaccatagcgtaggtcatgtttttaaagttgctttcttggccctggaatggcaatgcagtcatctgaattggtcttaacctaccaggaatgggcttatattttgaaaatatttctcgataagggagtaaaataagttgtatgggttttttgtttaagaaaggattcctttgtttactctggtatgcttatccacttctgtgatgtcaaccatgggtagtgacctaacattaatttaattcaacagatatctttgtctgccttgattcctgcatcccctgggctccacagctattcacttgtattgattctgttaactcttacacattaactttgagctgtgtctccttccttttatcattttgtgagtaaagaattttaatttgccaacaaatcctaatgtggactttgtcacgttgtgaaataaagtgattttttggtatggaaatatgtgttaaga

SEQ ID NO: 233531 - DNA, 447 bp, Homo sapiens
  misc_feature (393)..(393): n is a, c, g, or t
aaatcattgcaagtgtataatatggtacacaggattgattcggacacattcatatgtcataccattacacaaagttttgccgtgggctccatttcccctcgagactttatcgacttagtgtacatcaagcgctacgaaggaaatatgaacattatcagttaaacccagcatattccaaactagtgatgtttgtccagacagaaatgagaggaaaattgtccccatcaataattgaaaaaaccatgccttccaacttagtaaacttcatcctcaatgcaaaagatggaataaaggcacacagaactccatcaagacgtggatttcatcataatagtcattcatgataccaaaagaagaaatgaggccgttctgctataaaatcatgtgtagtangttattgctgtttacttctaagtcaacgcacataaataatactgttaaactatt

SEQ ID NO: 233532 - DNA, 531 bp, Homo sapiens
aaatcattgcaagtgtataatatggtacacaggattgattcggacacattcatatgtcataccattacacaaagttttgccgtgggctccatttcccctcgagactttatcgacttagtgtacatcaagcgctacgaaggaaatatgaacattatcagttgtaagttgaaacattttgcccatatcttggaattactgcgagccattaataaatgttttccctttattcacagcttcaaagaaattatattttaattatttcctttttaaatttacttagtgggatcaacaattagacgtatcatgtagatatgcctagtgacactctgaaggtgccatttatataatggtcaatatttgcaacatctcttagacttttgcagcatatatcctgtagcactgagtatagatagatacttgtagcctaaaactttgggtatacattttttaaatcctaagaaacaaaattaattgtcagatataattttatatttgaattgcttataatgcacatatccagtaactggataa

SEQ ID NO: 233533 - DNA, 358 bp, Homo sapiens
gcatttggtagaactgtttcatattcagactaagggtttcatccaaaacctaagatttcaatttgtttcacgatattacataaagtacagtattcatgtggtgacttcaaagcaacaaaaatgttcaacactactcagtctatggaaggtgaaatactgttttaatatgttaaaaagcatattaaatgaacacattaatgagaggtagctcataaacagtacatttcagcagggcacagtggctcatgcctgtgatctcaacattttgggaggtggaggcacgaggatcttgagcccaggagttcgggatgagactgagcaacagacagagacctcgtctctacaaaaaaaattaaaa

SEQ ID NO: 233534 - DNA, 346 bp, Homo sapiens
gggagaccaaagacgccatgagacacaagcctgctgttagcccatgtgtacatatgaggaaattagagaaatagccctacattcagacaggtatagccacatacagcttggtaagcagaacatggactgtattccagctactaaatggcatgatagttcagtgccattgggcagtgaacagtctgcacaagtgcagcatccttgctacaaggatttctgatggcagagacagcaggaaacgagaggcaatgtaacaacatatgagggctctcaagtcaagtatctgggtttaattcctagaaatgatacttaccagctgtgtaaccttggggatattaaaaaccct

SEQ ID NO: 233535 - DNA, 445 bp, Homo sapiens
atatggtagccacaggccggaagtggctattgagcacttgaaatgtggctagtgagactgaggagctgaattcttcattttacttaattttaatgaatttaaatgtaattgccacatgtagctggtgactactgaactgctgtgttaattcagcactaattctagagctgtggttctagactcaacaaggtaaagcaagaacccacacgctacacgtgctaaactggaccatccaacacacagcgccggcagtaatactgcaggcagtctggcactgggtgggacctttaagtacaatgcatgcttcagagttggtagccgctggcaaatctggcaagtgtgcccaaagtgtcactctgttctagccccttccccaaaccagataatgtttccctcagcttcagcaaaagcagatgctaaccaggtgtgagcagcaacgggagag

SEQ ID NO: 233536 - DNA, 885 bp, Homo sapiens
ccccctctttgcctcgaagctgggtgctttccaggtgctgctggaagctgcagttggcaccttctatcacaggacactgacctcactatgagaaaaggcttttagaagctgagactctcgcaccgtggcctgagacgcctgcttccatcagtggcagggtccccgggacccctggcagagcctccaggacccctggcagaacccctgacagttacatctctttcccgagagaggcctcaggcccgggctgcccagctgctgcagtggcggcctgtgcccaccagagggcgcaggcccggcgctgcgcagctggaccgggctgtgcggaccaaatgctttttaattgaaaatttttttaattcaaaaaggatttgctgtttgttcgcaagtgcaggttttccttatgcaggagactaatgtcttgagtaaacagatccgggtccaaatccaccttcaaaggtactcgctgtttgcccaagggagtgaaagggcttccagaagcggccccgtctcctgggtaaacacggcgggaggagcgggcagggaccgcgtctgcgggaaggcggccgcagccagaggggattatgtcgcgggacatatgttgaaatttcatttggggagttagggaaaacaagaagcgggggtgggtggcgcttttctccagccaagataacctaaaaagggaaaaaatcccgagggagagagggtgggggcgcaatctgtgcgccctcgcggggaccggcgtggtgcaggcaggaaggggcgccttctccgccctcccccagcccgcgggccgggagagaggagctcagcccagcccggagggcccagccatgccctccccgtgaccctgtccccactcctggccacagagactgggacagc

SEQ ID NO: 233537 - DNA, 493 bp, Homo sapiens
caagcattctgagtagatgggactccaggtgtataccattgcccccagccagatgcctcttttatattttttcaggcttttctcctgtattgtatgtaaataacacttttcttcgttttctatatcaaaatagtaggagagcttatatgaactctataataatataacattgttagagaagaagtgttctaatgtcacatttctcaaaaatttcataattaaagggagcataggggtcagataaaaaggttatattgtgaaattattaaagaataattaaaatacagaaaatataaaaaatcttctgaatctgagtccaaaggaattggaaggcagagattggattaaggtaaattggggaagttgacaagagagctgacttatgctgaggaaggggagggctagaccaaggttgaaggagaaaggaatattccagtcctggattcagttgatgacagcaggacataggcttctctgacccccacaaaactga

SEQ ID NO: 233538 - DNA, 416 bp, Homo sapiens
tataattttgctgtaaaattattttctgctgtagaaaaaccaattaaagcaggagtgtcatcagggaaagactcttctcttcaggccttgtatcctacattttcactgcatgagaagcgcccaccagtgaaacacagggtagcaggaaacctggggtgggcagctaactaacccagcttcctaatcactgagactacttcgttacaatgtcttgccagacacagtcagcatgagtcatcctcacaactatatctaggagtctttccatcaaatgtgtgcaaatgcgggtttatggagaaatttatcttacttccttagtgttctctgttatattaaggtatatgttaaaaagttcatttataattaaaataattcttctaatttgctaataaaatgctttataccaacttcaattg

SEQ ID NO: 233539 - DNA, 295 bp, Homo sapiens
taattggtaagtactttctgtgtttcataatttagttcataaactgtccataccactgtccagtggtgacagggccataagtcgcgagtgtgtagctgtgttctgtcagttcccgcagctttcaaatcccgaggcgtctgcctcatctgtttctagactgggcatcatgtccatgactaatttttaatcacaattcattctccaacttgtcttattctaaatgttgttctaaaaagcctaatgtttgttttgttctcggcgttgacattggatggcgtggattcgtgctggggac

SEQ ID NO: 233540 - DNA, 444 bp, Homo sapiens
attttctctaaaaatctctttgatattttcctctttcccctctttttgtcaggtcctaaccccatagtcgcagggtaaagtaataggaagaattgatggtagatatggatagaggtggtcttctacattgcgtccacaaagtcaaggggaaatattcacctgttgttaacttaatttgtatatgagatgttaaccaaatgttggggctaaattgcagtagatgtgttacttattgttgtaagcgcctagggtaatatttatatcccttgagtttggctgctttttttaatcaaatctcttttccccactttttcattgtttcactcatgcactctcaatcacatacaaagtgatcttgtcatcaaacttcctgtacactcaatccctgataatctaataaaaattcagtgttatttctaaaacgtatgcacagacccggagatt

SEQ ID NO: 233541 - DNA, 493 bp, Homo sapiens
agctgtgttcatttaggacatgggtattgaaatggagttttgaaggctggctgaggggcctgcactccatccctcccacagtgccctcagctcctccaccttccccacatgaaccagtccgcacctatcacacctacggtgggccgtggtcccaccccagctttcaggtatttccggagagggtagacgcagctctaggtcaggaaggattgtttccttcccttctctccttctgcagctctgcttggttctggctggcttttgctggagttgaaagactcaagtgtgctaagaagggagtcctggccatcacagttgtagtgccagtgtccccagctgctccggttccccaacaactcacagacaaccgtggtctggagggtgtgtgactctgaaaagccaaaaccccagaactccaaagttacaagaggtcaaaacagtggctctctccacctccgctcctacctcctcccaaaatgcatgaaattccctt

SEQ ID NO: 233542 - DNA, 293 bp, Homo sapiens
tgttacttatcatttgttgaaattttcaggattctggggtaattaagggttaaacattggtagactctgccaggatggcgtctgagtagaggaaaggaggagacaaggattaactgtacagaataaaagcaaaagaactaagttttttaaacttgaaaaagaaacagaattgtgcaatcattcatttctatgatccaccctctcagcaaaataaactgcagctatcactttccaaacgatgaagtgatacttctaagttttttcatggtgtcccaatatttttcagaacatta

SEQ ID NO: 233543 - DNA, 523 bp, Homo sapiens
caaacatttgtttgggtgtgctagtaaggttcttgttattgattgtgtgggcaaacattatgcatgatgagttatacagcctgatattgggaggaagcgtttggaaatagggtaaaatcatagaagatgggaaaggtgtttataagtagattacattaccgtggagggaagccactacaatattttcacgcaaacagctcagagtgaggatatcatacttaactatcttttgctattgtcatccaaacaaatgggctttgttggcgaaaatctcttggcctgcttactgcagaaaaggaaaattggactcctactgatttggatgttctacctgtataatctgaataaaacaaatgacaaagtgccccctgacaactcagcttgtgtgtagttgactacagttatcactcagtttctaggctttgtttaccattctagattatttttttccagagaaactaccaatgaattgtacagagcagaggatgctgtagaatagaatttctgcaccctatatggccat

SEQ ID NO: 233544 - DNA, 407 bp, Homo sapiens
gcgggcgaggcaggagcgcgggctccccctgcctccggagcgccggcgggggacggcggggcaggagatgtgcctgtccttagcggcccaggaagcagcatgcaccccgatgcgaccgacagtggcggcgccggcctcagccccgcgcgggccgcaggcgccggcggccgtcctgtctcgggcttcaggggcgagcggcggccagagtccccgggggacgccgaggcagcagcggcggcgccgggggccccgggcggccggagctggtggaagcccgtggcggtggccgcacttgccaccgtggccctctccttcctggggcccggcagcggggaggcggcgggggccgcggggctgagctccgtcctgctcaggctcagcctgtacctgagctgcgctgcggccac

SEQ ID NO: 233545 - DNA, 581 bp, Homo sapiens
cagatgctttcctgaacaccatctccaggtatctgaaataatggagaccctgaatacacttgaatatgccactactccctggctctgcagctttgtgagagcttctttaagaatattattttatacatcttcctcttacttcacctaaaccttcccatctgcccccactactggtcagtctcttcagctatttgggaatagctgtgaaaggagggggctgggcaagcttgtctctacaaaggacatccaactcaagcaatctgagatcttcagagttacttcttaggaccaagggacaatgaggtccactggtagaatccctatgatctatagatttctattcccttgaatttgacctttcagagtctccatgctttactgatatctatatgtgtgaggtagaggtgaaatctgtacagctagaagtaagctgggcatttctataagatataaaagcaatggtttcattcactcaaatcagacttaaggatgtatccctatgggcaggaaacccaattctaagaaacttacaaaatataatctctttagaagttgaacttttagtgtttaaaaaaaaaaaa

SEQ ID NO: 233546 - DNA, 371 bp, Homo sapiens
tgccctggaaacagaaagaatgagaggtccagacagagaaaagctcaggttaggaacgggtctcctctgggatttccaacccaccaagccatgtcctcttgggaggaggagaaaagggcaacaaaactggcagaatccttattccacagcctgtccccaaacaccatctttcactgatggtaataattcaagtaagagaagtggagattaagtagttgctgaactaaggatcagagagcaataactgaagcttggcaggcctggtaatttatctcctatgcaatgtttttcagatgttcctgagatattcaagtctagagaccaggcttatttggagtatgtgtcatagggaaggcaacagtggggggtgt

SEQ ID NO: 233547 - DNA, 218 bp, Homo sapiens
ggttatgattctgtatggtttctttggtgctgcattagacttgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctg

SEQ ID NO: 233548 - DNA, 319 bp, Homo sapiens
ctttaacacgttaatgtggcaaatgacaatttcaaattctttctgagtattaaagtagtttttcacttttgatgtaaagccaagatcctatttgctatgtcttatttagaaattttgtctctaggtctattaatgatattggtctttaattttatttttcatactacatttggtatcaagatcatttatatcagcttcacagaacaagttgattaccttttcttttgaaaattttagataaaaattctaagtataagactcacataatctgtgttttgacagttagaaataattaggtaataaaatcatttagctttag

SEQ ID NO: 233549 - DNA, 450 bp, Homo sapiens
agaccatggggaagcttctttcctagtcgaggagcaagacaatgatgacctgaactaggactatggcaatggggagagggattagaagggattggaagggacaggccctgacagttgattggcagtggggaatgaaggtgagggaagctcagtgatcgggtggaggcaattcaagtgacctcatgggtggtggtccattcatggacatggggaagacagcagcagaagcaagtttgggatgaagatgatgagttttcagtgtggaacttttagctgagtatgttttgtgagcgtttctgtgtgagtcagtctagaaatggcaactgaagccatagatgtttggaattttccagctaagagagaaaaggagtaggcttaggaaaagccccagaagacactaatggcagaaggatggacagaaggagagaagcccaagaaggaatgtgggaa

SEQ ID NO: 233550 - DNA, 477 bp, Homo sapiens
gaaatggtgtttagatcattagggctccatcctcataaatggattaatattatcgtggatgtgggttcacccctttttgctctccctctctttctttcaccccttcttggttttctgccttctgccatgggatagggcaacaaaaaggctgtcaccaaatgctggccccttcatcttggacttcttaccctccagaatcatgagtcaataaatttctgtttattataaattacccagtttcaggtattctgttacagcagcacaaaatggacaagggcatgatatattttcacttttatcactatgacatatgtctgtaattatatttttgaaagttaactttaatattagcattgaatgtttttttatattccctttttttcctgcaatttttttggcatagtgtattatttttaatccttttatttataatcattgtggatccttataataaaagtgagtcacttctaagcaaca

SEQ ID NO: 233551 - DNA, 1651 bp, Homo sapiens
acagtggctcaagcctctaatccccacactttgagaggccaaggtaggaggatggttcaagaccagcctaggcaacacagtgggaccctgtctccaccaataaataaataagattaaataaggaacacattatttgacattaaaatggtaatccttagaaaatccaaaacacaaactgttaacagtagttatctctctgagaaatccaagggaagaattttacgcttctccatctcctcaatttcttgcgggtcatgtgcatgttctattttcataatttaggaaactatttgcttatgattttccctgacaacattctcaccaatagaagaggaaatgacctttttctaatccctctacatctcccttcttactggatctttatgtatgttgtaatgccataaagttaaaagtgagaggtcagctcagatatcttattctctagcctgatatatattgtctttgtacaaacagatagtcttcatactgggagctagtgtggtggtacagaatgagcactagactgtgagtccaaatactaatttttttttttctttgagactgagtctcactttgtcacccaggctggagtgcagtggtgcaatctctagctgcagctactgtggtgcactctagttgcagctactctggaaactgaggcaagagaattgcttgaacccagaagctatccaaggctatagtatgctataatgctatgattgcacctgtaaatagccaccgtaccccagcctgggcaacatagcgagacctctctcttaaaaataaaacctcaaatttcctatgttaaaacatagaattatgtaataattttaaacatttaaaagatcaaattcttaatattctgccacctgctatttttatcaacacatatttagaaatctttcattggtgtatatacagctacctcacttcttttgccagctgtatagcattccactgtacaaatatattacgattcatttaaccagtccttctataaagaatgcttttactaactcatgcaacatataattacactgagtgcctattagagcaggtcccgttctgggcattagagatacacaagtgaacaaagcaaagtccttgacctgatggagcttacattccagtggggggaagtcagacaaaagtccatcatagtacgtcagctggtgtagactaaggagaaaaacaacgcagggcctaggagctcagtaacaggtgggatgggtggggagaagttgctattttatagtgtggccagggtaggcctctctaatagggtaaatataagcagaaaccagagggaactgagagagcagggcatgatgatatatgggtgaagaatgttagggcaaaggcaacagccaacgcaaaggccccgaggtgagagcatcactgagagagagtatttgagaaaacaaggtggctagcgtgcatggaatctgatgagaaaggtagatggtagtaaaacatgtcagggtggaggaaaacaaaccatgcagggccactttaaggacttttcgacaggggagtggcatgactggacttacgtttcaacacaatcactctgctttgttaagaacagattaaaagaaaacaaagatcaaagcaatgggtccagttatctcagtgggagacaatggtttaa

SEQ ID NO: 233552 - DNA, 454 bp, Homo sapiens
aacacatttttctcatgttttgcagaactccaagctctcccattttcctcctttatgctcctgccagttctgcaaatgtgggagtcgcccaaggctttgttcatcagccctcttacctaatcacatttcttccaagatgtcttatccaagcccatagttttaaatgccatctgtgttcaaattagtcttttcaacagattgagtgtcattgaggaagagtgtgacaaacagaagcagatgtcataattttcagtgtcgatagcaattcccaaagcataagctctatgagggcaggaggtctggtctgttttgagcactggttgtatggctagcacatagtagatgacaagtatttttttaaataagtgaatgaacgaagtgtttccaaaacattggtcccaggaggtgttctgtgacaaatgggttctatgaataaataacttggggaaacatg

SEQ ID NO: 233553 - DNA, 1741 bp, Homo sapiens
ggatcactctttgttgtgggggcggtcctgagcctggtaggatgtttagtggcatccctggcttctacccactggatgccaggagcacccccccgtcaagttgtgacaaccacagatgtctccagagattacagatgttccctggtgggcagttgagaaccactgctctgaatggttattgtccccgagacgatgttctgttcctcacagtctcctgcacagctaccttgacggggcgatcacctgcactattttaaaccatctctctcagatttcaccaggatgcaagtcatttcatcagtgggaaactcaccagggtgacctgcctcaagtgctacacagggagggacagtctgaatttcccccagtctttagccctgtcgctgtggaggggagggggtagcagggacaggactgctaggacaccttgctcagccacagccccacttgtaaccgcgctggcgattgtgacacttgtagagcaaggaaatcagcagctcatggaatgtgaaggagcacctttgtccccagagagatttagataaaggttcaaggtgaggctaccctcccctccctgaggctgattttggtgagaggtgtggtcatcttgtagtatcaagactacaggcatgggcttgagaattaggaggagcctgagtgagaatcctggctctcttcccagctttacaagcctggacaaatcctttgacctcgctgagtctcaggttcctcatcagaagtaagaggacctcccatatatcttccagggcacttatcggccttggtaatggatattaaggccactggctttggaatccagcagactttgtttcaaatgctgactcggccactttactagctgtgtgatcttgggcaaattactttatctctctgagccttgttttccttatttttatttatttatttatttttttgagtctcgctctgtcacccaggctggagggcagtggcacaatcttggctcactgcaacctccacctcctggcaattctcctgcctcagcctcctgagtagctgggactacaggcgcacgccaccaggcctggctattttttgtatttttagtataggcgggatttcatcatattggccaggctggtctcaaactcctgacctcaagtgatccgctggccttggcctcccaaagtgttgggattacaggcatgagccaccacgcccggcccttgttttccttatctatatctgcagtaataacagtatttacctccaagattgcaaggatgaaaggataatatatgtaaaagacaccctaggtgccggcacctggtggatactctatgatcaccttcagcttcacacagcaggctaaggccattctttgggaacaggaagaccaggctgttcccactgtgtatgggtgctgctgagtactcagaggcagtgggcagttaagaggagaagagttctgggatcagaaaagtgcccaggactggccttttattcatatgttcaagaggtgttcattcatccaggccctggatcaggctactggaggtaaaagaataagtgaaacagagccagtcctgcccttgtgtagcagacaggctgtctggatactgtccataaaaataaaatgtgatcggctgggcacggtggctcacaactgtaatcccagctctctgggaggcccaggcgggtggatcacgaagtcaggagtttgagaccagcctgaccaacatggtgaaaccctgtctctact

SEQ ID NO: 233554 - DNA, 1587 bp, Homo sapiens
gccgttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcg

SEQ ID NO: 233555 - DNA, 224 bp, Homo sapiens
ggcccaaaaccccggaaatttattgtctcacagttctgaggccaaaagtccaaactcaaggcgtcggcaggactggcttcctctgcagggtgcagggagagtccgttccacgtctggctcctgtcttctggaggctgccgccatccttggcgttccttagctcataggcgcatccctctgatctctacctccatctgcacagccccttctccatgtgtcttctc

SEQ ID NO: 233556 - DNA, 1275 bp, Homo sapiens
gaacaatggggctccaggcaattagtcagtaatataaagtgagaaagccagagagcagagcctcctcagcagtctgtcatctataatcagagggcagacagtcctgaaaaccaggcagaggacttaacctaaaaggagcagaacattagaaaaggttgaattttcagctactatcagtctctaacaccaaagtcaggactctaataaggaaggagtgagaccctgagacaaaggacaggactctaatgtccgtagaacttcaagctcctctgaactctttgttcaagaatggtaccaccaacccgaagactatgcagacacctcaaatgaggtaggtaccctacaagacaatgcattcttggcagggcatggtggctcatgcctgtaatcccagcactctgagaggccgaggcagacagaccacttgaaatcaggagttcaagaccagcctggccaacatggtgaaaccccgtctctactaaaaaatacaaaaattagccaggtgtggtggtgcacatcccagctactcaggaggctgaggcaggagaatcgtttgacccggggaggcggaggttgcagtgagctgagatcatgccactgcattccagcctgggcgacagttaagagtgagactctgtctcaagaaaaacaaaaaacaagaaaacaatgcattctttctgttcctgtatccccctggccaccagataaatcaccaagatcagataccatcacgcctgctaagggaggagtggaatcaaaaattgaaggaactgcaagaccaggctaatacacaccagcagaaactgaaaataagcccgggaatggatactacggggcctagatcaaggggtgaggggtgagggctggggagcagataagagagagtttatagatatgtgggcactttcctttaatacagatctcacactttgtcaaggatgctgggtgggcaggttctgatacatcatgggactggtatttgacaatagaaataagctacatgggctgggcgcggtggctcacgcctgtaatcccagcactttgggaggccaaggtggaaggatcacgagttcagaagatcaagaccatcctggccaacatggtgaaacccgtctctactaaaaatacaaaacttagctgtggggtagtggtgtgtgcctgtaatcccagctactcaggaggctgaggcaggagaatcgcttaaaccagggagttgaagtttgcagtgaggcaagattgtgtcacagcactccagcctggcaacagagtgagact

SEQ ID NO: 233557 - DNA, 382 bp, Homo sapiens
actccagcctgggcaatagggccagaccttgtctcaaaaaacaaaaagaaaaagaaaaaaagaagatgaaatcagaagatttgggtgtagttaaggaaacatatttgtcagcagaattttgggggtgagctggaaattatggaatgcttttctgggtaaaattcaccagtctcaggccttcttttcccaaaatagaactctgtgctccagtaagtttgggaaatcctcatttaattaaagagtttcttaaccataagaatcctcagagccttccatatgctaatgtgcattgtcagtttccaaggctaggaagtggcatttctctggatctataaggtctcaagatgcccttgagactgtattctacctgatgcatggctcc

SEQ ID NO: 233558 - DNA, 911 bp, Homo sapiens
gtgactacctgagtgctgcaacaatgcataagacacattcctttagcttaagagtctaacatatggaatgggcataaaaatacagacatagacgatcaaagtagaagtgcaatgtgtcgaggagaatggcagaaagtggaaatgctatggaagtttagagtgcaaagtgatttctttccatccaaggaacctattttcatattttaattgagcctgctaagatggggagtattttgccagtttctgaaaaagtgagaatttctccatataggataaaatatgagtaaggtgaataggaaaatcaggtacaattttcttgtagtaatttatgtggactgtaatgcaggaggtaacaaagaaaagagtgagcgttttaaccagactagacaactgtggactgggaaagatattaatgggtgatgagaagtctctgaagggtttggacctcacacaaagatgagatctcataaactggcatgagtgaggagtgctggaaatggctgatgagagacctgtctgggactttatttaagtggtttataggtagaaataacaggagttaaaaaaaaatagatatgagacccactacagagatagaatgaaaataaattagcagttagtcatgcagataaggaaagagtagtcacctgtgtgtagtggagatcaaatgcaccagtagtaagatagcattctggatggatgcagccatggcattgcaaagaggatatcttcatgtgtgcaatagaagtcatgaggtataggttgttgtgagattaaatgaaagtatgtacatgaagtggatttttaattaaaatactctaagtaagtgaataatattagttttattatgaaagtttagaataacatgacttgaaagatagtactattttattaacagagctgtagaaata

SEQ ID NO: 233559 - DNA, 511 bp, Homo sapiens
agctgaaagaaggaatcttctctttcttggtcctgtcatctctcctgcacttcactgggtcatcaggattagaacaagagctgctgttgaggtttcaacatatggaaatgaccaggggcaagaaactggaaagacaccatgagatccaatcccaaaaccagagggcagagttctggtgccaaaattggccttgaggccttgccctgctacaggcctgtcatcaccaagccagcttggacaggtgcttggctggacagccagcagtcagagtcatttcagctgggatggaaataaatctgagggtagattgtggccagacaccggccaagcttcttatctagtcaatctgagtgttctgtaagcgtgtgaaaaacattctcagagattaaaatggactttttaaataagtggctctaggaaaacaggcaggcatttgaaaaaaattagagctcacaccatacacaaaaataaactccaaataagtcagagatctaaatgtaaaaaaaaaaaa

SEQ ID NO: 233560 - DNA, 328 bp, Homo sapiens
gcttgcatctatttgtctgagggctttctctggacattaaagcttactccatccacatgtacagcaggacaggagtattggataattaatgcactcaggagcaaccctcaacaataaccaactggagtgggtgtatacatacctcagctcccttacccctctgcagtgaatgttctatgctgccacccagaggtctccagtgggattgaccccagttgcttacagggataagttacttgataggacatgctttataaacttccttttgttcctactttcacttcttcagatctggtatcacctcccaaataaacttacttccactgga

SEQ ID NO: 233561 - DNA, 203 bp, Homo sapiens
gctagaatgaatggttgggcactaacaaatattttcacaacctaagcccatactcgcagttgtttgctgaacagacaatcaataaatcaaacagcccttccatgtagaaattaagaaggaaacacaacaccaaaactcattattaaatagcattttgtatttgaaaactcattattaaatagcaaataaattgcactaaaata

SEQ ID NO: 233562 - DNA, 314 bp, Homo sapiens
gaatagagaacccagaaataaattgaaacatatgtggtcaactaatttttgacaagggcaccaagaggacactgtggggaactgatagtctctttgacaaatgatgcaaggaaactggatttccaaatgcaaaagaatgaaattggatgctattttttaccatacataaaaaccaacttaaaatggatcaaagacctaaatgtaacatctgaatttatacaaatcctagaagaggatataggtagaacttctttgatattgacattggaaatgattttttgaatatcacaccaaaaaaaaaaggctaccaaaac

SEQ ID NO: 233563 - DNA, 296 bp, Homo sapiens
tgatcaaagggagcccgagcctgagctcggatgtgtgtcaacaccgtggctcccagggccatgaccttatccattcatcaatatggagaaaagggctctctgcgcttaagaggaaggcagtggaagagaggaggcccttctttgttcttttgggcctgacaagaagcaggcacaacctgtgctggttagggggttaagaagttctgttaactttcaggttttcttggatttctgctcacatccaggagctgggtggaatcccagggccttctgctgagagcaagcacatatctgga

SEQ ID NO: 233564 - DNA, 398 bp, Homo sapiens
gtcttttgctaccctttcaatctttatgccccaggagtagcaaactgttagttttgaaccatatgaaattgccctttttgtaggtcaaatatcagcagattaatagggttcagtcgactgggtgcgatgtctcacacttgtaatcccagcactataggaggccaaggcaggcagatcatttgaggccaggaattcaagaccagcctagccaacgtgctgaaaccctgtctctactaaaaatataaaaattagccagacatggtaatgcattcctgtaatctaagctacttgggaggctgaggcaggagaattgattgaacccaggaggtggaggttgcagtgagctgagattgcgccactatactccagcctgggtgacagagcgagactctgtctca

SEQ ID NO: 233565 - DNA, 523 bp, Homo sapiens
ggaatcataccatatacacttttctaaatcttgctttttttccacttagcataatatcctagagatattttcatgtaagtacattagaatgtcctcattcctttttatggttccatggtgctttattgtatggatgtaactttatttttccagtcccctactggtgaacgtttgcttcaaatcttttgctcttccaaacaatgctgattttgtgcatatataattatgagcaccttagtgagtgtgcccgtggcataaacttgcggaagtagaattgttaggccaaaaggcatgtgcaacctgatgtaattgtatcaagaatgtatctgaatgcctgtcacctctcactcttgtcaatacagtgtgttaccaacctttttgacctttgccgatcagataggtgataatgttctctcttttcacttgtgttattatgagtgtggttgagccatttgtatttcgttttttgtagattgtttctatcttttgccgtttattaaaatttaatgtttaccttatcaaa

SEQ ID NO: 233566 - DNA, 1481 bp, Homo sapiens
agaactcccctgtttcccgagtgcataggaaagtgcttagcattgaatgtggagcgatagaatgaacaaagaaatgacaaaatgactaggtggatgaatgcatagcttaatatcagcgaggcaggaagtaaacaaagagacactgagcaccaagtaattcaatacaattcatcatgagaacttatctttaagctcctgtttcatgaggttagatactgtccaacatggttcttacagcacttgttttagctgacagcactggcattcagtgaaaattacagtgggcttgagtatctttggaaataacggttttgcaaatttgattaccattaaacagcctttataaaacacctacctgagtaggaatggagtatatatgttagccaagacttaattattcatctcaggaattggcacactatctgttggctaaagccatcttcctgtctacttaccttatctgtttttatagagcccatattctaaaaatgatttttacatttttatatgtttggggaaaaaaattcaaaagaatgatacatgataattacatgaattttgaatttttttgcccaccaacgaagttttattggaacacagcccgggaaacaacaacaacaaaaatgatactgaaaataataaatctatttatggacaaaagaataggagtcaaaaataggaggcaagagagcacactggaatttagggaaaaagaaagaaaggcaatttttggagcaagaatcatcattaatgtgtgtgatttgaggtgatacatggttaatgaacatttgctaattttttataattacacaaaatccatataaatatatttactttgattatatataaatatattaatattgttaaaaaattaaaacacttctaataaacaaaatcccttgaccactgagttatcacatcccaattccaggtccctctctggatcttttatgatggtcagcaagcatgcctgccagacgagccaaagggaaacatctttattgtattggatagtacacaaacccaatgtttactccttaggaaaacaccatctctatctttcaaggctcttcactatacaagcatccgtgaaaaatagttcgtaacaaagacaggtcttctgctcacaagatctgtagaaacatgagacccatagagaattgtctcccaacaatttccttcagagaggatttgcacttgattgcatcaagagccatggtatcctagcactttgggaggccgaggcgggcagatcacgaggtcaagagattgagaccatcctggctgacacggtgaaaccctgtctctactaaaaatacaaaaaaaattagcctggcatggtggcaggtgcctgtagtcccagctgcttgggaggctgaggaaggagaatggcttgaatccgggcggcagagcttgcagtgagctgagattgcgccactgcattccagcctgggtgacagagcgagactccatctcaaaag

SEQ ID NO: 233567 - DNA, 405 bp, Homo sapiens
gagagggtggctcccaaaggggctagaaaaggtataaaagggccagttcccaaatgcctgctttcctgacccagatcacaagacaaagcagcaccattgtttatcctctcatcccacagtctattgggggatgctcctgcccaggtggccccacatcccttaagcccagctttccttggggacaggggtgtagcggaatagtatggcttgagacagggatgtcaggcgggaatcggcaggcagcaggtgggcacctggccacagcagagccttgcctcacagcgcggctcctcctgacccagctgaccgcgtctccttgagtggcccagggaagagcttcagggaccttcaggcagatcctcccaccagcaaatgttaagaggtagaatgcaaggcgtttaatga

SEQ ID NO: 233568 - DNA, 488 bp, Homo sapiens
gctactggttgtcagtgacctcagtgctttcaggctatgtccttgtttactctgacagcaaggtggtattggagtgttatagggttacagagaagaccttcaattatcaattataggttttaaatttaccctggcttttaaaggactagggtacacttttttctttactacttccatttctttttctttctctttgacttcttttttgtctctctttttttctctttctgacttcctctttgtctcttcccctctctcactgtttctctttctctctgacttcctctttgtctctgtctcttcctctctctctctgactttctgtctctttctctctttcctttctgctggtctttccctgcctctgccagctgcttatgctgctgttctcccttctccttccccttttgatggcttcggcggtgtgagactgccacctctttggatttttgtactgcgtgcaataactccataatttccttgtggta

SEQ ID NO: 233569 - DNA, 274 bp, Homo sapiens
ctactggaagaactgctttatgttggctggagctgttttgtggctgggaagtagagatgagaataccatggcagctgcttgaaccatttggtgagaaacaggtagagagctactcaatcagggtaagaattgataaggaaaacagcatgatgtgacctctaacctaacccttccaaaagctcactaggttcaaaaccattccttccctttttctctctctccctacttacttctcctcttcttctcatcctctgcccctctgatctctttcttg

SEQ ID NO: 233570 - DNA, 452 bp, Homo sapiens
tacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagtttttctgagcgtcactttcctcatctgtataatgaggggttggccaaggaaacccataaggttatcttccagctgactttctaattggtgaaccctttggaaaaggggtgcagcttgcttctggtcttcatcctcaagtatgctgtgcttggacaggggccaaaactaattcctccactcaccatttgcccagcataactacaacagtacctggcacatcgtggatgcttattaaatatttattgcaggaatgagtaaatataactaactgatcataaggtaaaa

SEQ ID NO: 233571 - DNA, 388 bp, Homo sapiens
tctctgacatgggtgagagatcctttataccccggatgccttcacatggaacaacctgtcttttttaaggggaagcaatttgggtcaacaagcatttatctaacaatagactggcttaccccacacccattctgaacctcctttcccttaccagtctccactctagaggctggaaaaatgagtatcttcttttctcatcttctgtagctgtagggaacatttgacagtgtcctggcagtgagagataggcagaaacctgcttgggttttggagaagcttgctttttaataaatgggacagatgtatctggcaccatcccttcctcctatatcctgccttgaatagggatgtgataccttgagccatggcatccacattgtgactgtaa

SEQ ID NO: 233572 - DNA, 382 bp, Homo sapiens
atcgatctcaggacaaggcctataaaaagagacaaagatgattatataataatggggtcagttcagcaagaggatataacaattgtaaataaatatgcacgcacctggcatggcggagcatgcatataatcccggaactttgggaggctgaggctagctgcttgcttgagctcaggagtttaagaccaggtgggcaacatggtgaaaccccatctctacaaaaaacagaaaaattatccaggtgtggaggcatacacctgtagtcccagctacttggaaggctggggtgggagaattgcttcagccagggaggttgagtctgcactaagctgtgatcttgccactgcatttcagtttgggtgacacagtgagaccctctcca

SEQ ID NO: 233573 - DNA, 411 bp, Homo sapiens
gttgaggtggggaggagcacatttcttcctggaagaagggcagtgtgttcagaagcacagaagcctgaggagggtgatggggtggctgcgggcgatcagctgagctggtgagtgggagtgggaggaaggactgggccaggtctcagtgccggctcccgagggcttcagtggagcccggtgccttcaggtccatgccgtagttgtccaccgcggagcagtcccgtgggaaggccagggcagctggacctcactccttaaagaggaatattaatcacgaatactttgagctgcaggtaacaggaaacgcaaccagcagagtctgaaaccaccacaacaacgcactttgtttacctagcaagaagcctgaaggttggcagtttcagggtgggtttgacagctccacgatgtctc

SEQ ID NO: 233574 - DNA, 792 bp, Homo sapiens
  misc_feature (13)..(13): n is a, c, g, or t
  misc_feature (214)..(214): n is a, c, g, or t
  misc_feature (341)..(341): n is a, c, g, or t
  misc_feature (359)..(359): n is a, c, g, or t
  misc_feature (418)..(418): n is a, c, g, or t
  misc_feature (429)..(429): n is a, c, g, or t
actattcttattnaaaaacctcaaattgatttaagatatgacacatttaggacactgcacactgcaccacatgaagggaaaagcaggtttctgttcccacatggaatacacggttttcctaaatccttaaacagacaaacagaaaagtgtattcaattatgattttaaacatattttctgttagcactggggctcaggggtttggggttccttnaattttaaagacaatgactcagggtggtagaaagagctggggatctgctgcaggtgagctgtggggtggcggggtccactccagtctgcgtgagtgtggggccccagggtgtgggcgtggaggtagntgtaagggtgggtgtaantgtgggtgggtgtgagtgtgggcgtggaggtagatgtaagcatgagtgtaagtgtgggngtggaggtagntgtaagcgtggacgcggactgcatgagtgtggggccccacggtgtggacgtgggtgtaagcgtgggtgtgcaggtagatgtaagtgtgggtgggtgtatgagtgcagcagcattacacagtatctttgaagtcaattagacaagagttgctcttctgccatttactagctacatgacctcaggagatttaattaaccctttcaaacacaatcgcctcacttatgaaataggagtgataatacttgccttgcaagcttgttgagaaaattgaatgtgacaaggcttgtgaagcacctggcatgtggtagacacatatgccattgctctccagcctgggagacagagcaagactgtctcaaaacc

SEQ ID NO: 233575 - DNA, 849 bp, Homo sapiens
tctgcccacctgctcctaaagttataagaaccctgacagggcaggacaaagtctttttttggagttgggaaggcacccaatgctcactttgcccctctgttgttgatgtttttaatattcctcaagtcaaaaacaaacacaggactctctcaacagaacaacgtaaagacagtctgcctgaggccacccaaagctgtcaggatttctaggacactggaacatttctttcctcaaaaagtggccacttcccattgctttttcccacactgcccttgagtgttgaggtctgggctcattgactcaccccctggactttggcatgaccatgatgagcgctcatcactgctgctgatggtgccgcctttgcttgggaggtcattctgatgctcattcaccttcatggactgcttcaaaggcaagcatccagcacctcgggcttactttccctgagatccaagaagaagcaaaaataaaatacaataaaaaatctaaaatttagagattctttccaagagaacagcttcaaactcagtgtcagatttcatgaataatggatgtgttgatacactcaactttcagcaaaaagaacagcacagcctctgacggtcccctcctcgacacaacttaatctgccttccacttaacaggctttgtttatctgtttttccccttagccgggccttcaacgctgcaccaggttataatgagaggacattttttgagcacaggcacccttgaacagaaatggcaattaactagtatcatcacaaatgctccaggcctttagtctttctcatggtgatgcctggagcaaaaaatgtgtttactcaagacagagcctattccggt

SEQ ID NO: 233576 - DNA, 372 bp, Homo sapiens
tctgcccacctgctcctaaagttataagaaccctgacagggcaggacaaagtctttttttggagttgggaaggcacccaatgctcactttgcccctctgttgttgatgtttttaatattcctcaagtcaaaaacaaacacaggactctctcaacagaacaacgtaaagacagtctgcctgaggccacccaaagctgtcaggatttctaggacactggaacatttctttcctcaaaaagtggccacttcccattgctttttcccacactgcccttgagtgttgaggtccgcaggcacgtggcctccctccaggctgctgaccctttcctcaccctgtctaccctaggcccatcattcctgactttacaccagc

SEQ ID NO: 233577 - DNA, 1161 bp, Homo sapiens
ggagactgcgaaagacaacagtggggacaactgagtgagcctccactgaatgtctgcagagaccggccagatgaggggatgatggagttgcctgcttgactcgttcctgtacttttatcccaacaaaacatgacacacaccgagatgtgaaagctgtcgacttttctttgtaaatgtttctacccaggaagacatgatttcacccaccatgaagccttctggaagcacattcctctgacgctgcagcagcgaaggacagggaaaagagaagttatcatttctttctcagaacctggccccatgagcctcagtgtagccctagttcctgggatcagcaccaacaggcagggaggagaggctctggcgccctgcagacagcaccaggttcttggcatcaggagctggatacagagtccctgataatcccagccacagaatatttcaaactcaccgacatgtcctctaaatatcagatatgaaaaggcttccactcttgcacctgtcttgctattattttacagatgtgttctaaaagctataaagacggaaatcactattagtgtgtcacttatgtgatattcagacacctgagctctgtgatgattttaatgccccacaggtctttcagaaatccacctcatatacctcagaacgcccctccatctgcaagggaacgcatgtggaacaggtggagaaggaattcttttaggcccatgggtagaattgtaaggactcttgtaaatgcttcttctgtagtagagaagctggacggtatgtgtgtgtgcttatgcgtgtttgaatggacgcaggaaaaatcaataatctgcttgcatcaacacctaaataaaaccaaaataatcccatgatttgcctaaaaccaaattaatctctaggaaaagcctgctgtgacagagttgtgtgggggcgggaattacaaaagaaacgcagaatttccccgagcttccgctttgcaggaatctctgttccgttactcactattttgagagagccctgcttcttcctccttctccccaccacacgtcaatgtcattttcacaggggggaggctacaggaagcacacatctgcagtgtgtcacctcccgaggctgacagatctactcagtatttgtttgggttgaaaatagttatttttttgtact

SEQ ID NO: 233578 - DNA, 554 bp, Homo sapiens
ggagactgcgaaagacaacagtggggacaactgagtgagcctccactgaatgtctgcagagaccggccagatgaggggatgatggagttgcctgcttgactcgttcctgtacttttatcccaacaaaacatgacacacaccgagatgtgaaagctgtcgacttttctttgtaaatgtttctacccaggaagacatgatttcacccaccatgaagccttctggaagcacattcctctgacgctgcagcagcgaaggacagggaaaagagaagttatcatttctttctcagaacctggccccatgagcctcagtgtagccctagttcctgggatcagcaccaacaggcagggaggagaggctctggcgccctgcagacagcaccaggttcttggcatcaggagctggatacagagtccctgataatcccagccacagaatatttcaaactcaccgacatgtcctctaaatatcagatatgaaaaggcttccactcttgcacctgtcttgctattattttacagatgtgttctaaaagctataaagacggaaatcac

SEQ ID NO: 233579 - DNA, 972 bp, Homo sapiens
  misc_feature (36)..(38): n is a, c, g, or t
ggcagggggtcgttgggcagaaagttaagtttggannngcctcgcgttagaaacatagtttaaaggacagggaaaagagaagttatcatttctttctcagaacctggccccatgagcctcagtgtagccctagttcctgggatcagcaccaacaggcagggaggagaggctctggcgccctgcagacagcaccaggttcttggcatcaggagctggatacagagtccctgataatcccagccacagaatatttcaaactcaccgacatgtcctctaaatatcagatatgaaaaggcttccactcttgcacctgtcttgctattattttacagatgtgttctaaaagctataaagacggaaatcactattagtgtgtcacttatgtgatattcagacacctgagctctgtgatgattttaatgccccacaggtctttcagaaatccacctcatatacctcagaacgcccctccatctgcaagggaacgcatgtggaacaggtggagaaggaattcttttaggcccatgggtagaattgtaaggactcttgtaaatgcttcttctgtagtagagaagctggacggtatgtgtgtgtgcttatgcgtgtttgaatggacgcaggaaaaatcaataatctgcttgcatcaacacctaaataaaaccaaaataatcccatgatttgcctaaaaccaaattaatctctaggaaaagcctgctgtgacagagttgtgtgggggcgggaattacaaaagaaacgcagaatttccccgagcttccgctttgcaggaatctctgttccgttactcactattttgagagagccctgcttcttcctccttctccccaccacacgtcaatgtcattttcacaggggggaggctacaggaagcacacatctgcagtgtgtcacctcccgaggctgacagatctactcagtatttgtttgggttgaaaatagttatttttttgtact

SEQ ID NO: 233580 - DNA, 355 bp, Homo sapiens
ggagactgcgaaagacaacagtggggacaactgagtgagcctccactgaatgtctgcagagaccggccagatgaggggatgatggagttgcctgcttgactcgttcctgtacttttatcccaacaaaacatgacacacaccgagatgtgaaagctgtcgacttttctttgtaaatgtttctacccaggaagacatgatttcacccaccatgaagccttctggaagcacattcctctgacgctgcagcagcggtaaggtttgtaggaaatacaacagtggatatgcctcctaataatacttaatttctttctcatttacctgcagttatttttaaaatctcgcagccgtattaaat

SEQ ID NO: 233581 - DNA, 476 bp, Homo sapiens
actcagggctagtgctacagaaatcccacttgggtgtgcacatgtggttaacattttcaaaggggagttttagtctgtatgtagggtaaaggcaagaaaggccatgacaagatcaacagtttactcaaaactaagcccaagaaaagcagttataaaggtcctgtctccatgcatctgaggtgtagcacagcccctaccacagttatgtctgcagaggggcataaacttcagtctataaaaacaaacagctttacatcaatcacaattaggattcagggtgttacttgttgatatatgtgaatagttacatatagctatatatgtataaatagttacatatagctatatacgtataaatccagttatacatatgtatgtatatgtataagtcttctcagtaaagccataggtaaataaatatttaaagtaatggaggaaattcttaacatgaaagtagcaaagactgtagaatgaca

SEQ ID NO: 233582 - DNA, 473 bp, Homo sapiens
gggtttcattcccagctctgccactaaatttactgtgtccttaattggcaagttgcttaacatcttggcactgttatctctttatctgttaaaggagagagtttgattagattgtctttaagaccattcccacttccagctctaaaagtctgtatttaagtgactctaagagactgtaataataatagataacatttgttgaccattaccttatgccatttacatgttgatttaatgctcataacaaccgtatgaggcaggcactgttattcccattttacagttgagaaaattgagactcagtttaaaacatgcacggggaacaaggtagctttttggggtggtggaaatgttctaacacttggttctggtcatggttgcagaactctgtagatttagagttgtatatttcgagtgggtgaattttataatatgtaaattgtacctcaataaagctgttgaaaagaaataaa

SEQ ID NO: 233583 - DNA, 1716 bp, Homo sapiens
  misc_feature (889)..(889): n is a, c, g, or t
  misc_feature (1136)..(1136): n is a, c, g, or t
gtgagagaatgcttgtctgtgaaagtcacctgtaagatgagaacttaaaaatgattgagttggctgggcacggtggctaatgcctataatcccagaactttggggggctgaggtgggtgaatcactttgagctcaggagtttgagaccagcctgggcaacatggggagacccttcctctactaaaaacacaaaaattaatcaggcatggtggctaacacctgtaatcccagctactcagctggctgagtctgaaggatcacttgagcctgggaggcagaggttgcagtgagcggagactgcaccaccgcactccagcctgggagacagagtgagaccctgtctccaatatatatatatattaaataaatggttaagagctaaccaaagcatatagaggaatagctttatagcaaataatgtaatgtggaaatgcatagggcaggatagaactttgcaacttcaagaaaatagaacacaggaggctaatgcctgtaatcccagcattttgggaggccaaggtgggagaattccttgagcccaggagtttaagtttaagaccagcctgggaaaagtagcaagacctcatcattatgaaaaaattaaaaatcagccaagtgcagtggtgcttgcccagagtcctagctactcaggaggctgaggcaggaggacccagcatgagcacaggagttcaaggctatggtgagctatgatcatgccctgcacttcagcttgggtgacagaccagaattccatctcaattttttaaacgaaaatagaagaaagacaggcgattggaacaagagaagactgaataagagtggtgtcataattggaggggtataaaggggtcaggtcttgaaaggactggcagaggactttgaggagatnagagtttgtctaagctctagagaagatcttgaagaatttttggcagtgaggtaaggttatctaatttatgtttatacatatctttctgaatattttgtagataatttgttggagtagtgaaagggagggaatgagaggatggatgctatttgcagtggttgagccataaatgggcattgggttagtctcagattatgacagtgaaaatggtgaaaatggacaagatccgaacatactttggatattnaatctaaaaggcctgttgatagagggaatatggatttatgaagggaataagaaggaaatgccaagcctgtctccagcgtttcgagtttagcaattgcttgaatggctgtgttatttaatgagatagtagcatcaagaggagaaatagtttttcagagtggatgaagttttgatatttagattatttaatattgagattcttctgatttatgcagtaaggaatataagataggcattaaaaataaggtgcaaaacttattttgaatccaaagcttaaaagaaatgtcaaagcaggaaacaaaatacaccagccatccatacagatggtacttaaaaccgcagagagatgagaaggtccaggattgagtcaaaaagaatcatcttttgttgtgtgatcaaccactccagtttgcctaagatgaggttttcctggcatgtgagactttcagtgctacacccagcaaagccctggcaaactcgatgagttgattatcctatctgtagttctgatgagagaatatctaagaagacatatttacctaagccagacaccagactagtgactagtggtctgcaccact

SEQ ID NO: 233584 - DNA, 635 bp, Homo sapiens
cgttttcctgaactcctaacctcagtcaatactgcctcgggacctggcgctgcctgggagatccagaagaaaggaagcatcttggcccctgccttgggggcgacacgaccgtccccaaacacagcgagtcactggcctgggtctttgtgcagaggcccctctaggagcggggaaccaacgatggcacgaacattgatttgaggaggatgcttcgcagtttacgaaaaaatgagtgctagaggcgttcagaaacgggaaagatcactttgtgctcctgtgatctgaaggctgcgtgaagaagatgaggcttggaaaataggtgattctcacaagaaggcttcaataatctccatgttagagatgaagagactcaagtaactgaaagttacttaaggccaatggggaccctgtgcagctatatatccagtgtcccaagcactgtgtctggcatgttagtaaacatgtttcataggttctgtcaggtgagctgttgtgctgtatgtctgacctgaattgccttttaggagggaatcagtacttggaagctggaatacatcagggatacccctaaaacgagagactatttttttccattggattctgacataaataaattttgcctactttgacagtca

SEQ ID NO: 233585 - DNA, 802 bp, Homo sapiens
cgttttcctgaactcctaacctcagtcaatactgcctcgggacctggcgctgcctgggagatccagaagaaaggaagcatcttggcccctgccttgggggcgacacgaccgtccccaaacacagcgagtcactggcctgggtctttgtgcagaggcccctctaggagcggggaaccaacgatggcacgaacattgatttgaggaggatgcttcgcagtttacgaaaaaatgagtgctagaggcgttcagaaacgggaaagatcactttgtgctcctgtgatctgaaggctgcgtgaagaagatgaggcttggaaaataggacttaccacattacaggacagaccacagtgcatgtctgtctgctccaacagaagtggctttcttgagggaaggaattctgccttgttcaactttatattcccccacagtgccttgcagaaagtaggagcccagaaaatgtgtactgaattgctcagaattgtgtggtgaggtagaaagtattgcttaatctctccgagacctcaatttccttatttgtaaattaaactgctgattaatttctaaagttcttttgagttacagaattctgttacccaacaaggtttcagagattgagaagattgaattatttgatttctaaattctttttcaacttcaatattaaatgattttatataaacaaaaaataaaaaaaaaaaaaaagggggggggtaaaaaagaaccgggggggcaagttagggtaccggtttttggaaagggggccagggggggattaaaaggggggggggtaaaaggggtggaa

SEQ ID NO: 233586 - DNA, 629 bp, Homo sapiens
  misc_feature (20)..(20): n is a, c, g, or t
  misc_feature (57)..(57): n is a, c, g, or t
ctataatgtctgatgacagncctgggctgctcaactccccctctagagttttgcggntacttccgtaggatgaatttcagcactgcaggaacatctgagggggctaaaatatcttcatgcaagcttccaaacccataaactattttgctatcaattaaaacaaaaatattaattaaaaacaataaaaaggacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233587 - DNA, 505 bp, Homo sapiens
  misc_feature (13)..(13): n is a, c, g, or t
  misc_feature (23)..(23): n is a, c, g, or t
tcccccgggctgncaggaattcngcggccgcgtcgacacggctgcgagaaagacgacagaagggggacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233588 - DNA, 561 bp, Homo sapiens
ggtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233589 - DNA, 530 bp, Homo sapiens
gcaggaggggaaggatgggcttcctgcaacctcccttgccccacggcttcccatcctacccccggccgcgttagctgaaggccagcagggacgcaaaagtttttaggccccttaggtctttaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233590 - DNA, 441 bp, Homo sapiens
taaattcgcggccgcgtcgacctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233591 - DNA, 867 bp, Homo sapiens
  misc_feature (469)..(469): n is a, c, g, or t
  misc_feature (471)..(471): n is a, c, g, or t
  misc_feature (483)..(483): n is a, c, g, or t
  misc_feature (491)..(491): n is a, c, g, or t
taaattcgcggccgcgtcgacctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaaaaaaananaaaataaaaaanaaaaaaanaaaaaaagaatagaaaaaaaaaaaaaaaaagaagggggggggggtaaataaaactctacggggggggacgacaagtattatgaggcgcagcccgctttatgctttatgaaggggggcgccttctaatagaggggtgtgcattaataaatgagcgacagacggcggcggcggtatttaaaaaagacagggtggtgaggggagaaaacagtatgcggggttgttcttggaaggaggaccacatactcagtggggggggtggataatggggggacacactacgtaaagatagtacggtcggggaatgaaaacattggagctttgaggtgaaacacgaggaattaggcgtcgagagtgtgtgtggattattagagatgga

SEQ ID NO: 233592 - DNA, 861 bp, Homo sapiens
  misc_feature (585)..(585): n is a, c, g, or t
  misc_feature (689)..(689): n is a, c, g, or t
attctgcttttgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaaggtctccctctgtcacccaggccgtagtgctgtagtgcgatcatggctcactgcagcctcaacctcccaggctcaagggatcttcctgcctcagcctcccaagaagctggcactataggcatgtgccaccacacctggctaacttctttatttttagtagagacagggtttcaccatattacctgggctgtgcttgaattcctgggctcaggcgatccgtccaccttggcctcccaaagtgtngggattacaggcgtgagccactgtgcctggcataatttggtattttttgatagtagccatcctaataggtatgaggtggtatcatgtggtttgattgcattccngattattgtgtctgagcatctttcatgtcttatggcattgatgtatctttggcagaaatgtttattcagttctgctcattttcaaatttggtatttggtcaatggttgaagtgttctgtatatatctggatatttaccccttatcagatattgattgtcacctattttctcc

SEQ ID NO: 233593 - DNA, 808 bp, Homo sapiens
  misc_feature (20)..(20): n is a, c, g, or t
  misc_feature (57)..(57): n is a, c, g, or t
  misc_feature (664)..(664): n is a, c, g, or t
  misc_feature (666)..(666): n is a, c, g, or t
  misc_feature (670)..(670): n is a, c, g, or t
ctataatgtctgatgacagncctgggctgctcaactccccctctagagttttgcggntacttccgtaggatgaatttcagcactgcaggaacatctgagggggctaaaatatcttcatgcaagcttccaaacccataaactattttgctatcaattaaaacaaaaatattaattaaaaacaataaaaaggacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaaaaaaaaaacaagnanaaangcagaaaagagaagaaagaagaacaaagaaggaagcataaagaagaaaaacgaggaagaaagagaggaggcgagagcggcagccaagaaaacggagacgaggagcggaaaacacgggcggcgacacacgcaggcgggg

SEQ ID NO: 233594 - DNA, 1182 bp, Homo sapiens
  misc_feature (818)..(818): n is a, c, g, or t
  misc_feature (836)..(836): n is a, c, g, or t
  misc_feature (839)..(839): n is a, c, g, or t
  misc_feature (870)..(870): n is a, c, g, or t
  misc_feature (878)..(878): n is a, c, g, or t
  misc_feature (886)..(886): n is a, c, g, or t
  misc_feature (891)..(891): n is a, c, g, or t
  misc_feature (893)..(893): n is a, c, g, or t
  misc_feature (942)..(942): n is a, c, g, or t
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaaaaaaaaaatttttggggggcttgggcccngaaaaagtttttaaaccnttncttggggggggggggcccgtggtttggaacngggcaagngggtcccnaggananccgggcggactgggggtgggttttctcccccataaaaaaggccggcggnacggagggtttcggactaccgcagggttgcgcggggttcccggttctcccacgggtcgcccggcttcgcatcaccgccgccgccgcggggaaaacaacacaggcaaatcgaaaaaacaagagaacaaaaaaaagaaagaagcaaaacaaaaaaatagaaagaccacacaagaacaaagaacaagacaagaatcacacaaatacgagaaaagatagagagaagaaaagaagaacgagataa

SEQ ID NO: 233595 - DNA, 794 bp, Homo sapiens
agtttcaggggccccccccacccggtttctagccaacaatgaaatatacagccagtgtcagcacagttttgcccatagtaccatccaattaagggattggcagcttcccattctctagcaccagatccatttaattaaaatggtttaaatggctgaggaggaacaggttccccaattcacagccccaatttagaaaggcctgtgccttgaaccagttttctaatttgggcttttaggagatgccctctgaaataattcatcatgttgatttttctaaccattagtgtaaatgggacttctttgccctcattttaactagccaactagttaatcagaaaatgatagtctctgtagttttaaaaaattgttaatgctcgtgccgaataaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233596 - DNA, 1054 bp, Homo sapiens
  misc_feature (1054)..(1054): n is a, c, g, or t
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaccgtcctgcagcagtctgcctcctttttcaacatgacagatgccgctgtgtccttcgccaaggacttcctggcaggtggagtggccgcagccatctccaagacggcggtagcgcccatcgagcgggtcaagctgctgttgcaggtgcagcatgccagcaagcaaatcactgcagataagcaatacaaaggctttatagactgggtgggccgtattccaaggagcaaggaggtttgtccttctgcgcggtaacctggccaatgtatn

SEQ ID NO: 233597 - DNA, 1204 bp, Homo sapiens
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaatttcattgttctagcacatcttaactgtgatagttgtccgttcattgcagttacttggcctgggctatggattaaaagtgtctccatggcctgtaagactactgtactggtgggtctaagaagagatagaatctaataaaatctatcctgggcttcattgcactatttggtagctgtggcaacaacacattagttgaaatagctcattcaaatgtagggttcttatcagaatgggttcttaataacaaggtaacagttgtactgacatggggattttttctatccgaaaacgtacttactcgagggtccgttatatgcc

SEQ ID NO: 233598 - DNA, 802 bp, Homo sapiens
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggaaaaaatattttatttaaaagacatcctc

SEQ ID NO: 233599 - DNA, 968 bp, Homo sapiens
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaactcaccaaaaaagggggccaacaccgctgtaaaaaataaattcgcctttttccgcaaagcatatataaatttttgtgttttcctttgtgggcccggcttggccccaagtcttttttatttttgggaaggttttatctctgcgggcccgattttggaccttacttgggccaattcgccctttaaggggggggaattcac

SEQ ID NO: 233600 - DNA, 1168 bp, Homo sapiens
  misc_feature (892)..(892): n is a, c, g, or t
  misc_feature (996)..(996): n is a, c, g, or t
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaaggtctccctctgtcacccaggccgtagtgctgtagtgcgatcatggctcactgcagcctcaacctcccaggctcaagggatcttcctgcctcagcctcccaagaagctggcactataggcatgtgccaccacacctggctaacttctttatttttagtagagacagggtttcaccatattacctgggctgtgcttgaattcctgggctcaggcgatccgtccaccttggcctcccaaagtgtngggattacaggcgtgagccactgtgcctggcataatttggtattttttgatagtagccatcctaataggtatgaggtggtatcatgtggtttgattgcattccngattattgtgtctgagcatctttcatgtcttatggcattgatgtatctttggcagaaatgtttattcagttctgctcattttcaaatttggtatttggtcaatggttgaagtgttctgtatatatctggatatttaccccttatcagatattgattgtcacctattttctcc

SEQ ID NO: 233601 - DNA, 713 bp, Homo sapiens
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233602 - DNA, 448 bp, Homo sapiens
  misc_feature (33)..(33): n is a, c, g, or t
  misc_feature (36)..(36): n is a, c, g, or t
gagggccggggggggtgttgagatcgtttgccnttngcaaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233603 - DNA, 410 bp, Homo sapiens
  misc_feature (24)..(24): n is a, c, g, or t
ttaggtctttgccggacaactttngttaaatccttccttggcatactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233604 - DNA, 460 bp, Homo sapiens
attctgcttttgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233605 - DNA, 1316 bp, Homo sapiens
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaacaaaaaaacaatataacaaaaaaaaaaaaaaaaaaaaaactcccggggcctccttttcgcgcggggcgcgggaacaacaggcggcgtttggaatgggcgcactggggccaaagtgggttcctggccccagttttctttggtcccaagggggagaacccgcgggggcccccaaaaagggagagcccgataaaaatcgcaaaaaacgccggggtagcccggcttaagagacccccggaaaaaaaccacaaacaaccaacaaacgaggggcgcaatccgacgaggcaggacgcccacaggtgtgcaaacacaaagccgggcggggggaaacacgtcgtagaacagtggccgataacaaacgcatccgcggcgaagagaaagacaaccaggggcaaagtcatcatacagaagcagagtagagagccgagcgacatagaaagatcaaccagcgaagaggaggggacagcacgcaatgggaagctaaaaagcgggaagacggccagtcgcgaaggacaattcaagcgataacgaaaccgtcgtcggc

SEQ ID NO: 233606 - DNA, 1097 bp, Homo sapiens
  misc_feature (795)..(795): n is a, c, g, or t
  misc_feature (797)..(797): n is a, c, g, or t
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaaaaaaanantgtgtggcgcgcggcctatgggccctctaagaaaagttcttctaaaaccattccggtggggcgcgcggcgggcccccatgtgggctacggcgacccgtggcgccacaaggggtgttccccaggggaaaccccggggccaggagaccacagggcggcggggttttctccaccccaattaaaaaagcgcccggggggggaccccggagccgttcgagcacaatcccccagaaggggatccggaggggccaacgcgggggtcttctcaacagggggtcccaagggagtcgaaataaaatacag

SEQ ID NO: 233607 - DNA, 1278 bp, Homo sapiens
  misc_feature (816)..(816): n is a, c, g, or t
  misc_feature (818)..(818): n is a, c, g, or t
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaaaaaaaaaaaaaaaaaaaaaaaaaaaananaaaaaaaaaaggggggggcgccccacaaaataccctccggggggggacgcccaaacgagcaaccccccttttgggaaaagggggcccccacaagagggggcacaaaaaacggcggcgggcggtaacaaacggcgagcggacaaaccgagcgcgcggggacaacgggagcgacagaccccccaccgccgtgggggcgaccgacccggggccccaaccccaccgacggagcagacccgccgcagggcgaagacaacaacagcgcgagatgtcgggcaacccaccgcacgaagcgcggcgacagctgccctcacgctatctggaacgattcagggcgcggcgataaaccgagcccacacacccgcaagccagacaacacgccgcccgccacacgcagacgccaccacaccccgccccaccaactacggcagctcagcgcagaacctcgcaaccccgccgcaca

SEQ ID NO: 233608 - DNA, 946 bp, Homo sapiens
  misc_feature (802)..(802): n is a, c, g, or t
  misc_feature (804)..(804): n is a, c, g, or t
  misc_feature (808)..(808): n is a, c, g, or t
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaataaaaaaaaaaaaaaaaaaaaaaaaaaaaaaacaagnanaaangcagaaaagagaagaaagaagaacaaagaaggaagcataaagaagaaaaacgaggaagaaagagaggaggcgagagcggcagccaagaaaacggagacgaggagcggaaaacacgggcggcgacacacgcaggcgggg

SEQ ID NO: 233609 - DNA, 767 bp, Homo sapiens
tgtgagctcctagaagtcagcttcttcacttttaccccagccacacggttattcgcgtaaggttggttataatttaaatgtcggtttgtgcacatggtttgggactctgtgtatgagtacgactaatatcttccatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 233610 - DNA, 335 bp, Homo sapiens
catttaaaaattgagatcaaatccagacctctggcttcttctgtagaatgaggtgagctggcagtgttgggaccgagccgtgagtagctgtccccgttaagtggggcactgctgtcctgtttgccacagccagtcctagctatcgctcctttttgtttcagacattgacgtagtgtatcagttgccgtttttgttttaacatgattacgccattcagttccctacaatagagataagaggaaaaagaaacatttctcttgcttatctctctattcaaaagtgagaaaataaaagctggaccaagaatggtatgtttaaaaacggtggaagagaac

SEQ ID NO: 233611 - DNA, 3284 bp, Homo sapiens
  misc_feature (3276)..(3276): n is a, c, g, or t
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaanaaaaaaaa

SEQ ID NO: 233612 - DNA, 3251 bp, Homo sapiens
  misc_feature (3243)..(3243): n is a, c, g, or t
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaanaaaaaaaa

SEQ ID NO: 233613 - DNA, 2518 bp, Homo sapiens
  misc_feature (2510)..(2510): n is a, c, g, or t
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggccacagaggccagtgtgctggtgcgctacttcacccgcttcactgaggaaggtttctgtgccctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaanaaaaaaaa

SEQ ID NO: 233614 - DNA, 696 bp, Homo sapiens
tctggttcacctggacccatcagataagaattttatggggctggaggaggttcccaggggagggaacatacatctgaattcttctctgcttcccaggaaatgagtctcaatggataaggacaaggccaaaagacagagacgacattgtaagcatggtgagggactgctcctgggaggttctaggaaggaaagggtggagaccaaggcagtcggtggtttctagctcttcctacccataggttaaggaaaccttcataggtgagtaaagcttagccatttcctacagctgggaacttcccatcctgggcccctggtgtctctgtgggtccctcctcccttgaagttggtccaggagagcaggacatttactccattgcctataactccactcctgaccctcctgtgtacaggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgagtttcacctttctttctgtgggagaggcctgactctaagctttgggtcctatctgtgatgggaagtggtgtggaaaaagagagatggcaggcc

SEQ ID NO: 233615 - DNA, 3413 bp, Homo sapiens
  misc_feature (3405)..(3405): n is a, c, g, or t
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaanaaaaaaaa

SEQ ID NO: 233616 - DNA, 2995 bp, Homo sapiens
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgaggtgagggtgtgagggaagtgctcctgatgttgagg

SEQ ID NO: 233617 - DNA, 3530 bp, Homo sapiens
  misc_feature (3522)..(3522): n is a, c, g, or t
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagccatagaacaccctcatcttcatgcttctccaagctcaagagcctaagagccaggccaggcacggtggctcacgcctgtggtcccggcactttgggaggccgaggcgggtggattacttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaanaaaaaaaa

SEQ ID NO: 233618 - DNA, 726 bp, Homo sapiens
ccaccccccacccttcactccaggcaacagggagcccgcggcggtcaccccctaccccagccctcagctcacgcccgggcgcccactggcccgcaccaccccagcccgcgcccgcgccagtcccgccggtcaccagctcgggccccagacacgacccgagaaacgtccgcggccgcggcgagccccctccgggcatcccatccctcacttcgcttctctttccagaaggcgcctgacgagcccgtttcccgggaaagcggaagctccagctgctcctccgagcccaggctgggctcctgcctgaagagctcctctccgggctcggccgccgcctccccccttgtcccgggctgaggcacggggagggcgctccgcagacaccccggcagcgccgcccgccctccgcgacctgcggctgcctcctgagcgcgcatctcggccgggaagccgctggctgggctccgaccgccgggcagggacgggccgcgccacccggggcctggagcccgggccctgccggggagtcagggaagggaggctcgggccggggcgtccgaccccgaagtgctcgagcgcccggaacccgggtggaccctctcgcccgcccagcgcagcgttggaccggccgggactcgggggaccatgcgcccggcgctcgtaactccgcgccgactccgggaggcccgcggggcgcctgccggggccggaggagggggtccggggccc

SEQ ID NO: 233619 - DNA, 349 bp, Homo sapiens
tacctggaagcaagtccaaaggaagctgacagttaacaaagacagaggcagcgcaccaagacaaacgatgtatatcatttgtttcctccctgtcccttattctgagcccaacagaaataaatgagaagacaaaaatgatagtcattcagctggggacaaatgggatcaccttgcctgctggaagcaaccgaaatgctctgcacttagcactcagtgagcagagagcagggcagcccctcagcagggttacagtttagtttgtccacccaattttggacagtattaacaactgcctttattctataatttggtatataaatctataaagggacattgatatatgacagtt

SEQ ID NO: 233620 - DNA, 393 bp, Homo sapiens
ttttatgaggggttgtcagaatttgtatacatctctggctaactccagaggccatacacaggttatcaagagacatcctttgctatttgactctagttcatactaaatacacattcaacagtgatttttatatagcagaaccctacagtccacaatctcgaaaatgtgaaaaatgagttcctagcccatcaaaccgccaatttatttccctaacttgcactaaaacatcctaaaacctatgaatcaatcctctaaggaactcaaattaatcacggctatcaatccattatagaaggtatttttctacctttctaaaacattatgctatgcttaatagtaaagttttgagaaccaaataaattctcttaatttttattttctcatcttacagga

SEQ ID NO: 233621 - DNA, 418 bp, Homo sapiens
ttgccagtttcatctatgttgtatgtagtcctagttaattcactttttttgctgttaacagtggctttcaagcattgtggtctgtgatcccattacattgtcgaaagttattgaggatccaaaagatattttgtttacatatgttatgtatttaccatattagaagttaaaactgagaatttaaagatattagtctgttttaaaacaataatttaaaaactcatatgttaacataaacattttaatgtaggaaaaacaacttcaaaaatatagtgagaagagtgatattgttttacatattttgcagatctctttaatgtctagcttactagaagacagctggtttctcgtagctgttttgcattcgatctgttgcaatatgttattttggcaataaatactgtcagttgtttacttt

SEQ ID NO: 233622 - DNA, 648 bp, Homo sapiens
tgagacggagtctcgctcagtcgcccaggctagagtgcaatggcacaatcttggctcactgcaagctccgaaaaaaaggcatttaaaagctgattttatgcaatgagttctgcttctggctaactagctagtatcagaccaatgttcttgccaagaacaattaaaaaggtgaataaaatgtacaatctgtactatttaaacatgaaaaagctaccaaggaagtgagagatcaagctcccagaaagaagacaagcccgtggaggacagctcaatatttggagtcactttttccttctagacatttatcaatgttaagtagtgcctgggaggctgaacagccaaacaaaatctaagaggcgaagtaaatacgcagagcctgatgcattctcatgagcgtgagatacaaaaattagagttgaagatctgccataaagaaaaagtcctggtaaaatcaccatagaatttcagctgggtactagaagaactacactaggtggtacgttaatgtggcgtgtaccagttcacaaaagctggctgtgtgtatcgcttcccagtgccatcttcagtgatgtaacattggtaatctgaaattggcaacagtggaagtattcacactatggaaactggcaaatgctacagatcagaact

SEQ ID NO: 233623 - DNA, 546 bp, Homo sapiens
gttcctcaggcccgtcctgcctcgcctttcgctctgcgtctgcccggggcagcccgagctgggaccttctggcgggagccgcagcttttcagggcaactgtccttgtccctgggggacggccagtgtacgcggggacacttgcggccccagcccactgccggcctggaggaaaggacgcgggggacccccatacgtgaccagcggctgcagcgcagctcgggctcacagcggggcggccggagcagcctggacccccgacgcccgcgccgtccagtccggggactcggaggctgagcccgtagggggccggcccgggggccatgggcgtccccgccctgccttttgctgggccacggagctttgaggacagtttcgcctgctgataaaatccgttcccagcactttcgaaaggcagggcggggctcaagccgtccctggaggttaaaatgcgcgtcctcgcagcttttcaaatcagcctctccttatctcctcagccgcgggcggggcaggggcctggtctccggatggaggaggaggtgcggccg

SEQ ID NO: 233624 - DNA, 490 bp, Homo sapiens
atgaactaagcaaaggctcacgatgcctttagcacagtacatggcaatgaatacaacaatgaatgttggctttggttcatatgagtactagaaatgattaaataagacccctgctaagaaaaagaaaagccgggcgcctagtaggcactgaatgcccccttccctgtaaggcaccctcgaggtctccgagtctggagcctgtaatcaggcatagactcaagatgaacatgagccgacattttctgcctcgcacagggacagctcagcttctgtgtgcaaagggctgagccgccgacttcacggttcagttttccctgccacgtgggtacagccaccctctccttttacggaagacggtctgagaggctgctggcttgagttttctctgagcagagctgggcacatttacgcaacagataagcctgccctacccgggtcggatccacccgggaagagagaaagtgtgtgcaagtgaaagctcacaaatgtg

SEQ ID NO: 233625 - DNA, 443 bp, Homo sapiens
aactcctgggctcaagggatcctcctgccttggcctcctgagcagcttcaactacaggtatgggccgctgccttctgctgaaagctgagagaagaaagctctgacaagtcgggtgctggcagcaccatgctatgacttggaattttcttcaaaactttctattctgtggagaagccagaaaatggaatgcactacaattagcaaaaaataccttgtggagagatttagagcccaatcataatttacatttgcagatacgtagatctctaagtgcatggcttctgccctgattactaattaatgaggtgcaaaactgcctgctggaaggaaacagtactgattatgtcagtcttatgggacagagcagctctccagtctaggatggtagaagattcttttaacatacatttcagtaaattaaaagtacaaaaaagggacagaag

SEQ ID NO: 233626 - DNA, 299 bp, Homo sapiens
aaaagaaggaaatgacagatttggtcctgacagcctgggaggcagagaggagagagatggagccaagagaatggggctggggccacgttttcttgtggggcaattccgtgtcactgggccagagcatgcttattgtgaagacttcccctcagtgtcctctggggaagggtcagctgtgaggcagtggggcgtgagaatacgatgaaacagggaaacctggaagctgccgattcccaggccttgaaggggtgttctgatgtctttgacattccagcaaacatattttcacaggaaaactc

SEQ ID NO: 233627 - DNA, 348 bp, Homo sapiens
gctacactgctgcaggataaaccttttatttttataattttgtgtactcaaaagcttatatcagtgaagatagatatttcttcaatctaattactattagttattttaatggaatcaatcactttgaaaagaggattacaggcgtgagccaccacacccagctattttactgtaacttttctaagtggtcgacaaataaagatagtcttatgtgtggcttggtaatttttgtggttaatatataatatgaaaaaattataggttccatgcatatatgatcagccatgtcaaagcaagtattgagttgtttggcatttcatagtatgtatagttaaaagtagattctaa

SEQ ID NO: 233628 - DNA, 250 bp, Homo sapiens
cctcagcctcccgagtagctgggattatagacacccaccaccatgcctggctattttttttttaaatgtaatactgtttatttaacttcaaaaacatttcagcattctaaacatacaaaaaaaatgttgcaaatcgtgtttaagtacaggaggttcttgaactttcattgatgcagtggctcttcactttgctgacaatgaagagttctacagcttgtttaaaaactaccccactttactcaaaaaaaaa

SEQ ID NO: 233629 - DNA, 553 bp, Homo sapiens
tgtggacctggacggtagcctgggcactggaatcctggcccttcccagacctgctgagccagcgccagcatcctaaccccagggaccccagggacgcctgtgcgcagtcgctcagagaagccccaggacgcctgttcgcagtcactcggagaagccccaggatgcctgtgcgcagtcacttggagaagtcccaggacgcttgcgcgcagtcactcggagaagccccaggacccctgtgcacagtcactcggagaagccccaagctgactcaactctgttgaaacgactgttgtaagcagatcttggaggtcgcccgtggtctctgcctccagtgttactcccaagacggctgtgttgtgtggcagagggattctgaaggcatggtgaagttcaccaacccgctgaccttaaaacagggaggtgcctccgggcctgacctcatcacaccaacactttagaagcggagtttcctctggcgggtgcagaagggatggccagaaagagccactcatggggggactccaccggcccctgctgcttgaagatggagggg

SEQ ID NO: 233630 - DNA, 417 bp, Homo sapiens
ttattccttatagccttactatcttcaaagcttacttacaaatacactcatttgtaaagagaggagtcatcagtatttgtaaaataattactgttggcttatattactctttaagtgattgaacttcattggaagaaagtctaagaatgcagagtggtaaaaggaagctggtttcctttttaaaaaagaaccctactgtggacacaggaattaactagaccagtgaatagggaagacaataatggtagcaacatgccaagatgattaaatgtggaaatatataaagacgtgaaaggtaatataatacccacaagaaatgggaaaaggtcaggttacttggaaaagtataaagacattgcacagtttggtcagaataagtacaataatatagacagccaccctctcaactgcctgttt

SEQ ID NO: 233631 - DNA, 368 bp, Homo sapiens
aaagtgctgggaaagtatttttttctaagcttcagtttacttgtgaataaaatggaggttatagagtttgccatctgtgattgttagaattaaattgtaggatacatgcaaagcagttagcaaagtacgtagcacgtaagaagtgcttgataaatgttagctcccattatctctagatcattaagtcttattcataataagagttaggctagtctaacaataagttagttattagtgctaaggaaaattaaaattttttggtacatgagctgagatctaattattgagccattgtttacaagagacatatggctatatgatttttactttctaatctcaactatgaaatgttgctcccagaaaatttt

SEQ ID NO: 233632 - DNA, 945 bp, Homo sapiens
ttttaagtggctttattaagatataaatcccataccatacaattcatccatttaaagtgtacaagtcaacagattttagtattacattattaatatttttaactgtggtaaaatatatgtaacacaaattttgtcattttaaccatttttaagtgtacaattcagtggcagtaattacatctacaatgctgtacaaccatcactactacctatttccaaaacttttcatcaacgagcagttttaaacaagtgatacggatgttgtccatgttccttcccttccgcttcccattgctgcttgtacctgaataaatctggagttctgagtgcaaggaagaattggtgggtggagggttgggggcggtgacaaatgggcagacaaccaactttgcattggttgtaacattttccagggtaagtctccactcagcatatgagttttgcatagtgggacggaaaaggggtgatgttttaataacaatgacttttccacattctgggaagtgacaaagaattatgttggagagtgtctgttctttagttttagagaacactgtttagcctttctggtttcttcttgagaagatgaagaactgggtccttgagtctagagtaagagtaattatgaaaaaagaatctgttctgatttacagagggcccagtcacacagcagcaggaagggcccaaggagggaggaccgagaaactccaagcagggacttctgacattagctttcacgttttccttttctacattgagatgcccttatagtaggtggcatcaagcgttcagtaaatcttgtcaactgcatcccaatgccagctttgttctgcaatgctttgggtaaaaacaggagtgcaggagtaggttaagaaaaacaggctgcaaaaacaatttaggataccaagaaatgatcagtccatataggcagatccatggagacag

SEQ ID NO: 233633 - DNA, 887 bp, Homo sapiens
ttttgtttttttgtttttttttttcagtagagacggggttttgccatgttggccaggctggtcttgaacaactgacttcaagtgatccacccacctcagcctccaaaagcgctgagattactggggtaagccactgagcctgctctcgtccaatgagccaatattcttaaaaataacatgattaacaaaattatatcactttaagagtgtgactagaacccagatttctgaattttaaatcttgctgccaaagtaggcttttgccctactatctcctttctaatatactaaatcactgtttcattgttatttctataagatatataattctcttacatacaaatgtaaaaggtactatactaaaaataaatgtaaatgatgaaaagatatttcccgcatcctccaaaattattgattatatgcaaataagatacatacgaatctttgtgctaaaacttgaaggctaatttttcaaatttattgattattgattatatgcaactaagatacatacaaaattattgattatatgcaaataagatacatacaaatctttgtgccaaagcttgaagcctaatttttcaaatttactcaatgattcaagaaaattcaaattaatgtactttttcttaggcaggaaaagacaacttttagatttaaaaggctataccaactttaattttttaaaaactttttaccaacttgaacagcctttgacttggtgagctatatatagcacatactatactgagaaagggaggctactttggaagctctgataaatatcaagacattagaacaccattgttttaaagacaagtgcctttttttgtctctccttaaaaggaaaaaaacaaacaacaaaactacatacatatataaagttc

SEQ ID NO: 233634 - DNA, 833 bp, Homo sapiens
ttttgtttttttgtttttttttttcagtagagacggggttttgccatgttggccaggctggtcttgaacaactgacttcaagtgatccacccacctcagcctccaaaagcgctgagattactggggtaagccactgagcctgctctcgtccaatgagccaatattcttaaaaataacatgattaacaaaattatatcactttaagagtgtgactagaacccagatttctgaattttaaatcttgctgccaaagtaggcttttgccctactatctcctttctaatatactaaatcactgtttcattgttatttctataagatatataattctcttacatacaaatgtaaaaggtactatactaaaaataaatgtaaatgatgaaaagatatttcccgcatcctccaaaattattgattatatgcaaataagatacatacgaatctttgtgctaaaacttgaaggctaatttttcaaatttattgattattgattatatgcaactaagatacatacaaaattattgatttcaaatttactcaatgattcaagaaaattcaaattaatgtactttttcttaggcaggaaaagacaacttttagatttaaaaggctataccaactttaattttttaaaaactttttaccaacttgaacagcctttgacttggtgagctatatatagcacatactatactgagaaagggaggctactttggaagctctgataaatatcaagacattagaacaccattgttttaaagacaagtgcctttttttgtctctccttaaaaggaaaaaaacaaacaacaaaactacatacatatataaagttc

SEQ ID NO: 233635 - DNA, 178 bp, Homo sapiens
gccatctccacctcagcagctatgaatgtgcctcactcttaactccactgattttcttccccattcccagaaggcccttctctcttctcattgtccatccaaaccacaacaccctcctggttatattacacctctaccagaattcttggtaaaaaatttccagtctcttatgttggga

SEQ ID NO: 233636 - DNA, 866 bp, Homo sapiens
atggggtagagattgggttgtggcaaagaatagaggagccaggacacgtccgactgagagctgagatctgagcgaaaccttgaaaggtggtgtgagagtcagccaagtggatatttgggggaaaagttttccaagcaaagggaacagtgagagtcaaggtctccttggtgtgtggtactgcaaggagccctctgtggctgacgcggggtgaaccaagatgagagtaagtaggaaatgaagccaaagcatagtggtagccatatcgtggagggcatatgggccagttaaggactttagggagcctttgaaaggtttgagcagaggagggatataatcaacttccatttcaaatggagcccccaatctgctctgtgcaacagacactgggaagtgggaggtaggcatagaatcagaaaactaagagagggtatacagtaagctattgcaaaagatggcagcgattccatcgggatagcagtggggtggcagagaaatggaatggttagattttgaatccgtttggaaggtagaccatcaaataggcagatcaaatatgagacaaacagaggagataaatatttctaattccagcttctagaagcttatgcagattatttcaacacaacaatcctcatattttgatgtttttctgaagtagttttttaaatattgaaatgaggaaaaaaaaatcagctaaaataaacaaaagaagcaataaggaaaaataaatcctgcaaactgtggcccttggccagcgacagaggaggaagtcaaagtttccaccaggccaaggtgggtggatggcttgagccccagagttcaagaccagcctgggcaacatggtgaaaccccgtctttacagaaaa

SEQ ID NO: 233637 - DNA, 584 bp, Homo sapiens
agaattctaagaagtaatcatttctcccattttgaaaatgggaaaactgaggcatagagagattaagaaacttgcccaaagtcattcaatgaaggtttgaacccagataatctgtcctcagagccctgctgtgctagtttcttacaaaatcttgggaaaaaaaatttttttggaggatacttggggctttcatttggcgtagactgggtagtttatacctcaaatggagggataatcttgactagactgaacctcgcaacagggttaacaataaaattacatggcagatgcacccccagggcaccattattatacatagcagggcctcagtaaatggtattctttcccttctcttcagacccataaaatcagctttttttaaaaagggactttcttagttttgtttacctctggatccattcctggtacatagaagacgctcagtaaatacttgcggaaggcagagaggatgctttggggtcactggatgtgatgatcactcacagttgttggggcatctgcaaatacagtggtaccattagatggtgggttttataaatacagccctgggtgaagggggctta

SEQ ID NO: 233638 - DNA, 448 bp, Homo sapiens
gctgtgtgtctctgtctcggcagagtgtagggtttgctggtagttttttccctactgctacaaacttacacataaaggcccaaaacaccttacccttgtattctatagtacatctagccatacatctagctgtgtagaggctgtagattaccaatgatgataaatcagtgtctcacaagagaagagacgatttccttcctcaactataatacctagatttattgtgtaaattcccaaacctttttcatattttgtaaatgcttcaaaggtgaaaagaatgtttatttcttcttgatccaaggaggaagcatgctttcaataccagtcactccctgcatcaaaatgcacagatttttactttgatggggtctttgttgatacatccttggtgctgaggtttatgctaaaaaaaggataagccatctgaagggatctttattctacactg

SEQ ID NO: 233639 - DNA, 423 bp, Homo sapiens
ttctcagtggttccttacctaatacatataaatttataaatagtatgatttttttaacaaattaatacctttcactttaagatataagattccttgtctagctgttttgaactcaaacctaacatgtataaatctcttcagcttaaaaagaaccagggcaattttaattcatgtccccttaagaaaaagtatttttcaaccatgtctttctcttcagcactacaaagtaatgtacctgtgaatggtgactatatttttttgttgctgattttgttacattagcttggtgcaccattgtatatataatgatctcagctttgaacgtagaaaaaatatctttgttcctgggcaaatcaattcaatttctagtattgcataagaagcacactgtaaaaataaatcactcctccatgctgtaggcta

SEQ ID NO: 233640 - DNA, 701 bp, Homo sapiens
cctggtaacagaacaagactacgtctcaaaaaaaaaaaaaaaaaaaaaaaaaggactggtccagggagagtttgctttgtaaccccgacaatcctggagggaatttggtgtttggttaaggaaaagagagaagttaaaagtcatgagttacatccagcagtgtaaaaacgaaatacccgccgggcgcggtgtctcacgcctgtaatcccagcactttgggaggccgaggcaggcggatcacaaggtcaggagttcctggccaacatggtgaaaccgcatctctactaaaaatacaaaaattagctgggtttggtggtgtgtgcttatagtcccagttacttgggaggctgaggcaggagaatcggttgaacccgggaggcggaggttgagtgagattgctccactgcactccaggcctggcgacagagggagtatgtctcaaaacaaacaaatgccatgtagaggttgctgatgaagtgatgtttcccaaattcccatgtcagcaaatggcaagctgacctccctgtgcgtctctctgccaagaactgccacctgccttctctgggctcttcccggatagcttatgaagtccacagcctttgaatctggcctagagggtggtttttctcttctgcacccagccaagtgttttaggagaggtgcggctctctgtgagggaacacagggcatgttgaacttgt

SEQ ID NO: 233641 - DNA, 499 bp, Homo sapiens
cctggtaacagaacaagactacgtctcaaaaaaaaaaaaaaaaaaaaaaaaaggactggtccagggagagtttgctttgtaaccccgacaatcctggagggaatttggtgtttggttaaggaaaagagagaagttaaaagtcatgagttacatccagcagtgtaaaaacgaaatacccgccgggcgcggtgtctcacgcctgtaatcccagcactttgggaggccgaggcaggcggatcacaaggtcaggagttcctggccaacatggtgaaaccgcatctctactaaaaatacaaaaattagctgggtttggtggtgtgtgcttatagtcccagttacttgggaggctgaggcaggagaatcggttgaacccgggaggcggaggttgagtgagattgctccactgcactccaggcctggcgacagagggagtatgtctcaaaacaaacaagaaaggttgtgataagggattttccaaatcccatttcggggctcgcct

SEQ ID NO: 233642 - DNA, 151 bp, Homo sapiens
ctgggacttgggcggctgagaagctgacctccctagttgagtcaactgccatgggctaatagtcaaagagaaagaacgagctctcaagagcaagggcaatcacagcagagaaaattctggtttgcctaatcttacattcctgtcttttacc

SEQ ID NO: 233643 - DNA, 158 bp, Homo sapiens
ttgcctctgcttctcccactcccagcacctcacagacagctgtgaagcccatatctctgaacggttttcatatactctcccccaggagccttcagtggctccctagtacccactgaccaagcaggcagttaaaacacctcctcagtgtggccttatgt

SEQ ID NO: 233644 - DNA, 452 bp, Homo sapiens
taaatttttaacttttttatttagagctttccagcagtactgacacaggtgttataaactttccctgccaagatgtggccttttcctaacgaaaagttccaaaggaatggagattgagactggagtagtttcttagaggaggtggctactccgatcctcttcactccaaaataaagtgtactcccgctcacttccctcaaaacaaatccaccacttataaatgtgcaacctgtggggccatttttgaaacgtgtaataaataggaggatgtggccaattttcagctgaaacactccccagatatgcctccaagcactgtgtacaccaccatcttgtaggtgttctgaatgtccccaagccccatgttttgctcacgaggcatgccaccctaactccctgctgctggaaatgagaatatgtctgagggtaacagatgaacagtaataaatggc

SEQ ID NO: 233645 - DNA, 672 bp, Homo sapiens
ttttttccagacttaccttgtcaataataggctgcttaggttaccctattcgtttgtagccctaatcaccctaatttcactaggttgtcaaggaccaggccaaccacctcagcaggctgtgatgttgggaggaggcccacctgggtttgcaaaggttgagcacagcagcggctgggatgatagcagctgactcctgtattgactgagtgcccagtcagtgctggggaccatgccaagggctttcttgcatcatctcatctcatcctgaccacagctccgtgaggtgggtactattatcactcatctttaatcggtggggaatatggggctgcgaaaggggtagcaacctgcccaaggttacagtttagaagctgcagaggctggacctaagagtgtagctgggcccttccttccccaggcagccttggtgcctaggcgagccactttggtgtggacgagggggctcctgtggctgacattcatctagtctaggatgtcgccacattccaggttgtccagttcgctctgcatgtggtcgatgtactgattgatctccttcacgcgcttgcggttcctcatgatctcatccttgtgaatctgaggagtgaaaccaaagcccgattccttacatcagatcattggttaatatctttcactgaatccagtttgagg

SEQ ID NO: 233646 - DNA, 620 bp, Homo sapiens
ttagaccaccttgtttttgacttgcagaattgctttcgctcagttgtatttggtgcttaagatttctgtgaaactaacttccgaaattcatgttggggtgttaaggaaattgacctctgagttgccaagtcctgaggattcaggctggaattggggtgaagcaagttgaggcactttgggccctgaatttaaggaggtactggctcccaaggtaacacaagtgttggatgggcaccgtcctggtagaattccctcctctttgggttccttagcactgcccttttctggtctttcactgattgactctaggtctggctatgtgattttcacggctttggccaatggggtattggcaaatctgctccctaagtcctgtgcattgggacttgccctctcggaaagaatgctgccctgagaccatcacgctgtaaagaagcttgcaagaaagatcacatgaagaggtccaggtgttccagctgtgtcaggcctctgccaacagctagcaccaactactagagcatgctaagatgtgaacgagaccatcttggactttgcatctgactgtctgcctatgtgcactagaacttgatataaaggtatgttttactgtgggtcttggt

SEQ ID NO: 233647 - DNA, 150 bp, Homo sapiens
atgaagaggtccaggtgttccagctgtgtcaggcctctgccaacagctagcaccaactactagagcatgctaagatgtgaacgagaccatcttggactttgcatctgactgtctaactgagtgcagccacacacatgagcccaggtgaaa

SEQ ID NO: 233648 - DNA, 778 bp, Homo sapiens
gaacttctaagctaaaagatttatcttgaaagattccaactgttggaattcactttgttttaaatagaaataaatgtgtttcaaatgaaagtctgatgatttaatgatcacaaaagtgatgagtttaataaatgagttttttctcacctgctcaatggcactcaatgaaggtttgaaatgcctttttttcctgaaattctttaagtattataccctttgattttctagaaaactttccttagtcggcattccagcttgtgttaaaaaataaagaggaagtccttccttcttaaactggacatatggcaacattttttgtgtgtgatttcatatttgtaggacataaacctgaaaattatattcattaaatttattatgtgaatgaggttactcttctttaaagataaattaactctactgcaagaaaattgtttcatcaattacactgcaatgtaagtaaaatgatacagatgatctttgaattttggaagtatttgatttttttttcctattctgctaaggaagaaagactgactaatgttacagaactttctaatttgccttgtaaatgaagcatgtgttgtgaattttaaatcttttcttccgttggctttgtataagtgtttcccaatttttttttgtggggggtggggggtgcgttaattcttgctctcttctcaccaaagacctttttagacatttttttttgatcatcctccaccacacatatactgtaaatcagtttatgtatcacatatatatctgcactctgtactta

SEQ ID NO: 233649 - DNA, 480 bp, Homo sapiens
caggcattgtaggcaaaaggatgggtgaatattttaagtgagagatgttatgcatagtacacaggtgagtggtgatgagtgaagctggaaaagtaggcaagaactgaaagaaaattcacctgtccaccatggcttggaagtagtaattaccctgatggtagtagagaagtattaaatgttttaatagcaaatgaacattttagaaaaatcatgaaagctgaagcatggaaaagagattagaaaagaaaccccatgagattggaaacagaaatagctctaaagatatactaaagtcttccaagtaagaaatgtgtgcatatactatactaatcataattagaactaaggatgtgtgtaacttcacaaagagagatctcttgatgtcaaggctaggaatggaagcctaggtattgataacattcaaagggctactacataaagcaaagtgttcttggggagaataaaaagggcagagaggaa

SEQ ID NO: 233650 - DNA, 477 bp, Homo sapiens
tttttttctagccctttttgtaatatatctgggaaaaatattccattgtagattaggttatgagtagacatttaatatctctaaccaagatgtcttcttaaggtgatttatgtgtagcatcacatgattcattttatcatataaaataaaaaaatatactttgtataatatgaaagagtaattcctatgaaatccattaaaatgtttagatatgttttaaaagcaaaatatttacaattgattattggtacataagaattcagaagtaacatggtttcataaatacaaaatgtatccaattgattctcaactatatagtgacttattttatggttggctggtgaaatgcagctatttgatgtagcttttggggctacgctacacagtttaatgatggtatgcaatttatttatatattttgttcaattgtatttccactttcttttttataataaaacctgttcaaaataaacagat

SEQ ID NO: 233651 - DNA, 543 bp, Homo sapiens
gagcccatggtgaccctgcaccccagagctgggaagggtgggctggaagcttaattaccagcacactcagctttagagttacatagagttatgttaggattccattagttttggaattgtcaggggtgatttgatttcacattttcatgggatatgggattgggatgagtcttcagtctcctggtttgtttctggaatagagtgggccacacctcccaggagtctcccccagggaactcaagacaatcactttagaattcaagaaaacaaaaataatgtgtctcacttcgttcataaagaaggcctttgacaacgtggccaaaaaggggcagagcctaagggacagactcttagaaagatgcccttggaacagggtcccgcagagtgttcctctcaaattctttagaactttacactgttttgtggggccaccctctcccacgccctttcctaacaacagtgtctttcttgatagagtatgtttcaaatttgtagactgtttgcacaataaaataaagttcctcccaaatcaagaatctgtaa

SEQ ID NO: 233652 - DNA, 397 bp, Homo sapiens
taaaacacacacatcataattgttacatgaaaggattactggatagattaaacaaaataacctgaaatacatagtaaaccacagtcagaacattcagtattagaactgcctcccaacccttgcccaggccttacactctcacctcggataccctcttctgttagatatgctgagaaaagtctcccaatctcgtaacacctaactcaaaaactgaagccttctctagtcagctcaatcagaagtcattctcccttcctctaaaatcctatatcttacttgcacaggatttagcatgtgcagcatattctctcagagttacttatgtatcattttgtttcccctcatgacctctcgtgctcaaaaaattaaatgggtggctggacatggtggctcacat

SEQ ID NO: 233653 - DNA, 516 bp, Homo sapiens
tctattttaggtatacttcataaaatacctccttccacatgattctgagttggaaagataccaacaggatgtatgtggtgcaagtgttcaagcattttaagtaggataaaatgatacaggaaatagcatcagcaatgaaagaatcgttggctatctcctcatatgattgatatgaagaaaaaaggtttagttaacttaaactaaaagtcagactgaattccaccattggattcctatttttatctcattcccactcctacttcagtttcatggtctagatactattcttaaaaacacttccttattaatagaaattgtattccctgaatattgtcatttcaactagttctcctaagatgtttaaattttgtttatttatttaaaatgtatttgttaatcattagatgtacagaatttatttataatctaggtaatccaaaggtatcattacaaaattctttaataaacagaaatgtaaaagcacatataatccaagtctgagaatggtaaaaggct

SEQ ID NO: 233654 - DNA, 843 bp, Homo sapiens
tgcggttcacaccatcggctaggtagcgaggccggttgtgaatctgttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagccgggcgtgggctggccctccggggcaccgacccacgggtgccgcgatg

SEQ ID NO: 233655 - DNA, 780 bp, Homo sapiens
aactaggctagtacgaggctgggtaaattggcagaggaggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233656 - DNA, 240 bp, Homo sapiens
cgcagcgcggggagggggtgggggaggagggaaagcggcgagtaagatggaagatgaggaggtcgctgagagctgggaagaggcggcagacagcgggggaaatccaaatctcctcccaaagtgcccattgtgattcaggacgatagccttcccgcggggccccctccacagatccgcatctcctgagtcggcagattaagcattttataaattgtattttaaatacatgttttaaacttg

SEQ ID NO: 233657 - DNA, 3437 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233658 - DNA, 3922 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttgaaaaaaaaaaaaaaaaaaaaaaaaaaaaaaaaagggggggccccaaaatttcccccggggggccccattgcccccaggtttttttgttgtacaagggggcgcccaataatggggaacggcctcggattatatataaacgcaaaggcgaagcggggccggcttgtattaaaaaccggcttgtaagacgaggaacaaacggcggtacgactgggggcacctttgtggagaaaggcaaccccttaactttggtggagggtgggaccatatatgtgggcaacaaacattaatcacataccagaagattttataagagccctccagggggaacattatttaaaacttttgaacggtgtatatctatgtggtggttaaaacccaaccgcggcaaaatagtgactgtgccaggcttgaaaaggaattgtgcggcagtacggattttgtaatttcgtgaaaaatttttattccaggggagcttgtagtaaata

SEQ ID NO: 233659 - DNA, 3467 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttgaaaaaaatacaaaaactgaaaaaaaaaaaa

SEQ ID NO: 233660 - DNA, 3505 bp, Homo sapiens
cgcagcgcggggagggggtgggggaggagggaaagcggcgagtaagatggaagatgaggaggtcgctgagagctgggaagaggcggcagacagcggggaaatagacagacggttggaaaaaaaactgaagatcacacaaaaagagagggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233661 - DNA, 3713 bp, Homo sapiens
ggcttgcgcggaccaaggaggcatgtccggcttcgcaggaaagcgggaggaggcagccgagggcggggggaaattgaatcctctttgggctactcaactctgctaaaatcccccaccatccgtcacggtggacgagtcgggttttttttctctttcacttttactccaagaagagtttgtgggcaggcaggcaggtctcacggggactctgccaaagcaaccgaaagctctgcggggcagctcctctgccactcagcgatccgaggccccgggaaggtctaggagttcgcttgtcggagtccagggaaatagacagacggttggaaaaaaaactgaagatcacacaaaaagagagggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233662 - DNA, 3638 bp, Homo sapiens
gggatagaagtgccagaatgaggtggcgttccagcccctgtggccaggggttagggctgaggagcagttcctgtggcctgtcagagctggtcgcaagcttacttttttgggacacccttcttgaggagtggaaattttgctgtctggtcagaggccagagaatcatgcatgggtagaattagggagggagaggaaagtgatgagaggtgggtgtgggacatggacagggcctccttagtcaggagcatgatttgtgaagctgtgtttgctctttgtcagcggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233663 - DNA, 2892 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233664 - DNA, 2581 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtggtgacaggcacacagcgggcaaagcccatctttggccagagggaggtgggaggaccagtccctgccacatcctcaatccacagacaccca

SEQ ID NO: 233665 - DNA, 2959 bp, Homo sapiens
gggtacccggatcccccccagacgtccgtatgatcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233666 - DNA, 3427 bp, Homo sapiens
cgcagcgcggggagggggtgggggaggagggaaagcggcgagtaagatggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatgggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233667 - DNA, 2706 bp, Homo sapiens
  misc_feature (27)..(27): n is a, c, g, or t
ggttaagcggatatcgtcgacccacgncgtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233668 - DNA, 2683 bp, Homo sapiens
aaaggctaggtacgaggcctgggtgtgggtggaagatgaggaggtcgctgagagctgggaagaggcggcagacagcgggacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233669 - DNA, 2450 bp, Homo sapiens
tgcggttcacaccatcggctaggtagcgaggccggttgtgaatctgttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233670 - DNA, 2080 bp, Homo sapiens
tttatttccattcagggcctggcgttttcatttataattacatggccccgtcggtccgtatcaatttccattggccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233671 - DNA, 2078 bp, Homo sapiens
tcatttcattcacgagggagctggcgtttgcttataattacatggccgcagttcggcacgtcaattagacagccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233672 - DNA, 1405 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccggccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233673 - DNA, 1157 bp, Homo sapiens
cgagtgggtgaaatctgactaggaaaaggatatttacatagtctcaaactggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233674 - DNA, 732 bp, Homo sapiens
tcgtcagaggatcccccaggggtgtgggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233675 - DNA, 896 bp, Homo sapiens
  misc_feature (719)..(719): n is a, c, g, or t
  misc_feature (803)..(803): n is a, c, g, or t
  misc_feature (827)..(827): n is a, c, g, or t
cgcagcgcggggagggggtgggggaggagggaaagcggcgagtaagatggaagatgaggaggtcgctgagagctgggaagaggcggcagacagcggggaaatagacagacggttggaaaaaaaactgaagatcacacaaaaagagagggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcaaaaaanaactgaagatcacacaaaaagagagcaggaaatccaaatctcctcccaaggtgcccattgtgattcaggacgatagccttcccngggccccctccacagatccgcatnctcaagaggccaccagcaacggtgtggtcagcagccccaactccaccatacgcctgtgattgccctatt

SEQ ID NO: 233676 - DNA, 501 bp, Homo sapiens
cgcagcgcggggagggggtgggggaggagggaaagcggcgagtaagatggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233677 - DNA, 1009 bp, Homo sapiens
aaaggctaggtacgaggcctgggtgtgggtggaagatgaggaggtcgctgagagctgggaagaggcggcagacagcgggggctggtgtgagcagaaaatgaatgtctggggaagaatgttgacagccataatacattatatcgatataaggtattattttaaaagctattagtattatattacatgccaagtatgttaatcatgttctagtttggggacagaggcgcatttactcagacatggcctacgatgtcctcttgaagcgcttttcttccacccaggctccttgtgctggaactgggcagatggtccatcttccttaaaccctagaggaagaaggaagcagtttgctttcctcagaggagacctggatgggacttctcaaattcactctaatgtgtgaggcccatttctctctctgtcttatttggctctcgcagcgatatgaaagtgaaagttcacatagtgaagttggaaaattcagtgcattgccataaaaatactgatttggtttcttctgcgctagatctggccctgtctgccaaagcttgttggccgtcattaggcagggcaagtgctctttggtgccctgcagccccttcacttccccaggtatgctccgtgcgagtggagtttggctgcttgcctggtctatgaaggcatttggtctcaaccctcaaaggcttctaaattctacagctgtcaaggctctgtttatgatggagaaactcgaataggcagtcttgtatttagagtggagcgaaatgatacagtatgaaactttaaaacaagaagttacttgtgagaagcccttaaaaggtaataggcaatagactaatatgagctgtagtacttactcaggtaataacactggtattaatagaattaatacaattccatcaatacagtcattttcaggacagagtacgtagtggacatagattctgtgtgagtgtctgtgtttgtcagttcacagaaaacatccaggtcgttctcttattattggtgt

SEQ ID NO: 233678 - DNA, 505 bp, Homo sapiens
gaggaggcagccgagggcggggggaaattgaatcctctttgggctactcaactctgctaaaatcccccaccatccgtcacggtggacgagtcgggttttttttctctttcacttttactccaagaagagtttgtgggcaggcaggcaggtctcacggggactctgccaaagcaaccgaaagctctgcggggcagctcctctgccactcagcgatccgaggccccgggaaggtctaggagttcgcttgtcggagtccagggtgtgatatgtaaaacagccacattcttgggagaggagtggggagatggaccgttcgacttgtttttggagtttttgtttgcctccagaaactgtaggaaaatagtttatctcaaagaggatctgtcaattctcttagatttgtgaataatttggtcttttcagagtttgtctgtggtgacccttgtgaatatggggagatgctttttttgtctccccgtgttcgcgtctgttcaatgctggctgc

SEQ ID NO: 233679 - DNA, 3455 bp, Homo sapiens
cgcagcgcggggagggggtgggggaggagggaaagcggcgagtaagatggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233680 - DNA, 3440 bp, Homo sapiens
aactgactaggtacgaggcctgggtgtgtgagtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233681 - DNA, 2978 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgacgatctaccagtgcagggatcctctagatgcgcgt

SEQ ID NO: 233682 - DNA, 3558 bp, Homo sapiens
aaaggctaggtacgaggcctgggtgtgggtggaagatgaggaggtcgctgagagctgggaagaggcggcagacagcgggggctggtgtgagcagaaaatgaatgtctggggaagaatgttgacagccataatacattatatcgatataaggaaatagacagacggttggaaaaaaaactgaagatcacacaaaaagagagggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233683 - DNA, 2685 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagctggccaaagatgggctttgcccgctgtgtgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233684 - DNA, 3192 bp, Homo sapiens
cgcagcgcggggagggggtgggggaggagggaaagcggcgagtaagatggaagatgaggaggtcgctgagagctgggaagaggcggcagacagcggggaaatagacagacggttggaaaaaaaactgaagatcacacaaaaagagagggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacagcatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233685 - DNA, 2150 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacaaaaaaaaaaaaaaaaaaaaaaaaaaaaaaaaaagggggggccccaaaatttcccccggggggccccattgcccccaggtttttttgttgtacaagggggcgcccaataatggggaacggcctcggattatatataaacgcaaaggcgaagcggggccggcttgtattaaaaaccggcttgtaagacgaggaacaaacggcggtacgactgggggcacctttgtggagaaaggcaaccccttaactttggtggagggtgggaccatatatgtgggcaacaaacattaatcacataccagaagattttataagagccctccagggggaacattatttaaaacttttgaacggtgtatatctatgtggtggttaaaacccaaccgcggcaaaatagtgactgtgccaggcttgaaaaggaattgtgcggcagtacggattttgtaatttcgtgaaaaatttttattccaggggagcttgtagtaaata

SEQ ID NO: 233686 - DNA, 637 bp, Homo sapiens
aaaggctaggtacgaggcctgggtgtgggtggaagatgaggaggtcgctgagagctgggaagaggcggcagacagcgggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 233687 - DNA, 5737 bp, Homo sapiens
  misc_feature (573)..(573): n is a, c, g, or t
  misc_feature (600)..(600): n is a, c, g, or t
  misc_feature (2369)..(2369): n is a, c, g, or t
  misc_feature (2495)..(2495): n is a, c, g, or t
tctaaaaatgcttcctgaggtttcctaatttctaaatctggaagccacttctgaccagctacttttaagtatctcagactgctggggacaatagaaacttagccactctaacatggtagatggaggcgtgaactgtaataaccctaagatgggtatacagaatttttctcccctagtagcagtcacattgcaaaaagattatattgctattgaattttaaggtgtagattaaatgtctgtaatatgtgcataatcttccattcctgggatcttagtcttgacattttctttttaagcatagaacacccctcctttacaaagaaggtaatctgtggaaggaaagacatgctaatatgatggttttaattataattccctcagaacggaatatatccattaagtacatggcatatatatggctatagaaactgctacatgtatttaatttattgccttaatttttttttatctctctcaggatagaccatttagaaactatccagcaactcctaactgcagtagtaaagaagattccattaatcactgcaaaaagtaagacaattacactgaatntaggggtgcatttttgaaagctgtgancttaaggtattgagtcaactgaaatcacttgggattgtaaattaatattgatatggcggttaccttataaggtttcagctagagatacagcccatttgcaagggttttagaattcacatccagttagttttttattgttttcactgtgttgatctgtagaaggaatgttttacatttttcatatgtaaatcatagattgttttgtatgcagttaaaactctgtattagcatttggtgtttatgagtgaggaaagcatttagcgtttgcctgcagtgtaccaggtcctgtgcaggttgggtacgttcactgtctcatataatcccagcctcctgtgtgatagctggtgtcatctccacttacagatgaggaaactgaggataagcagggttgaataacttgctcgagatcacagagccacgggtggtgaaacaggatacaaacctggttctgtttgactctaagaccattcatctttcctctgaaactcagtattgcacagtgtagaaatgcagtttttaagacctcccaaagtgacgtgctgcgtcactgcccatcattagctagattgagtaaattgctgcttagccccagttgttttgacagaatcaatagcccttgctgaggggccagcagcctacggacacaggagcatgctcatgggcaagaccaccatgcacactcagaggggagccacaaggcaacctccacgccactcagatttgtagggctctgaacacatacaccaggtacagaccacctacttattttttccaactgtaatagcaaagcagtaatctctttctgtagggtaaagtttgggggatcattttgatgtctctcagagtaaacttttggtgacagtttcccagcctaacataagaaattcaaacaaaaaaatctctcttatatatgtgtgtgtgtgtgtgtgtgtgtatacatgtatatatatatacacgtgtatatacacacacacatatttttctctctccttaaaaatacagaatgtaagagctggaaggtagttcagaaaccatcttcccagctttctcagtttatagatgagaaaaccgagctgggcttggtggctcacgcctgtaatcccagcactttgggaggttgaggcaggcagatcacctgaggtcaggactttgagacctgcctggtcaacatggtgaaaccccatctctactaaaaatacaaaaattagccaggcatggtggtgcctgcctgtagtcccagctcctcgggaggctgaggcaggagaatcgcttgaacctgggaggcagaggttgcagtgagctgagatcacatcaccgcactccagcctgggtgacaaagtgagacaccatctaccacaaccaccttgtgagttaatggcgggtccagggctcctagtggagcaccagttccacagactttaatagtctatggcagtgattaccttctctaccaaagaagcaaagtgcccaggaaggtgtgttgctttgagtacacacggcaagacaccttctcttctgaggagacgccctcctgtgttaggctgcatctgagcttgcccagtaaggaacatacatgcgataaagaggtctgaagaagtgactggcttgcctccagcaaatgacgtgtggttggaatcgtaagagctttattcaggctttgctgggtgtgtgcattctaggtgaagatgccagctgcttttctgcaaagtctgtggagcagtactatggctggaacattggaaaaaggagagccgctgaggtaacccacntctgcctgtccactctggctgcctccagaaaccttgtcttatggaacagggataagattgcagcatatttggttgaaatatttgatggcagaatattttcctcagttaaaaaaaatctcatttttnaaagacctgtatccagctgactttcaggcgtgccttcttttcctgcactggcagaaacatccctcacagtttctaaatttttttctgagtttcagagttttaaatgaactcgagtattgagtccttacagtgggaaggtgctgtggtgagtttagggaaagctggggtaggaggggagtgggagagcgcaggtggagaccaggtgaagatccttacagtgggaaggtgctgtggtgagtttagggaaagctggggtaggaggggagtgggagagcgcaggtggagaccaggtgaagatccttaaaggccaaacctaggagttgctgttttattgtattagcattagggaagttcgacttttttttttaatggggagtaacacaaccaggtttttttctttaaaaaaaaaaattctaacaggttaggttaggatggtgatttatggttgcatgatacgtagttgtgttaagtggaaggatttgattatggttccaaaagaaaattttttttttaagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233688 - DNA, 642 bp, Homo sapiens
ctctagaggacccgtgtgtcgagataagcaaggtaacattcttactgcgttattacacttgctagcttctttttcttttcatttttaaaaaataatttttcaaatggagatggggtctccccgtattaaccaggctgtatcgaactcctggcctcaagagatctgccacctcacctgccagggtactgcggttacaggcatgagctgcaccccgccactttgccggtttctgaacatagtatgttcagcctcagcaagaatgtgtcagttgatgacgcaaatttcataaaatggaatcttcaagctgttaagtatctagactttactacccccagactttactaacttacttggatctactccagactttactaccttacttggatcttttcatagtgtcacagatgcttcacaacacttgtgtgaaatagtcacccagtatcaatttaaaaacttactgtgataagattatttatttacttatttgaaaagtttgttaaaaatacttgcttataaaaatattcatctgacctcttcccttttggacacctctctctctcgcaacagagagctgctgtcctctcccctttcttttgcttattaaactttctgctccttaacccataaaaaaaataaaaattt

SEQ ID NO: 233689 - DNA, 344 bp, Homo sapiens
gacagagtctcactctgtcacccaggctggagtgcagtggcatgatcttggctcactgcaacctccacatcctaggttcaggggattctcctacctcagcctccagagtagctgggactacaggtgtgtgccaccatgcccagctaatttttgtatttttagtagagattggatttcaccatgttggccaggctggtctcgaactcctgaccacaaatgctcctcctgccttggcctcccaaagtgctgggattacaggcatgagccaccacgcccggccaaacttttttctttatacttctgaatttcccaaattttctattaaagtaaattataaaaagtag

SEQ ID NO: 233690 - DNA, 4065 bp, Homo sapiens
ggaggatcacttgagcccaggaagtggaggttgcagtgaactgagatggcaccactgcactccaggctggatgacaaagtgagacactgtttccaaaaaagaagaaggaaggaggaggaagaaggagaagaaagaaagaaggagaatgaggagggggaaggagaaggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233691 - DNA, 6285 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233692 - DNA, 6694 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgttatttgtggtgggtgtttctgagtttgaagcatggtactcaggcagggttctccctgcactgggatgaggtgatggtgtagagtcttattgatatgtttaaattaattcctctgcttcttgccaaaaaaaaaaaatgttgcaaccgtataagataaaggattacagttacataaaagtctaaaaaaaatt

SEQ ID NO: 233693 - DNA, 6525 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgtaaaaaaaaatttgtaaaaaaa

SEQ ID NO: 233694 - DNA, 5964 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgaacgtccgtgactcgagattccagattatcaaggatactcaagaacagctatgccaata

SEQ ID NO: 233695 - DNA, 1218 bp, Homo sapiens
cggcgtggtggtgattcaggcagagggtggggatggctggtgccggttaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233696 - DNA, 6067 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgttatttgtggtgggtgtttctgagtttgaagcatggtactcaggcagggttctccctgcactgggatgaggtgatggtgtagagtcttattgatatgtttaaattaattcctctgcttcttgccaaaaaaaaaaaatgttgcaaccgtataagataaaggattacagttacataaaagtctaaaaaaaatt

SEQ ID NO: 233697 - DNA, 3930 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtatagctgtttcctgggtaccgagctgattgtatcatgta

SEQ ID NO: 233698 - DNA, 3661 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccgattgataccagccagcatacggctggcactggtctaccggaaaaactgaatatcaccgagatacacacacacactcacgcatgcagacaacaccccttactgcctttggataagaggctgtggatgttgttgttgtcattactattattacttcattcatatgtagctccacaccaggccccttgtgtcttgtttggatagagaacaaaaaattaaggctgattatatttttctcttgatttctacctccctgttaaaattgaccaacttctagtatagggagtacttgttctctactaactgttttatttgaggccctgtgttggatactggagtagaaattatagaaataaaaggagatcggccaga

SEQ ID NO: 233699 - DNA, 487 bp, Homo sapiens
tttgagacagagtctctctgttgcccaggctggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233700 - DNA, 2461 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaaggtaacattcttactgcgttattacacttgctagcttctttttcttttcatttttaaaaaataatttttcaaatggagatggggtctccccgtattaaccaggctgtatcgaactcctggcctcaagagatctgccacctcacctgccagggtactgcggttacaggcatgagctgcaccccgccactttgccggtttctgaacatagtatgttcagcctcagcaagaatgtgtcagttgatgacgcaaatttcataaaatggaatcttcaagctgttaagtatctagactttactacccccagactttactaacttacttggatctactccagactttactaccttacttggatcttttcatagtgtcacagatgcttcacaacacttgtgtgaaatagtcacccagtatcaatttaaaaacttactgtgataagattatttatttacttatttgaaaagtttgttaaaaatacttgcttataaaaatattcatctgacctcttcccttttggacacctctctctctcgcaacagagagctgctgtcctctcccctttcttttgcttattaaactttctgctccttaacccataaaaaaaataaaaattt

SEQ ID NO: 233701 - DNA, 2734 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggtttgtgttgggtagagatgggaaatttcacatgtaaatgatgttgtttgcctaaataattgacaagtgctgaaaagattcacggtgacagggttgatgatcccataagaacctgtgggtgaaagcctagttggaaaaacaagtctgttggtgtgaaactcttctactcctgtagtaatcattggcaagagccgcgttatgtattgcaaaggatcccggaatgggccaagaggcaggggaacactgctgtctctggcagtggaggcagagctgactcatgggcacagctttctacttgattcatctctaaaagggatccgctgttgacttgtttatttatggtaggagaatgctgtagtttatacctctgatgttcgggctgttacctgtttaatgattcttagctttctgtagagttcttttttttttttaataatttggaggtacaggagaattaatgtattgagagaattttaaaatagcacatagaggccgggcatggtggctcacgcctgtgatcccagcactttaggaggctgaggcgggcggattacctgaaggcaggagttcgagaccagcctgaccaacatgg

SEQ ID NO: 233702 - DNA, 353 bp, Homo sapiens
cttacatagcagtgtgggtggccctttaagaaatatctaaggagccactttattgcagccgccctgtcatgaggctggagttgtcctgagacccaggctaacagttcttcccttgtctgatgaccctgggatgataggagccatctcagtcccctggctgtgtccccacaacagctggagtggcagtttccttactgagcttcactgtaagagctttgtttgtgcctgcacgtgtccttccaccactgacccctaacagctgcctctttgttgctcttcccttgtagtgaagactgaaccagaaacacctggaccgagttgcctctctcaggagggtcagacagcagtgaaaa

SEQ ID NO: 233703 - DNA, 377 bp, Homo sapiens
ggtaacaccctttgttttttggaccaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcgg

SEQ ID NO: 233704 - DNA, 661 bp, Homo sapiens
tatacttctgaatttcccaaattttctattaaagtaaattataaaaagtagctgaggcaagacaacaattgttaagcttctattattgtaatacccaagtgtaagaaatacagttgccgttcacacctgtgtaggtagctttcctagatgactgaattaggctgcatgtattatgtgcaggcctttgttttgctctctgccaaaacggtgactgctgttctaagagctctcgaagcaccgttggactctgctctgttttgaacaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcaggtaaaacggatcatcactgggagccctttcagcagaagctctgtccaaaatttcctttgctagtgattttatttgctatttgatctggtctaggaaagcctagttaggttgatgctgtaagaagtgtattgaaatgt

SEQ ID NO: 233705 - DNA, 364 bp, Homo sapiens
aaaactagtaatgttgcaggtgaaatgaattgtttcacgataaaaaaacagaccactgggccgggcgccgtggctcacgcctgtaatcccagcactttgggaggccgaggcgggtggatcacgaggtcaggagttcaagaccatcttggctaacacactgaaaccccatctctactaaaaaaacaaaaaaattagctgggcgtggtggccgcacgcctgtggtcccagctacttgggaggctgaggcaggagaactgcttgaaccagggaggcggagcttgcagtgagccgagattgcaccagtgcactccagcctgggcaacagagcaagactccgtctcaaaaaaaaaaaaccacacacaca

SEQ ID NO: 233706 - DNA, 6504 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233707 - DNA, 1448 bp, Homo sapiens
gtatagtaaccactgaactagagaagtaatcttttttaaatggtatggcatttactaagtagtcattaacacctaatagatgatatttagtgtgtgtgctgtgtggccgtcaccgccgtcagtcatcactctgctttcttcctgaactgtgttgtttcggaccccatgggtgagcagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggtgagttgcattgtgatattatttctctctcttttctctcattgggctggaatatttttgtttgtttgtttgagatagcgtctcactctgtcgcccaagctagagtgcaatatcacaatctcgactcactgcaacctctgccttccaggctcaagccatcctcccacctcagcctcttgattatcagggaccacaggcacatgtcaccacacccagctaattttttgtgtttttggtagagatggggtttcaccacgttgcccaggctggtgttgaactcctcaggtcaagcagtccacccacctcagcctcccaaagtgctgggattacaggcgtgagccactgtgcccagctatttttttggagggtcttaagcaatattttgtatggtaaattgttaaaagtaattaacccagcagcattttctgaacagttgctttttagatgaattatttttgtttaaaatctacgtatcagattttgtctgagactttaaattatcatttgaaagttactatttgaatttttgaatgatataataaacccttagccacgcagaaccctactgggtattttagctttttttataacgtaattttggggagagccaagagtttgctttccttaaagtactaatttcttttttcctataatcagtgtcgaatagaattcactataaaatgtatacctttctttgcttttataaagtatataaaatatatcttagccttgttgactccaagtcataatttttaacattagttattatcttggctagtgttagagtgataggctggagatccagtaagagctatggtgtctttgtgcctgcactagagggcctcagaaaagtgtaccttttgtttctgagtaacagagagcacacatcctgagaccacattgccttagttgaagtgatttgcttcagtttctcagctgtaaatgagattgataataatacctacttcataaggttgagaggtttaaatgagtttgtaatatatcagtgcttagaatactgtctggtgtgtagtggccattatataaacaattgccactgccattatcatgtgtgatcatttttgtt

SEQ ID NO: 233708 - DNA, 4783 bp, Homo sapiens
atccccccctacaccttcctgtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtgagcggagtgaggtgccctggagaagcaggctttgaaggcacagcgaagctgtaactgaggaccctgctgctcgggaaggaggtggtttccagtgtgactcggcatgtcatggctacccaacctttgccgctgcctgttcccacgtgtcaccagcacgctgcactccagatgaaatcctcctaggacaggagtttgtttcctgagtgtggagtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233709 - DNA, 1876 bp, Homo sapiens
  misc_feature (44)..(44): n is a, c, g, or t
tcgggcgcgacaggcttctgtctaggtagcgaggcctgggtggnggtgaggctgtcagtggatccgtgctttgtcggccagcgtttctgcagtctttgtaaaggccccacgagagcgggccaggccgtgtgcctcaggcccttctccctgggtgtgcttaagggggctccttgggcccgcctccccaggaggtagaaaatgagtggcaggctagagatttcacccattttgtgggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233710 - DNA, 1179 bp, Homo sapiens
ttctcaccctaacaggtcaacctcgcttccccacccttactaacattaacgaaaataaccccaccctactaaaccccattaaacgcctggcagaagcaggaagcagggtttggtgagggcagaagcaggagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233711 - DNA, 2196 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacaccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagtccagccctggtgacagaggagaccccgtctcaaaaattgattgatcaattcagcatctgagggctgcaagtacagaaggaatctattctcagcagggcatagggcacgcactggcttaacagtttagtatataaggctcaaatagtctatacctgaactgctataagcaaggtcgatagggaagtggatagattgcttcagcaaagtgaactgtgagatctccaggacagagggagaaagatctgatccaaatgagaacagattggttattgcaggtatcacagcctaaagaaattatctttttgcaaaagaaatattaaatgatttagcagtctccacgtgtgttaatgtttcaaacgtgtatcataatgtgtataattgtgtaacaaaattgtctacaataaatcttttggtatttgt

SEQ ID NO: 233712 - DNA, 5613 bp, Homo sapiens
  misc_feature (3718)..(3718): n is a, c, g, or t
  misc_feature (3745)..(3745): n is a, c, g, or t
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtaagacaattacactgaatntaggggtgcatttttgaaagctgtgancttaaggtattgagtcaactgaaatcacttgggattgtaaattaatattgatatggcggttaccttataaggtttcagctagagatacagcccatttgcaagggttttagaattcacatccagttagttttttattgttttcactgtgttgatctgtagaaggaatgttttacatttttcatatgtaaatcatagattgttttgtatgcagttaaaactctgtattagcatttggtgtttatgagtgaggaaagcatttagcgtttgcctgcagtgtaccaggtcctgtgcaggttgggtacgttcactgtctcatataatcccagcctcctgtgtgatagctggtgtcatctccacttacagatgaggaaactgaggataagcagggttgaataacttgctcgagatcacagagccacgggtggtgaaacaggatacaaacctggttctgtttgactctaagaccattcatctttcctctgaaactcagtattgcacagtgtagaaatgcagtttttaagacctcccaaagtgacgtgctgcgtcactgcccatcattagctagattgagtaaattgctgcttagccccagttgttttgacagaatcaatagcccttgctgaggggccagcagcctacggacacaggagcatgctcatgggcaagaccaccatgcacactcagaggggagccacaaggcaacctccacgccactcagatttgtagggctctgaacacatacaccaggtacagaccacctacttattttttccaactgtaatagcaaagcagtaatctctttctgtagggtaaagtttgggggatcattttgatgtctctcagagtaaacttttggtgacagtttcccagcctaacataagaaattcaaacaaaaaaatctctcttatatatgtgtgtgtgtgtgtgtgtgtgtatacatgtatatatatatacacgtgtatatacacacacacatatttttctctctccttaaaaatacagaatgtaagagctggaaggtagttcagaaaccatcttcccagctttctcagtttatagatgagaaaaccgagctgggcttggtggctcacgcctgtaatcccagcactttgggaggttgaggcaggcagatcacctgaggtcaggactttgagacctgcctggtcaacatggtgaaaccccatctctactaaaaatacaaaaattagccaggcatggtggtgcctgcctgtagtcccagctcctcgggaggctgaggcaggagaatcgcttgaacctgggaggcagaggttgcagtgagctgagatcacatcaccgcactccagcctgggtgacaaagtgagacaccatctaccacaaccaccttgtgagttaatggcgggtccagggctcctagtggagcaccagttccacagactttaatagtctatggcagtgattaccttctctaccaaagaagcaaagtgcccaggaaggtgtgttgctttgagtacacacggcaagacaccttctcttgctgaggcaggagaactgcttgaaccagggaggcggagcttgcagtgagccgagattgcaccagtgcactccagcctgggcaacagagcaagactccgtctcaaaaaaaaaaaaccacacacacaaaaaaaacagaccactgctgcagggccatggggtgtaggagcaagggattaaaggtatataggcagaagaagcattttgagtttcacctcaaagaataagaagggttgggccgggcgtagtggctcatgcctgtaatcccagcactttgggagtcaaggcaggaggatcacttgagcccctaggagtttgagaccagccagggcaacatagcaggaccttgtcactac

SEQ ID NO: 233713 - DNA, 4379 bp, Homo sapiens
gcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaaggtgaagaactgaatgtcatcatgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggtgagttgcattgtgatattatttctctctcttttctctcattgggctggaatatttttgtttgtttgtttgagatagcgtctcactctgtcgcccaagctagagtgcaatatcacaatctcgactcactgcaacctctgccttccaggctcaagccatcctcccacctcagcctcttgattatcagggaccacaggcacatgtcaccacacccagctaattttttgtgtttttggtagagatggggtttcaccacgttgcccaggctggtgttgaactcctcaggtcaagcagtccacccacctcagcctcccaaagtgctgggattacaggcgtgagccactgtgcccagctatttttttggagggtcttaagcaatattttgtatggtaaattgttaaaagtaattaacccagcagcattttctgaacagttgctttttagatgaattatttttgtttaaaatctacgtatcagattttgtctgagactttaaattatcatttgaaagttactatttgaatttttgaatgatataataaacccttagccacgcagaaccctactgggtattttagctttttttataacgtaattttggggagagccaagagtttgctttccttaaagtactaatttcttttttcctataatcagtgtcgaatagaattcactataaaatgtatacctttctttgcttttataaagtatataaaatatatcttagccttgttgactccaagtcataatttttaacattagttattatcttggctagtgttagagtgataggctggagatccagtaagagctatggtgtctttgtgcctgcactagagggcctcagaaaagtgtaccttttgtttctgagtaacagagagcacacatcctgagaccacattgccttagttgaagtgatttgcttcagtttctcagctgtaaatgagattgataataatacctacttcataaggttgagaggtttaaatgagtttgtaatatatcagtgcttagaatactgtctggtgtgtagtggccattatataaacaattgccactgccattatcatgtgtgatcatttttgtt

SEQ ID NO: 233714 - DNA, 502 bp, Homo sapiens
cttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaa

SEQ ID NO: 233715 - DNA, 293 bp, Homo sapiens
acacacagacctcaacagagccaagcgggcgatgccatccccacaccccaccttggagtggctcctgctcccatccccacggaccttctgggatttgccagcagcagggagccccaggtgagcagcgccacacacagatttgctgaacgctctggccaccagggcctttctcgtgcaactcatctggcttgccaggacgtgcagagcttccaaaacgattccgtagactgttggggcctcttcagtgcccaggatcaagtcaggcccagtttggaagtggcagccaggcaggc

SEQ ID NO: 233716 - DNA, 355 bp, Homo sapiens
tataaatggggttttgctatgttgcccaggctggtttcaaactcctgggctcaagcaatccacccatttcagcttccgaaagtgctgggattacagacatgagccaccacgctcagcctggtaaaatattttaccaggactgtatcattgaatatgttgctgctcttattcttagttgctgctcttagtcaacccaaatagatagctagagaagttttctgccatagtatgatttccccccacacttaaggtctgttatcaccatcactctacctttttccctcttcccctaaacttgctcatgtaaaactattttggagggtgataatgtttgtcatttcactagtagaattgg

SEQ ID NO: 233717 - DNA, 382 bp, Homo sapiens
tctcccacccaatctgcacctcacaggcagaatgcaggaagtcctcactgtcaaatgcactttggtccgcctcatcccaagtccctccagccttcctgcttctgttttcttcctggatgttcaggtgtgtccctcagatcctccagagggcttgatggcttctgtccatgtgacccttcctacctctgcctacccagttcactcaagatctgaagaccaacgaggcctcagaaggggccacagccacattgcagtgtgaactaagcaaggtgtcgctgtggagtggaagaagggacctgagaccctcagagatggggactgtgttctctgttcctgggccgtgtgctttctcaccatctgtatattcatttgcttattctgc

SEQ ID NO: 233718 - DNA, 325 bp, Homo sapiens
cagtaaatttatgactgagctaaagtgactaggaacccatcatttttaattacccatgatttttccaatggacaagcactattaacatgggactgtatttccttttcatatttcttccttcagtaattattttaataagagtttcagatttcactttctcctcttagcaataaaatattttgtcatcccataattttcaaaaatttcactaataattgtataatatcctatcatacagaggttccactacttattttctaaaatgctcatatcctatactatcaatttctatctttataaaacaataaaagtactctgcaatgga

SEQ ID NO: 233719 - DNA, 372 bp, Homo sapiens
tagtctccatcactctatcttcttcctctctctgacctgcacttgctggcccgttggtcatcttctctccctgtccccactacctaggtgaccttatatcagatttaaaaaccacctcaaatttcaatctccatgcctgtcccctcctccatgctccagattctcacacccaactgtctgctcggctcccacactgagctgtacaatgtgcaccgcaaacttcctctgtctgaaacagaacacaatgtcccgtgctcttcccccgttgtcatctttcccatgtcgggagatggcaccactattcactctggggctcaagtcaaaatcctcaattcttctctcacacacccacctccaattcagtggcggccg

SEQ ID NO: 233720 - DNA, 459 bp, Homo sapiens
  misc_feature (92)..(92): n is a, c, g, or t
gcggaggcccggacgcccccctggggaccctgtgcggcccgcgaggtccgggcccggccacccccgcggcccccggcggtccccgcctgccncaggacgcgctcgctgcggggccccgccgctgccgcctcctgcgcgtccccgacgggctgctgagtcgcgcgctgcgggctggaaggagtcgccgcctggcccgcgtccgctccgtctccagcgggaacgaggacgaggagcgccgcgcgggatccgagtccccggcccgggccccctcctcgagcccgctgtcatccagggccccgcttcctgagcgcctggaggcaagggccgtggctctgggccgcgcgggacgcctggcctggctgctgagtactgtccgggaacccgcgtctccgcctccggctgctccgcgcggagagcctgttcggaggcgcccccgggcccgcgccgtccgctgccgcc

SEQ ID NO: 233721 - DNA, 451 bp, Homo sapiens
cggttcaagacaaatttctactttgagctctctctctgatttcttgctccattacttattccatttctctcttatatttccagtctgtttattcctcgctccttacctttttttcctgtattttttggatctcctaaaaatctctcctgtcttataagagaaattaaagccttttcttggcactgaatactcctctagctactgtcttctcttgcacatgcagcccggcttcttgaagaaatggttcggttgctctcctaggcacgcagctcttcctctctccagctcttcctggtgggttttgtccctactctactataactgttgtcacctgggtcaacaatgaatttccaaagcttttctttccttatataacttcaactttctgttcatatttaatacttacttttgaattacaccagtaatacataaaagcaagttccctaaaaaa

SEQ ID NO: 233722 - DNA, 2069 bp, Homo sapiens
  misc_feature (16)..(16): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (138)..(138): n is a, c, g, or t
  misc_feature (174)..(174): n is a, c, g, or t
  misc_feature (189)..(189): n is a, c, g, or t
  misc_feature (235)..(236): n is a, c, g, or t
  misc_feature (239)..(239): n is a, c, g, or t
  misc_feature (293)..(293): n is a, c, g, or t
  misc_feature (328)..(328): n is a, c, g, or t
  misc_feature (367)..(367): n is a, c, g, or t
  misc_feature (375)..(375): n is a, c, g, or t
  misc_feature (409)..(409): n is a, c, g, or t
  misc_feature (513)..(513): n is a, c, g, or t
  misc_feature (531)..(531): n is a, c, g, or t
  misc_feature (546)..(546): n is a, c, g, or t
  misc_feature (549)..(549): n is a, c, g, or t
  misc_feature (559)..(559): n is a, c, g, or t
  misc_feature (623)..(623): n is a, c, g, or t
  misc_feature (635)..(635): n is a, c, g, or t
  misc_feature (656)..(656): n is a, c, g, or t
  misc_feature (686)..(686): n is a, c, g, or t
  misc_feature (739)..(739): n is a, c, g, or t
  misc_feature (824)..(824): n is a, c, g, or t
  misc_feature (830)..(830): n is a, c, g, or t
  misc_feature (879)..(880): n is a, c, g, or t
  misc_feature (887)..(887): n is a, c, g, or t
  misc_feature (911)..(911): n is a, c, g, or t
  misc_feature (967)..(967): n is a, c, g, or t
  misc_feature (974)..(974): n is a, c, g, or t
  misc_feature (1046)..(1047): n is a, c, g, or t
  misc_feature (1129)..(1129): n is a, c, g, or t
  misc_feature (1145)..(1145): n is a, c, g, or t
  misc_feature (1185)..(1185): n is a, c, g, or t
  misc_feature (1189)..(1189): n is a, c, g, or t
  misc_feature (1194)..(1194): n is a, c, g, or t
  misc_feature (1202)..(1202): n is a, c, g, or t
  misc_feature (1247)..(1247): n is a, c, g, or t
  misc_feature (1388)..(1388): n is a, c, g, or t
  misc_feature (1402)..(1402): n is a, c, g, or t
  misc_feature (1405)..(1405): n is a, c, g, or t
  misc_feature (1440)..(1440): n is a, c, g, or t
  misc_feature (1446)..(1446): n is a, c, g, or t
  misc_feature (1457)..(1457): n is a, c, g, or t
  misc_feature (1473)..(1473): n is a, c, g, or t
  misc_feature (1490)..(1490): n is a, c, g, or t
  misc_feature (1492)..(1492): n is a, c, g, or t
  misc_feature (1496)..(1496): n is a, c, g, or t
  misc_feature (1549)..(1549): n is a, c, g, or t
  misc_feature (1594)..(1594): n is a, c, g, or t
  misc_feature (1634)..(1634): n is a, c, g, or t
  misc_feature (1753)..(1753): n is a, c, g, or t
  misc_feature (1792)..(1792): n is a, c, g, or t
  misc_feature (1824)..(1824): n is a, c, g, or t
  misc_feature (1856)..(1856): n is a, c, g, or t
  misc_feature (1870)..(1871): n is a, c, g, or t
  misc_feature (1888)..(1888): n is a, c, g, or t
  misc_feature (1890)..(1890): n is a, c, g, or t
  misc_feature (2009)..(2009): n is a, c, g, or t
  misc_feature (2033)..(2033): n is a, c, g, or t
  misc_feature (2037)..(2037): n is a, c, g, or t
  misc_feature (2067)..(2067): n is a, c, g, or t
actctgcctttggacntgtgagagagcgcacctttcacttgagcttcaacatgggaaagggaaatgaagaccccgatctcnantgntcctccatccagtgctccactgaccagccccctttccaacagatctcctttncagaaaagggctcagatgagaagaaaccattcaaangaaaaggcaagaccnccttctcccattccagtgagaagcacacacaaaggcaagcaggatnngancccaatccaaacaaggagaattctgaggaaaccaagctcaaggccgggaacagnactgctggatcagaaccagagtccagctcatatcnggaaaactgcaggaaaagaaaaatcagttccaaggatanctgccaanacagagcagggaactgtccagaagaggagtgcancttgacgttgaataaaaaatcaagatcctccactgctgtgcacaacagtgaaatccaggagacctgtgatgcccaccataggggaagttccagggcttgcactngcgcagcaagcggcatangtctcgggccctagnagnccaaacaccntcacttcgaaaaagcttggtgacctctgtgcgagctatgtcggaggctgtttatcaagacctancccaggtgtggncacagcagatccattctccantgacctgtgagcagctgacactgctcactnggctccgggggcctctgtgtgcccaggtgcagaccttgtattccatggccacncaggcagcttatgtcttccctgctgagagctggcttgtcccagccacactgcctggtcctggggattcagccctggatagagaancccatnccttccctgggcaggagataactgagcctgtcagtggatcagatgaggnnaagctgngagcaccctgaccctattcagcanagatgcagctctgggaatgagaacaaggacctgcttcttctcagattcttccagangaccagnagtgacaattttagatgcactgtgttaataaatgacagaacctgaagaagtcataggaaagaaacttgagcnntatactcagaatggtgagccctgaattttgcagaccgctaaggctatagacaaattttatatttcatgttagacatttgatnccttttggatgtctgntgacagtcgtgcatttctatataatcagaaaaatattagnttgnaatcntgaatttncatattttagattgtagaaaagtaaatataaaattatatgctctntttttttttgagacagtcttgctatgtcactcaggctggagtgcagtggcacaatcttagctcactgcaacctctgcttcctgggttcaaacaattctcatgcctcagcctcccaagtagctgggactacaggcatgtacngccatgcctggctnatntttttttcttgtattgttagtagagttttgtcacnttggcnaggttggcctnggactcaagtgatccnccagcctccacctcccnangtgntggggttacaggcatgagccgctttaccaagaaattgcttctcttttaattcngaaaaggttgtaggctcttccagcctgaacccatggagtactaanatccacaaaccattaatagcactccctgtgggaaaatgtntatacatttttacagtttgcatagtaaaattactatgcaagctgtttacttttaatatttctacataaaatttaagtcaagatatattaaatggtaaatgattgtacttattcatctgnctcatgttttatttcattttaaacatcctgaatttatantttattgtatttcatacatttcaattgattgnactgtattgcaggatatggagatttcatcacntactacaatacagnntattttgttatatttgncntatattctacttgtattttgtactgagatcatacaatctttcattatctaagtgtattaatgacttgtttggttgctttataattttcattttatgtaataatgaaataaacattaatnttgtttggaattttaaatttcttncatntggaatttgtatttaataaagatgtgaaanag

SEQ ID NO: 233723 - DNA, 504 bp, Homo sapiens
gctctcagcttgaacattattggtgtttgcattgttgatttggttctcagcttgaacattcttggtgtgtaaaaatgctactgatttttatatgttgattttgtatcctaaaacttcactgaagtggtttatcagttctagggtccctttgctggagactttaaggttttcaaaatatagaataatatcatctgcaaagagagatgatttgactgccttttctattttgatggcttttatttctttcttttgtctgattgctctggctaggacttccagtactatgtggaactggagtgatgagagtgagcaaccttatcttgttccagttcttaatggaaatgcttccagcttttgcctagtcagtatgatttttgctgtgggcctgtcatagatggctgttaatattttgaggtattttatatatttagaagctttcaaaaattttgtaatttgtggttattctcctcatcttaaataaatagtaactttttaatctaatgt

SEQ ID NO: 233724 - DNA, 437 bp, Homo sapiens
ccccccctcctctcttctcccgccggtttcccccatttcagagaacgctgaatggttccagtctttcagtcctgctcctggccaacactggacctctcaaagtctagccaactcctcttccagcgccttgataaacaaccccctcatgctgggaaccacagcagtgggctgtttttctccctcatgcaccccaggaagcctctcctctttgcctgggctttcttcccaaggccttagctgccaacccattttacacccatgcgaagcccagtcagtcacctgaagaaaaggagactcacagaaggcccaagatgaaagactctttaatcctgtggctttttgagttttgtttttagcaggaagaccttattttcaaaacaaattgttacacagaatttgccagtttacagaacagatgaataaagacatttatggca

SEQ ID NO: 233725 - DNA, 357 bp, Homo sapiens
tctttttacttctaatttgtgccaaggacaaaagccattcagattcttaatgttttgtatatgacctttttttttccccagtctggatgcttctaatatcttccttccatccccagtgttgtgaaattttgcagtgtctatttttgatccactacactgtcattccatagactatacatacttggaaactcatatccttcagtgctgaaaggtctcgtaagtcaatcctactgtgagtctttatgtttctatactgccttgccaggcatggtagtacatgcctgaaattccagctactaaagccaaggagttcaaattcagcctggtcaacaatgtgagaccccgtctctatttttt

SEQ ID NO: 233726 - DNA, 461 bp, Homo sapiens
aatcctagcaaattgaaaattaatactaaaagtcatacccactaaaaaataagattacacctgtaccagtggacttggagaaatttcctcaaggctctggctagtgtgaaatgtagatgcagagaaatgagccctgtaggatcctattttagtagcaagcaataaaaatatcttttacacatatgttgagtgtgtgcctggggtacgtaggacagtggctgggtggagtggggaaggtgtgtaggaatcaacaaaaagaaaatgacagtgaaaagtgagtccagtatgtgtgatcctacttgtggaaaaactccacatatatgaatacgcatgcgcgtaaagaaacatagacttacacccagatctacttcctaggagaggcaaccatgatacaagttctagtgaaaagaattaagttgcaaagaaatgtggataataaaatccgaattggtagcaatacc

SEQ ID NO: 233727 - DNA, 441 bp, Homo sapiens
actattattattattattttgtcttggttttcattaaactatcttagtagtttcaggagctctgggtttcaacacacacttctgccagctgactttagtgcgtccattagcataacaaagtcaattaggcaaacctgaattttcacttttatcccgttcacagaacatcagtgtaaatggagacaggaagaagaaattggattgattctccacttgagaattatgttaacttggaagaaaatgttaagtctactatgtgagggcatctagtgagagggaaggaatcacctcccttcccccattatgtccctttatgcacctctgacccttgtgctctccttttcttgttgcttctgtggtctggttgttagctttcccgatcctccacacattagaaacctaagcataatgatttctgatcgaaggctatgagatatttga

SEQ ID NO: 233728 - DNA, 560 bp, Homo sapiens
gaggtctggtaccatcgtccgtattcttaaccactgtacggttttccagcctccccttcttatcagtctcctcttgccggtttgaaaattagggcaaagttaatatttacaaaccttaaaattctaattagcagaaactgaaaatgtatatgtggggcatatttaatatttctaactagagtaaaggaggagactttatacatactccgtcacttagggatatgcaattgatgtgagaaagagaggagcctcggtaatttttcatgccacccaggcatctttttttccctcaggctgatcccagaattgctaccacccttttttctgccctctgcctaaagctggccctaaacccatgactctcttcctgtgtggactgtgctgtagcttgctgaggaagggctgtactgaggtgtcagaagcctccttgcagtgctggtccttgggtattgtgtctgttggtagaagtaaccaatgaataagccactgccagaactgttccgcctgcccagttttcgtgtgaattttctaatgtagcttgcgtgccaacgccttaattt

SEQ ID NO: 233729 - DNA, 537 bp, Homo sapiens
aaatatgaaggaaaacatcagaagaaacaggttaaagaattagatgtggtcctcacagggaatatttgcccctggccgcagatacaaaggatgcatttcaagctctcccaagaactcttgcagtgctccatccctgtgtcctcagaaatggccctgagtctcagcagctcaaaaagactccagttggatagtgagaagccactgcttccttgcaagaaccttcccaaatttctctaaccatgtgaagacatgcttgattcccctcaccttcaccatgatttttctgggagaataacaaaaagaaggaagattcagtaggaaaggaaagcaatgaagaagccaagaaagagacaaggaaccctggaaagagagtcagcaaagagagaaatagaaacattaatttcaggtgaagaaactgaagactttagccagagccaagtggctaattcagagtttaatacacctttgacctcaaaccctttgtggtcacctttgaacagtgcctccctctctgaaataaaatactggttctgtcat

SEQ ID NO: 233730 - DNA, 689 bp, Homo sapiens
aaatatgaaggaaaacatcagaagaaacaggttaaagaattagatgtggtcctcacagggaatatttgcccctggccgcagatacaaaggatgcatttcaagctctcccaagaactcttgcagtgctccatccctgtgtcctcagaaatggccctgagtctcagcagctcaaaaagactccagttggatagtgagaagccactgcttccttgcaagaaccttcccaaatttctctaaccatgtgaagacatgcttgattcccctcaccttcaccatgatttttctgggagaataacaaaaagaaggaagattcagtaggaaaggaaagcaatgaagaagccaagaaagagacaaggaaccctggaaagagagtcagcaaagagagaaatagaaacattaatttcagaggagttggaagtgttgtgaactattaatcctttagctttgctttggacttgatagcaaaagtagctgcatgcagaagtaaaattgttaagaatgtcacataaaatgtgagggtgagctcagcatgaaggaacagcctcttccattggtgaggtgaagaaactgaagactttagccagagccaagtggctaattcagagtttaatacacctttgacctcaaaccctttgtggtcacctttgaacagtgcctccctctctgaaataaaatactggttctgtcat

SEQ ID NO: 233731 - DNA, 1017 bp, Homo sapiens
tcctggggagcacatcaaagagaatcaggtcagagagagaaatttcacaagaacacaaattctatgttatggtccgcccaaaagaggaaaatattttaaaatgatatccataataaagctatattaacaataagctgtatggtcctgccattggagtggaggggtgtcttgacccttgacctctgctcacataaaagcctgagaaatgaaaatcatgtttatcatggttgtttgttttatacaaatttactgtctttctttaactgatataagaaaaaaaaaaaatcttttctgaaatagcccaagtctggttcttaacagtcatgtgactgttttttctgccagccatgtgctccgtatcattttactctgaaataactatgcggatttcagctcaacctgcctttgcttataatgcatgacataccctgtgagggagcctgagaacagactcctttgaaaagcaaggttctcatagttggcctgtaaccatggaagcagatgccgttttcttctcaccctgcttacctctttgcagcctcgagctgctccctattgttaaaaggggtacgccttgatttttcttcatcatgaccgaacttgcctcttcttcaaaggacatgatgctgcaggtcattggtctagactgtttgcacggtccagagaatagccttgatgtaacccttgctccgtctgagccacaccaccagccgtgcatctgcagactggagggggacattggagatctgtatttgaaaagaagtctgtctgattttgccattgtgccttttcactcatcgatcgaatgaatatcgaaccttctgtcgttgcatgtgtgaaatagatagcttagcaagcacttttgtgcccaacctgtgcagtgggccaaaaggttttccttttagcctcaagaattttttcttcagactttatgaatttcgtgttagcttaaattatttatatgtctttatccaactgttacgatgaccgtttcagttacttcgtcagcagtgactt

SEQ ID NO: 233732 - DNA, 480 bp, Homo sapiens
gggaaaaggttgcagacaaaagacacaaaagtgagaaatcagaagagccaagaatcctatcaaactgcactggcatttctccgaatgagaacaaaacttctttttgtcctttttgcaaagttcttaccatgctcatgacagaggagactgcttctcagcaggagaaaagattcactgaactcaatgggatcacatttatttaagctgtttctttccccttcaacatagagacgcaacctgaaagtcctggagcttccagggctgcagggaatccaggaacctctagaaattatacataatattgtatgggcatgtttatatgcatctttttaggtaaggatgaatgttttcatcagatgatagaagtgatcttggtccacaaaaggttaagaaccacgcctttaagatccgcattcttggccaggcacagtggctcacacccgtaatcccagcactttgggaggccgcagcaggcggatc

SEQ ID NO: 233733 - DNA, 434 bp, Homo sapiens
ggcagtcagattctgtctttattcaaaattttgatgtttgttcatcatggtttctttgcattcattaaaaaaagatgttaaacaccacctcgcccagccgacgctcccatcttctaagtgtgtaccacatagtagcaggtgcactattgccatttataaaaaatgtgcatctgtggcgtctccctcttttcagaagaggaaattgaggcccagagaggcaaaaccagttgccgaggtcttagaacacgtaagaggcagggtcaggatttgaatcgtgctctcctgcgttagcgctccttccgcccttctgcgccgagatgtggtcaatggggtggggaccagggtgagaccagggaggctctctcgtgggtgcaagatttaaggggacgctgaaaatctcagtcattaaggtccatcatgttttaatgcaacat

SEQ ID NO: 233734 - DNA, 596 bp, Homo sapiens
cactattaatgctaatgattgccaacgtgtgctagagctgtctggtgtttcattgttgatgccatacatatatacagacttattttacacctatcatcaggtttttttctgacagaattagaattactctgtaatctagattcataagctaagttttaagggaggtattttattttttgctccttgcagacccttcttgatagagttcgataatggtggtaccgtggtgccctctcgtgacagaaggctgaactacagctagaacatcgcgagcaggaaggtgggagggagaggctgtggcccaagcccaccttacagagctttctggaactctgggtggcaaagcggacattctcagtattcccagggacattgatgggctcaagacagaaatcgttatctcttactgtgctgaaaagagagttctatatcagaagaaaaaggtcattttaatttttattctttgaccactggaaaatcagagacctaaatgagggaaaaatggatccagactacttgttcaagtctttgtacccctctttaaatctttattagcattttttcatggaaataaatttctataacattcgaaatta

SEQ ID NO: 233735 - DNA, 414 bp, Homo sapiens
agtcttattccctaagggattcttttttcatttataatctaatttggtcttttaaattgtggaaaacagttatgtagtttcgatatataactagataccttcagaaacatatgtccattctagtccccatccttcatcttccctctgtggcttctgttaaacatggtagacaattgccctatgcagctatacaaacttgtattaattaaaattaaaaattcagttccttaattatattagtcataagtgctcaatagcacatgtagctagtggttaccatattgtaaaattcaggttatataatatttctatcattacagaaagttctattggacagtacttccttaggaaagcactaaaaattagtgcaaagaggtatagctcatacataaattttacaattaaaaaaaaaaa

SEQ ID NO: 233736 - DNA, 528 bp, Homo sapiens
tcagaatgtcattgtgccctctttagtgacaatcttggagcctgagaccacatgaaagagactgtgagttactttcatttccagtgcctggcacataaggaattcttaatgaatggtgaatagtgaaatgaataaatagatgataatgagagaccacacagtaggacaggtgataaaaaggatggagtaatgaacaaatgaagaccaatggtgaaataatagatttcagtataacaattaccaaacatgacttagaattaacgttttgccttgatgacatggaaatcttaaataaatttctctctggtcattctatgtcatttacttaaaatgggaaaagacatgggggactgctggtttgaggtatgtgtgcagaggtcccatgtgcacccagcacacacacacgtgcttacacacacagccatccagggacgcagctgccacactaaatattgattagcaacaggagttcaagaccagcctgcacaatatagcaagaccctgtttctattttaaaaattaaacaaa

SEQ ID NO: 233737 - DNA, 313 bp, Homo sapiens
aggtgactggcccagggccaggagacagagggaccagaggagtagggaccagaggcccaggccccactgtgcccctctagccgtgtgacctgaccactgctgagtggcccccttgctcagcctctgctggggagatgcagccaggcttgcggaatgctgctctggcatggacacccgtgggggcagggggctggctctgttggcaggaggctgtaaaggaaggctgccaggctgagcaggcagcagggtggggaccacggggcactagacctggcaaggtctggatggtgactgggccaccattgtagaggag

SEQ ID NO: 233738 - DNA, 254 bp, Homo sapiens
cccagaaaaacatatagtactacatataaattatttggtgtatgctagtaccacatataaattgcttggagtattactgctttctgagttattgatgttctcttatggttatggatgattgggtgttaggaagtgaaatacacacggtgcagattacacttatggttaaaagcaaggaaagcatcctggagctgtagaaagagcattacatagttaaaggatcttgtcaggcttcgtgtcatttgaaaactgag

SEQ ID NO: 233739 - DNA, 498 bp, Homo sapiens
ataatatggtagcattatttgcaatagcttcaaactggaaagaacccaaatatccattaacagagaaatgaatacattttggtttattaacatggtggaacagtatacaataatgagaatgaatgaactatgcagctacacacaacatggttgaatcttacaaatataattttgaatgagtgaatccaggtacaaaattaaaaaaaatactgcattcttccatttgtatgttgtttaaaaacagattaaagtaaatcatagtttgatatgtgtatagaaagagttatgttgataatctcaaaaatcaggtcagtagctgattcttatcttggaggcttgcaagtgaagactgagtataatcatttctctatttcaattaattatatggtgactacatggacgttccctttacagtagttctataatctagaaattttatgcacttttctatatgccgtgtagaaaaatataagctcattaaagtactttgagggaaaa

SEQ ID NO: 233740 - DNA, 256 bp, Homo sapiens
aaatatcagctgttgggtcccgcatcattgcttgattgaagccctgctccttctctgaggcaaccgtagaaaaatatttcaaaagcaagtgatcaccagacaagaagtctaacacatgtcgtcttcaagagccctagcacaatcagtatcagacaattttcctgtcctaagaaaaatgtctgggggccctgtccatcttttcctgttcctatccagccttccctctcctttttgccgcttggtacccgaatgtaca

SEQ ID NO: 233741 - DNA, 124 bp, Homo sapiens
gcctcggctgatgctttctgagcctgtttgcccatctgtgaaatggactgctgacgcggggcaaaatcatctcagggactgccttggaccttggaattatggattgaaatttttttaaaaattt

SEQ ID NO: 233742 - DNA, 553 bp, Homo sapiens
ctttggggtggttacctttagctgcctccctagattcaggattagggaaatccagtaatattatcaggctatgtgaaatctatggagaggagatctctagcagccttcagaacattgatgtacccaagaataggggcctgtgtcagaaacatacagcagggattactaaggacaaatgtgggaatatataatagatggatgggtaacaataatagtaacatcaatactatcagctaacatttagcaagagtttattaagtaccagccaggcgccgtggctcatgcctgtaaacccagcactttgggatgcctaggcaggcagatcacctgaggtcaggagttcaagaccagcctgcccaacatggcgaaaccccatctctactaaaaatgcaaaaaactggccaggtgtggtggcagatgcctgcggtcccagctccttgggaggctgaggcaggagaatcgcttgaacccaggaggcagaggctgcagcgagccgagatcacgccactgcactctagcctgggcgacaagagcaaaactctgtctcaaatta

SEQ ID NO: 233743 - DNA, 406 bp, Homo sapiens
gccacatgtgcaacttaaaggaagcacagagctctgtttcagacaggtgctcagtgcgagggaaaaaatcctaagagcagggggcaagacttgaggaaaatattgaggtggagtcaatgagagctacagagtcagaaagagaaactaaaattcttcagtgatgagaatgttatccctgcaaggatgattaccaagaaatatcagaaatagagaacctcagtgaaaaccttctggtgtcctctgtaatagatttacttgttttagggatttatacatcagaaatctctagttattgagttactgatggaaaaataacgaggcactagtttgtctgtgattgaggttcagctgcggaacatcatagcagccaaataaaattagaccattttgagtaattcccacccat

SEQ ID NO: 233744 - DNA, 413 bp, Homo sapiens
tccaccttcatatacatattccaaacagctttttagtgtttcactcttaaatgtgaatgggcagcaacttactagatacctgatgaaagcctccagcaagaaaagcagaggagagaaaagggtgggggatgggggaggggagagaaagagagagagagagagaaccaaaagaacttagaggaaaatatagataaggcagaaaacagaagaaatgcactcttctacctcaaagccattgataaaatccttagagagctgagcgaatataccttatatgtgaattaagaaccattaaaaagatactcaaaaaacaacaaaaaagagctcttggaaattaaacatcagatagccaaattaaaaattaaaagcaatagaaaattcagaacttaagaccaattttcagaaagtggagg

SEQ ID NO: 233745 - DNA, 273 bp, Homo sapiens
tgctaaatgtatttatgaataaaattgagacatatagtactgttaaaatatatgtgataatatgaatatgtaaaattatggaaccaatttttaaatgataatgtaaattaaatgactgttagtaaataatgactactggccgggcgcggtggctcacgcctgtaatcccagcactttgggaggccgaggcgggcggatcacgaggtcaggagatcgagaccatcctggctaacacggcgaaaccccgtctctactaaaaatacaaaaaattag

SEQ ID NO: 233746 - DNA, 198 bp, Homo sapiens
cttcttattcattctgattccttgtaatctatttgacttttctttttgaaagacattgacttttgttctaatatttgaaatatttcatatgcctacaacagaggtctaccaggatttctttttcttagatgcctaagtaagttcttgccctttcttatgtctattatcatcttcctttctttcacccttgttttgctg

SEQ ID NO: 233747 - DNA, 355 bp, Homo sapiens
caggctggcattctttgcccagtaccacttaactttattcatgatccattttaggtaaacagtccctgtgccatgccggtatgcttagctattccaaagacagatactctccaggatgggcagctcctatctcagtgtgttacctggaatgcttactgcccagagcagtgattctcaaactcaagagcctcgggttctggcaaggtgccttagggacacaggtgggagcaaggaggggcccagggagacagcaggtggtggcacattgagcctttacctctgcagctttgaattgacctatttttatatttgggtctctgtttaagatttcattgccgtggtagggagagttcca

SEQ ID NO: 233748 - DNA, 1027 bp, Homo sapiens
tagagattttttttctattacctagcatggttcttatgtaaaacatcttgtattctaatttaagctgatagtacgttaattactatatgaagactctaccttttcatttcccaccttttatgttattaatattatactatgcaactatttgtattgggtatccactaaggagttctgtatagtatagttgttattaatacatctcttatttatatttgtatactaattttaatagtaatttaaacattacttttagagtaggagagaatactgtattgactgttcatttaactttactggagagccatatgttttgttattattatttatcatgctcttgtttcacatggaaaaactctttagacatttcttgttaagtcttgtctgatggtgacaaattctcaaattttgtttgtgttaaaatgtacttacctgtttttttattgctgaaatacagctttgcagtttagagtatttttaataagcttttttaaattttattttagcactttcaacatgtcatcccactttctactcacttgcaagtattttgttaagaagtttcctgatagccttacctagaagacccctttgagtttatcctcttgctgctttcaagattcttttcatctttgatatttacaatttgattaatgtgtcttggagtattctcttttaaattgatcctaattgtggcattttgaatttcttgagttcatatcccgcctagaattcgggaagtgtttgtacagtacatatttaaataagcttcctggtcttctttctctcctcttttgggtacactcataattgttatatttatgcatggatgtggtgccacagatcacttttaaccttttcctctttttttttttcccaatcatttgttgttgttgttcctctaattggctaattttcatctgactgctatttgagcttgtcagttctttcttctgcatgatcagctatgctgttgtaactattgaaattttaaatctaatattaaattgtaaatatttaaaattat

SEQ ID NO: 233749 - DNA, 475 bp, Homo sapiens
tatttcctgtctctcccattaaatgataaaatgtttcaggacactgactgtgtctagtctacttctgtattcccagtggcagctacctagaataggacttatcacacagaatgtccatgcatatacacacacacaaatactgaggcatattcttttttggacatatctgtgggggcttgtggaaaggagcggtggtggtggtagtgactttttcccaaatgatttctttacaatttctgaaatttacaattcacaggcttgaaaacataggcctcctgtaactgtgcttcctttaagacatatttcaattgagaccataaccaaacacctggaagatggtaactcttggttaaagcaagatatgaatgaatgacaagggtttattattaaacataagaaacctcatttctttggaggagaagagcaatgcaagggatgaggatgggaggatggcaacttgagaaaacaatattct

SEQ ID NO: 233750 - DNA, 312 bp, Homo sapiens
tgaagaggttagatggatttggggggttgggagttaggtagctgttatggacatagctgctgaggaaacaggtaaattaggacggcactgcgggtactctgtgttccgcctgctcaagttctagacttctggtgtccatagcaacccagcagaaaacatctgcctatgctcagagccactgctatttctacaaatctacaaggcccagactgaggtgatgaccgggccaatctctggaatagtgtcagacaattagatactctttcctgtcttcaggagcccatctggaataaagctacttatcaagtttca

SEQ ID NO: 233751 - DNA, 252 bp, Homo sapiens
caattttgtttcccctccaaatccccatcattttaacttgttctgaaatgtgccacgtgaggtatcctgtattatgtgcccgcatctgctgctccatacaaaccgatgctgctgtcttagaaataataggcccccttttattccctaatagacactgccattatgtgagatcatgttcaagctttaaatttttccactctgtatttctgttttcagtttatcttatggaataaatggtccattatttcagta

SEQ ID NO: 233752 - DNA, 572 bp, Homo sapiens
tgattccactacttgaaaactgattgcatcagaatggaagtatagtaaatagagggcacctgttacttaggatgtgcttcattgagagagtggagccttgtgcttaagtgattcagatactaaatttctattgggatggttggctgaaattgtccttttaagaaacaggttataaagatagctggcttaggtggacagtttattattttttggtgggttatgtattctgtatacaggaaggggttagtagtttgggagtcatgaaattaagtaatgttcaaccgtgttaacttgggagcagtggttagcaaacctgattatttgacagataaaaaatcttgggtcctattccagacttactaaattagaatcttttaggcatcaatcctaggaatttgtatttttaagttcttctgaatactttggatgtctggtgggcaactttttgggagttactgccttagaagactatccagatagttgtgaccaaagacctatttgaaatgggtgtgagaaaggaatagcttaaacttgagaaggaaatgaggactactgtgcttttttttttcaaa

SEQ ID NO: 233753 - DNA, 379 bp, Homo sapiens
cttttgtaaattttggaagcgtttatgaaagattgttgctacgtctattctaaacatttttaaaatttaccagtgaagccatctgaaattgggcttttctttttttggaaagtattttttgctgataactcaccatctttacttgttctagatctatttagatttcctatttcttcttgagatagaagcccattgttccctctccagtgactactggtcttctggttttcatgaatatcttgattgaccatttgttggtttttatggatagagggctggggagagggttctgagaattgagcaagttacaccaccccaaaggttgttgtttttactaagatgtaactgtttttctcgaataaattctcctcagattttt

SEQ ID NO: 233754 - DNA, 252 bp, Homo sapiens
gagtggggctggtcttctccgaatcatcatgaaggacagggaattattttgcctggagacaggtgactgggtgaggctagggtgatgatttctttttcagctctctcaaggccttctggccccttattgtatgtttcaggccccatagatagtgctgcaagcctctgttagtaattcataggcagaaacaaggcaaagtcaaacaataatagggaagtaaattattgtctcactagaggcaaaacatctgct

SEQ ID NO: 233755 - DNA, 338 bp, Homo sapiens
agatttcccttaaggagttaaggctgcagttacaatatttaaagtttggttttaaagataagtaaaaacaaaacaaaaaattttttaaagactgaaatgtatggggcaataaggaactaaaaaacctctcatgttgacaaatggctatataaataatctgcttctcaacagtaaaccagtcagtaaaccagtaactgtgaaaaaaagtccactgaaagaagcattgctgctatatgttatgttgtctacatgtctgacataagccttggagccctacatgtatggctgaggtttttgttgtttgctgttgatttaaggaaagaaagccaactataaaa

SEQ ID NO: 233756 - DNA, 197 bp, Homo sapiens
tgtatattcacttcccagagctttttaggatattaaccagtctctaacacacagtaggctttggtccaactagtgtaaaacatggtgcataaattcaccagagataaagaaaatattaatacacgagtagctaaccattggtggcaagtgacaggagagggaaggtttacagatttaggtaaagtgttttatttatc

SEQ ID NO: 233757 - DNA, 485 bp, Homo sapiens
cagcacagatagagcaagtttccatctttgcggaaagctccattataccgaattagatgaatctgtctagactgataactgacaaatggggctacaaggatgtgggaagggactttatactttataaatcacattgttgttgttgttgtttttaacaattgcttttgttattttattttattatttttgtaattttacaagagaagaagacggcttgtacttgtgtcaggtgtttattccttattaaatcacatcctgcattgtttctcaaactggggaaatgacaaagatgaagagaaggctggaagaaaaagagatgggatggagtagaagcgtgaccaggaggcgggtgagaaggaacattacaaagtttttcacctcaaataaaacttggatttgaaacgttaaacatccttctagttatcatccacaggactgagtgaaatgaaatttcccaaaattataaataaatggaacaaagtttg

SEQ ID NO: 233758 - DNA, 146 bp, Homo sapiens
aaaaaaagaacaagggagggaggcatcagctatgtcaaacacaaacagctactggagtaaaatgaggacgagaactgactgggggatttgcagatgctgaggccatgggtgacacagacaaatgaagaaatgaagttggttactcc

SEQ ID NO: 233759 - DNA, 417 bp, Homo sapiens
tgtttatttctgttcagagcattcttattttctttaaggaatatatcagttacaaatctttgtagaaagttcagctgtattggtttggagaagtttatgtgtcagttttttttttgagtcaagaagaaaggaaaaactcaactactgttatgtttatatgaggacaaaaaaaaaaaaaggaagttgataagaaaatacttagcatgacagtctttaaaatccagcatctgaatttttaattcctcactcccctccttttttaagaaacagtacaggaaagatggtcttattatccttgttcgcatttcactgttttcaccccactcaaccaggacgaagtcattcctcaaagcaagtaggaacaaaacataatctcttaagatatttttaagaggacatgctgacttggtctttgta

SEQ ID NO: 233760 - DNA, 968 bp, Homo sapiens
gatagtatcattattaggctaatgggcatttttgactccttaagagttacttggctcagtcagtctgctggttgaggctttggatttgctgattgcagcccatgggtatttgcatacgccttcccttctcccaaggcctttctcccccatcagtgcttgtcattgctgaattcattgcacccctgtccctcacacccactcacatgaccttctcatactaatgccttttcacacttgagcaaggtttctccttaatgaagacaagatgcattaaacttcccaattcagaaaattggagggtaatgatatgtatgaaataaagtagtttctttttaagagaactcagagctgtcatccattgattcagggaatgaatgtggtttttggtgtgctgtattctcccctcttccccagggtggtagttagtttcttttttctttcctttttttttttttttaagttctgggatacgtgcaaggtggtagtttctacagtgagatagtgacttgataatctgagaaatatgcatcttacccacacacatacccacaccctaaatggaggtactacagtatattttgcacttcagtaaatgctcagcacctactgtgtgcagagtgatatatattgaattttgtgtgcggtgctgtcaatccttcctcttctctgatttctgagacacaatctggctcctgtgccttgtgattctgatgaggccctctcaatttctcaccaaacttccttttgtcttgcttgataaaagttggcattcctcaaatctctatctctgacttgctttctttttatactatggattttctctgtataatctttcatagtgacttcaccatcccccagtgggtgattccaacatctgcattttcaagccaggaaagcactgtagctcccccaaaagcagaaatattgtgtatattttgaagatatttgctccaagatggctcacagga

SEQ ID NO: 233761 - DNA, 370 bp, Homo sapiens
tagttaagacggggtttcaccatcttggccaggctggtctcaaactcctgacctaaggtgatccacccgcctcagcctcccaaagtgctgggattacaggcgtgagccaccgcgcccggccaggttcagtactgttctagtttctaagtgcatacatctctgcaataaattccttcatgcttaaaatacttccagtggtttctgtttcttgcaccaaactctgactggtacagtcagtaggatttcagagaaaaattatatatatatagtgaaacattctacctaggcctcatgttctaattgaggttattctaatcgccctccagtgaccctggcctgcccttcgctctgatcccaaccttggccccag

SEQ ID NO: 233762 - DNA, 510 bp, Homo sapiens
acgattaaagtgaaaattcgattgtgtcatttcttggctcaaaacttctccagttccttgtcattccttgacttaaaacctctcccatttcactaaaagcccaagttattacagaggtctaaaatatctacttgttacgtccctattcttctcctaactcctgttgcttcagcctcctgcccttattgttcactctctttggaatttcttcccccagatgtctgtatgttattgctcccttattggcttaatttctgctcattctcttaagtgtcagttgtctcagtgaagtttccctgattactctatttaaaaacataatccaatttaaaacattaaaatcataatcctaatggccaggtgcagagtggcttatgcttgtagttctagcactttgggaggctgaggcaggaggatcatttgagcccaggagtttgaagatacagtgagctatgatcgcaccactgcactccagcctatgtgatagagtgagaccctgtctcaaaaaaa

SEQ ID NO: 233763 - DNA, 247 bp, Homo sapiens
gttctggttacatgcatgtcacaaagttatatctgtggcagctagctgtgtagcctggggctgaattaataaggagtacattgtagaatcaagttaatgactgcaactctaagacaggtggcttgggagtcagacagaaccaagttcaaatcctgacttattcgctctgtgtctttaggcagtgactcctcagaccctccgtgccctctgctcacccttcctcctgtctcacccctctgcggttcac

SEQ ID NO: 233764 - DNA, 359 bp, Homo sapiens
ctcctccttgtgttaaatccaggtagacttcctagcggcagcctgtgtccagcaggaaaagctctgcccttttgctaaggaggttgggaagggcagaggaagcccttgtttaggtggccttgacatggctgctgtggggttttgtcatttgccagacgacatcagatttccagagctcatctctgggctctgagttttgaggctgctgtgtggtcctgggaggcagaacttcggcatcaaagttttcacagcctctgatggtcttgccactctgcgggctgagccatgtgtgaccaggtcatgcccttgtgagaatcccagccttgaacaagtgtgaagatgcacagatatggagaaaa

SEQ ID NO: 233765 - DNA, 868 bp, Homo sapiens
agcagctccaggagttctcacggtgacagcccccctcactcacagacaccatgtgatattaatagggcttagacacaaagcactgaattcccaaagcattgaagagaaagacagctctcagtctgagtaaaaccgtattgagagaagaaaagaggttgaaagaatcttaaagacaaattcagattacatgtaacattggtcaaattgaccagaaaatattcttccaaagaagttcttctctaaacaccaaaagtgcacagctactctcagcatgagaaatacaagtattatgagaaagagggcttattctgagcagaatttccatctctgctgctctcccatctgccggccgttggattgggaatctatactggaacacacctgacaacctccaccagcactttttgatgaagaattggaattcactctattcacatagtagaattatatcagagattgcaagatagctaactgaagagctactatgattcttgggtggccacatcacctgcatttatttgtccgggaatagtggcattcctaatttagtaaaataaaagaatagactgtaaaattatgctgacctataattatacctataggatcaattaataaacatgtcaggttaatatctactgtagcaatgtggtagtaaattttctttgggtattaaatataaatgtgtacatataaataattttggtatattagtcataatgtatatattttaaaaattatctgtaagcttaattacaatattttataatactttatatttcaaacaaattaatgcttatattaaagttatataaacttaattcaaacaaattaatacttataataaagttatataaacttaaagttataa

SEQ ID NO: 233766 - DNA, 216 bp, Homo sapiens
aggtaggcaatcattgtagctaaagcatgtgggtagatgtaatacccaatggtagacagaggtcccagccttgatgaaggtagctggaggagctctcagttagggcatcatctaatttaattcttaataaatgttagcttttaagatgtgaagaagtctggatcatcaggacttaaagaggaaatacatggtagaaatgggaggtaccaactgtaa

SEQ ID NO: 233767 - DNA, 237 bp, Homo sapiens
caccccatgacccatacctcctcttccccacctccctgggccagcctgccttccttctccctcctcctccttcctgggggaaggaagccccaccttctgtgcgcagtcagctcctaagcacgctcccgcttcccctggcctccccatttaaaaagggaggcaaaggatgtcaccactgtcactacactcatggctttgctctgggaagtcctgcaaataaaatgaaagttctccaac

SEQ ID NO: 233768 - DNA, 774 bp, Homo sapiens
caggcacgagcttgaactcctgacctcaggtcatctgcctgtcttggccttccacagtgctaggattacaggcctgagccactgcccctagccctcttctttttttttaattaaaaaaaaaattttttttttgtttgagacagagtctcactgtcacacaggctggagtgcagtggcacaatctcggttcactgcaacctctgccttccaggttcaagtgattcttgtgcctcagcctcccaagttgctgggattataggcacccaccatcacgcctggctaacttttgtatttttaacagagatgaggtttcaccatgttgaccaagctggtctcaaacttctgacctcaggtgatctgcctgcctcagcgtccccaagtgctgggattataggctgagccaccatgcccagccaaccctcttctatttaaaaactcttttaaacaaaaacaaaaatacatagaaaacaaagccaaaccaataaaccaaaaaaactgtcttaaaatttccactgctctcaggataaaattgaatgcccctgccagcctggccctcctgccttcccagttgcctttcctgctactctccccacagccttgagcttcatgccccttaggcaagtggtgtgcaaaaccagggggaaacacagtggtcttatctggagcaactggagaaagaatacattgtatttagtggggaacaaacatggacacattataaggcagcatgcaaactcccaatcataaaaaaaattcaacagagaattcaaattg

SEQ ID NO: 233769 - DNA, 458 bp, Homo sapiens
gctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaaagcctttatctttcaggaaagaaattacaaaatagtttcattgtccagtcatattcactatgagttataagaggaaacattctatctagaattagaaataccatttgacccagccatcccattactgggtatgtacccaaaggactataaatcatgctgctataaagacacat

SEQ ID NO: 233770 - DNA, 243 bp, Homo sapiens
taggaaaaaaaaaaaactagctaagcaactagatttggttcaagataagaactatctaccccatcccagattgtgaacaagaaacaggatgctatagcagtctaccgtaaacagggaaatttcttggtatgctcttgtatattctctgaactccaaaaaaactagctaagagactagatttggttcaagataagaacaactagatttggtagcgaggtaagaatcactggacactttagaaat

SEQ ID NO: 233771 - DNA, 412 bp, Homo sapiens
ttggttgttaataaatcacatcctagtctttcagcacttccacaagcagatgacattttcagttttctagctcttgtagttttaacactgcaacatcaatgatggatatgtccagaatcagttaaaaagaccgtcaaattattttattccatctatttgttcactctcttggtcccaagtgtattggaatgattaccttttggcattctctgctattgtgcgttggggtgctctcgattgtctccgtgttttgtgggctggttgggagagggagcttgggaaggatgtaccactgtcgggagattgtgaatcactgggatgcctccaaggatgatcccttccgtggctgcagggagtgctcctggagccacacccacgatgcctggcagatacctgtatgtggcaccactga

SEQ ID NO: 233772 - DNA, 452 bp, Homo sapiens
aatggagacattaaggtatactttgtataggtggaatgcaggattgtaagtctacagtttgttaaattctgataaatgtatacccttacataacttacaccatcatcaagatacagaatatttccatgacctcagaaagttctgtgtttctttccagtcaatcttgcctcacctatttgaattttcatcactataggttaattgtgcctgctctagaatgttatgtaaatggaatcatataagatgaacctttgtgccaggcttctttcactcagcatcatgtttttgaaaatcatccatgctgtcgcatgtattggtagttcattattgcaaaattgtattcaattgtatgaatgaagcaattgttcatcctttctcctgatgttggacacatgggtgtttcgagtttggggccataataaattaagctgcaattaacattcttgtacaaa

SEQ ID NO: 233773 - DNA, 375 bp, Homo sapiens
atagaatacagcagtcagctcagattcctaaacaagcccactaaaatagactgatcacaaacaaacctagactacaaagactagaataaatatctaatttgttaatgagtagacagagatgcatgtccacaaataataggaatatactaggaaaaatggcctcaccaaaaggacaaagcaaggtcctaacaactgatcctaaaccatgtagatgaatgatctggtggacaaagaattcaaaatagttctttgagtaaaactcagtgaacttctagaaaacagaaacaattcagaaatttatcagagaaatccaacagagaaattgggaatcatataaaaaatcaaatagaaatcctggagttgaaggatataata

SEQ ID NO: 233774 - DNA, 384 bp, Homo sapiens
ggactgaatttcattcccccaaaatttatattttgaaggcttaacccttaatgtgactatatttggaaatagtgcctgtgaagaggtgataaaggttaaatgaggtcacaggctggggtcctacttcactaggactggtgtcctttaaagaagaggacaagatgccagatgctctcgttcatgtgccccctttctctctctctctctctcgctggttcactctctctctctctcctcctgccccccatgtgaggatataaggagaaggcagccatctgccagccaggaagagagcccacaccagaacttgaccatgctgacaccctaatcttggatttctagcctccagagttatgagaaaataaatttctgttatttaaacca

SEQ ID NO: 233775 - DNA, 448 bp, Homo sapiens
ccagtgatcctcttgcctctgcctcccaaaactactgagattacaggcatgagccaacacacctggcctaagctacattttaatcaagtcagcatagttatccatcactccaaatgagcatgtccttgtattagtgtccatgcattgtctatgatgtagatggagaggtatagcatattatcaaaacccacctcaaatcctgtgagggatgtgaatcaataaattaatgagtttgttctattgataccaaatggagagagatgagtggagattgatcactatcagttatgtcaaagaggtaagttttaaaccagtgtttgaagttatgtgagagaaaccaaaccaaacaaggtaattaaacttcaaattaactgcttttaattggtcacgtgtgtacatatacatgtttatgagtattttacatttctttgtataataaatcccctga

SEQ ID NO: 233776 - DNA, 470 bp, Homo sapiens
gagatggagttttgctcttgttgcccaggctagagtgcaatggtgcgatcttggcttaccgcagcctctgcctcctgggttcaagggattctcctgcctcagccttcctgagtagctgggattacaggcatgcaccaccacacccggctaattttgtatttttagtagagacgggatttctccatgttggtcaggctgatctcgaactcccaacctcagatgatcggcccgcctcggcctcccaaagtgctgggattacaggcgtgagccaccgctcccggccccctgttaattgttattatgaagttgatggagattacattctattgttgagttagagatctatcagggagataaagcagtatcaccctgtactgttttggtgaccatgtgtggaatctgagattttctttttcttttcttttttttttttttttttttttacatttttaaagagttgggggaataaa

SEQ ID NO: 233777 - DNA, 478 bp, Homo sapiens
gagtctcactgtcgctcaggctggagtgcagtggcacgattccagctcactgcaacctctgcctactgggttcaagtgattctcctgcctcagcctccagagtagctgggaatacaggaatacagggcccgccaccacacccggctaatttttgttgtatttttagtagagacagggtttcaccatgtttcccaggctgatttcgaactcctgacctcaagtgatcaacctgcctcagcctcccaaagggctgggattacagacatgagccaccatgcccagcctctatcactttatttcttatcttggctaacataggagcacctcagtcatttaaaagactaaaatttcccttgtgtaacattttatccctttcctggtttccttccattctattattcagaatggaattcagccttacttaagcacttccaataaaagatcaccgttatacattaggctgccatttattttctac

SEQ ID NO: 233778 - DNA, 368 bp, Homo sapiens
cgttcagctgaaatttatacttccttaaattatgaatgtagtaaaccaaccacagcagtattaccagtatataagattttgtcattaatagaaacatacatttactattattattattattattatactttaagttctgggatacatgcgcagaacgtgcagttttgttacataggtatacacgtggtatggtggtttgctgcacccatcaacccgtcatctacattaggtatttctcctaatgctatccctcccctagccccaccccgacaggtcccagtgtgtgatgttcctttccctgtgtccatgtgttctcattgtttagctcccacttatgagtgagaacatgtggtgtttggttttctgtt

SEQ ID NO: 233779 - DNA, 441 bp, Homo sapiens
acagtcaatcttggcttcttgctaagtaaatattttttagtaaaaattgtcactcttagttcattgaaattgattcagtattctattaatttctgtgttgaatcttggaatggaaagaaacttccaggtgattctaatgtgcagccaaggttgagaaccactggtctagtgaaaagtcatgcatccaaagcacctaaatgtagggactacgtgtaaaaggcattcacaaatgaaaaacatcaaataattgtgattttacattttaaaaaaagaattattcttcgtctgaatatatttatcaccacatgaatgatatacattactaagtattgcaggcgtgtccaaccttttggctgcactgggccacattggaagaagaattgtcttgggccacacataaaatacactaacactaacaatagctgatgacctaaaaaaaaa

SEQ ID NO: 233780 - DNA, 422 bp, Homo sapiens
tcagaggctggcaccatgctcttggacctcctagcctccagaactatgagccaaataaatctcttttctttctgaattactcagtttgtggtattctgttatagcagcagaaagcagatgaagacaaatacttttattataaaatttcacactaactgtacatggcaagaattagaaaactatatgaatctgtaaaaatacttccttggaaatcaatgaatatttggatggaggaatatgtattcatatttttggctttgttcaaaaccaaatgatttgttaaaacatatcattgaaatgtctgtataccaattttgggaagcatgaaacctttctctgtgattggccaactttccatgtacccttaaaacccaaaaatactatcaattatgtcaataataaatatttatatttctgaagta

SEQ ID NO: 233781 - DNA, 339 bp, Homo sapiens
caaactgttcaatggattttttaaattaacaagtaaaagttatgtctatttatggtgtacaacacaatgtttttatatatgtatacaactgtggaatggataaattcaagctattaaacacatgcattgtttcacattttcttgtggtgagaacacaaaatcttttagcaattttcaatatgcaatatattattactaactctagtcactgtaatgtacaatagatgtctttaagttattcctcctaactgaaattttgtgtcctttcactaacatcttcccaatcccccaacctccagcctcttgtaaccatcattgtactctctttctataagttca

SEQ ID NO: 233782 - DNA, 751 bp, Homo sapiens
gaagggagagaaattgtacctggcctcctgaaagacgcagcctctgaaatgaatattgaagactggggaggatttaaacaggtagagacggatggaatggacacagggctcgggagcagcgccagcccgacatcggcggaggagcaccggaagttctgcagcactggctttctttgctcttccacctatgcaagctccttctctcttgtggcttgccgagcctggttagctctgagaccggaagttctgaagtcagctggcatcctacatctgtgcaacctacttctctccccatcccaccacagaaaccagagcctcgaggcttttggcttgggtgctgccttcacagtttaggttttggtaagaagaaagcttatcttcatgtcatgagaaagaaaaaaaaatgtatctttacgtaacgagctgaaagaacaaaacaagtatacctaagccaagtacatgctatctttatttctttatttccacactgaaatttagtcagggataaaacttacttttttaatcacacgaagtttgaaaaataggaagtactatgggaaacacctaatgcatcaaaacccctgtgcattttatctttgtcttatgtttgctggattttaatcttagtaggtttcctgttgcaacaatacaaaaacagataaagaaaaaacttaataacctttcctaccacaaatgtgaacagcccgtgttcttgttggtaggtacagatacagatatatgagattatcgt

SEQ ID NO: 233783 - DNA, 2596 bp, Homo sapiens
agcaggaggagagctggcgggaagacatgcaccccttgaagacccagagagaggccgtctgtctaccgcgtagcagttacatcagactgagacacttcctgtttacaggagactataaaattcctgccccgtgctcatttggggctgacgccattttaggcctcagcccatctgcacccaggcgctcactgaaacagtgtgttgctccacaccgccttgttttgcttgttggcgcgctctcagggttccgaccaatccaagagccttgcagaaagcattaacgtgcttttctctttggcagagtttttctttgctctgatcttggagacatccctctgcctagtggaaacataaggaatacagaaagaatgcaaggagatagaccaacgtgagattctccttcatgcactcaagagaaagatgttgcaggaagagctagtctttcaggctgggctggtgacctgagaaagaatgtccagcttttcttctccacttggcatatcaagagccaggcgtggaagactaaaacaggaaatgtttataaaaactgttcagcggttcgccaacaagaagtggtaaagtagcaaaaatggggatggagatgccaggaggaaagatgccaggggtaaagtgggaaaatgggaacctgaagccaggaggtcaagccaagccaacaggtgttctgtttttcaatgaggaggtggggcacaggatggatggaaactttccacagtcacagaactaataagtggtgctgaggactcaaacccggggaagcccactctagaacccatgctggtcatccatatccccaaggccctggtcagaacacagctaagcagatggcttgggtcatcaggacgtccattacatccaaaggaagacagcctgtgacgtttcaaaagcaaaagtcccctaccagccagtgaagctacctgatttctcagtatcttacgcccagtgacacgatctaccctcaaaacttaaaaaaaaaagggaaacataaacacataacagcagcagcaataattaaagatgagatgagaacaattaagaaaaaaggaaaggtctcctgtgactgttttatttttagggaaacagagaggaagaagaatgatttttcttttgatgactctatatccaactctgaggtttgattaaagaaatgaccttgaaccacagcaaagaaaaataaaagacaatttccagtaagtatgccagttcgaattaatgatttactttttatttttaaactgaattcagcagagatttacatgcattacgatgattaacatctgaaatttgaccttgaaataatctttacattgtaaattcttaatgatcaaaacaaggttctcagtgattaaaacatattagtaattaattattaaaggagaataattgcaaatacaacattcctaaaatctcaaggcttttaaagcatttgtacaaatgactggacattttttaaatttgaaaaaaaaaaaaagccctccatctgattctcattttcattgtcagtgcaacaacaaaaaaggtatgcacttctcttctcattttccactgtctcgcaagctagaaattctcacgactacctttgatcccatcaaagccaaagaaagaaaagaaaattgttctgtacagatatatgacattaaaaaataatcccaaaaacttcttctctaaggttaataaaaggtcggcagttttgatcacttttaaaaatcaatttataaataatttagtcacttgtagatgggacatgatcttcctgctatccctaactactctgatgccaaactggtcatagcacaagtggggctgcatagcaaactgatccgcccaaataatttctactgggttataagattttaagaaataaccatgtctcacaccatagagaaaaacaattcaaccagatatctgtcccatgtattgtaggtactctctgtcaaagctgtaactctttttaacttggatggtctcacctagagtagatttcttgttgacagaaggaaccccagaatgtgtacaggccagggccgattgtgacttccattggccaaggttgtcccagggccaggacaagggccacacaggtgcactagcctcccaagggctgagcatgtgtgctcaaccatctggaggaagataaaagtgcatcccctaaattctgcccaatccagtctcttgtccatggagtttcattagaagtgacaaagttgaatgaagaaaaacaaaaggcaactcgccagaacatttcatctctgtcatgttctgcattgtcaaacattactttttgcaatttgctctttgttgatctttatctttttttccaatataaaggtgcaatatttgaaatggtgcctgtattaattttctatcactgcataacaaatgaccataaacctagttatcttagagcagtacaaatttataatctcacagtttctgtaggccaggagcccagcacatgttaagtggattctctgctcagggtctcacaaggctgaaatcaatttgctagccagattcatcttcatgtggaggttcaactgggaaaagtgccatcttcaagttccatcaggtcaatggc

SEQ ID NO: 233784 - DNA, 838 bp, Homo sapiens
agcaggaggagagctggcgggaagacatgcaccccttgaagacccagagagaggccgtctgtctaccgcgtagcagttacatcagactgagacacttcctgtttacaggagactataaaattcctgccccgtgctcatttggggctgacgccattttaggcctcagcccatctgcacccaggcgctcactgaaacagtgtgttgctccacaccgccttgttttgcttgttggcgcgctctcagggttccgaccaatccaagagccttgcagaaagcattaacgtgcttttctctttggcagagtttttctttgctctgatcttggagacatccctctgcctagtggaaacataaggaatacagaaagaatgcaaggagatagaccaacgtgagattctccttcatgcactcaagagaaagatgttgcaggaagagctagtctttcaggctgggctggtgacctgagaaagaatgtccagcttttcttctccacttggcatatcaagagccaggcgtggaagactaaaacaggaaatgtttataaaaactgttcagcggttcgccaacaagaagtggtaaagtagcaaaaatggggatggagatgccaggaggaaagatgccaggggtaaagtgggaaaatgggaacctgaagccaggaggtcaagccaagccaacaggtgttctgtttttcagtgagtatatcctgtctttccccatgtgtcagtttatagaaagagcaacctaacaggctgccccatataccaatccagagcttggacatgtcctagcaaattcgacagcccacaaagcagtctgggctgggggcggtggcacgcct

SEQ ID NO: 233785 - DNA, 408 bp, Homo sapiens
tagtattataattatttcactcgtcttgctccaaaaagagattggagtctacttgtaaaatagaacagcattttaaaaaatcagtcagaaaattgattgcaaggctttctgagttctggatagaatttcttgtggcagtttaagtggcttctgattagcctccggtttctgtcaaggtttggttacaggaagagaacgtactgatcacatgacctaagtgacctcgcctttgttacagttgttattgatcatttcttaaattaatatattggcgttttggtttcaaaaaatgtaaacggggaaatacatgggcaggaaaatatgagcaagctgagggaaaaggtgccattgtagtgcagtgctcccaatgccagtgcccaggccagaagcatctgaaagcttctaaag

SEQ ID NO: 233786 - DNA, 398 bp, Homo sapiens
ctatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagttcgaccccatactgcatacgcatcagggccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgta

SEQ ID NO: 233787 - DNA, 473 bp, Homo sapiens
cagtgatttttttttttcgtaatttctagaactgttaaaagaaggctttaacacaatatcttcttacacaattgaataaggaaagtgggcctgctcctgagcattgtaggaggtaaaactctatgttttgctcctgattactttggagctttttctcactcagctctgtctgcctttctattgcctttatttgtttacatgcctaactttatctttccagacttgaactcttcaattgtgtagctattacccatatgaggccattgagcatccaaactacagctagtccaaattgagctgtgaataccaaatttcaaagacttagcacaaaactagaatgcaaagtagctcagtgactcatattaattatgtgttgagaggctaatatgctgggttattttttcattcattgtgtgatattgggttacttaaacatttggggtataataaataggttaatttaaatatattgt

SEQ ID NO: 233788 - DNA, 2476 bp, Homo sapiens
  misc_feature (2251)..(2251): n is a, c, g, or t
ctgacctccgaggttttccctgcatttttgtcttcctcttagcgggcgcttggcttccgtcactgtctggtgcagccgtgcccattcttcaattcgaggcttggccacctcctctgagaagccctcttacatgatcccactcaaattacattttctcctctctgctcccatcatgggcatcgcccgcttaccttcagcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggtgaggcctcccccttcccaggtcgggagttgagggaatgggggaggtttccaagaggggcccctttcccactctcacctctcctcccctcttccccaagggcctcccagaacccacaggcctcactggataatgagggcccttccccagtattccaggacagcaaatgatagaaatttttccattttgagcagggcttggtggcgcacgcctctaatcccagcacttatgggaggccaaagcgggtgggttacttgaggccaggagtttgagatcagcctggccaacatgacaaaaccctgcctctacaaaaaatatgaaaaaaaaattagctaggcagtggcacacgcctgtaatcccagctacttgggaagctgaggcatgagaattgcttgagcctaggaggcagaggttgcagtgagctgagattgcaccactgcactccagcctgggcaacagagtgaaactctgtctcaaaaaagacttttctccattttgaattttccattcacatacatttcttctttctttggtgcctaccattcctcatccctactagaattaattctgagactaggctagttgggtgggccgtatcttcaggtatgttaggggacatggcagaaagacacagatgacagtatcccaaataccacatggccaggaagtacagtggcatgtggcctgtgttgtcacaccaggccctgtgctcagggggccccatgcttggtttcatgctctgctattgccaccttgaaattcttactagctttttagcaagagggcccatggtttccttttgcactgggcgatcatgtagccagtcccaaatggtaggaatcccaacacatggcacccacaacagcagaattaatgcacctgtgtgtgtgtgtgagtgtaagggggtgctctcgtatgatggcataacacctaacacatgcatgtgtgcaaatgagtgcacacacacagaaggggtccagaggggagaatgccaccaacagaggggctgtggctgtgtgagagggacagatgcctccgcactgtgacaagctgagaaggaaggtcacatttagtgaccctccgacctggtgctatacttttcctgttttatctcatttgaccttcacaaccatgagaggtaggtctctttatccctattgtacagatgagaaaactgagtccagttaagttcggccccttgtccagggtcacagagccagcagatggcagagtctctctgccctgtctggaagctcctatttcttgatatagtggttgctgagttcatagaacttgtcacccaaaatgataccctgaaatgggcaggaaatttctaaagcaggtgagaaacaaggcctgcccaagaaaagagaaagaatttaaaattacggcatatctatactacagaggaggcggtctgtccatgtcaatgtaaaggatcaccaagagatatgtttaggtgaaaaaaaaggaagtagcagaaccacaaatatgttttgtgtaaaaaaaaagaaacaaagaaaagaaaagagataactatttatagatatactataagtaaatgtttttttaaaaacatgtctaggttctggggcggggaggaggggatttaagaaaggggaaggcaggatggaaaggagctctcatttttttgtttttgatcctcccacctcagccttttgagtagctgagactagaggtgtttaccaccacatccagctaattttcttattttttgtagaggtgaggtctcactatattgcccaggctgctctcaaactcctgagctcaagtaatcttcccgcctcagcctcccaaaactgctgggattacagcccaactgagactcccatcttttaacactactgcatatgcttcagattgtttgatttgtatgagaatgcatttatnaatagtgttttaaaaaatacagaaggcaccctaggcaacatggcaaaaccccatctctacaaaaaatacaaaacttagccggacgtggtggtgtgtgcctgtgatcttagctacttggtaggctgaggtgggaggatggcttgaatccaggacttcgaggctacagtgggctgagattgcaccactgcactctagcttgggtgacagagcaagaccttctctcgg

SEQ ID NO: 233789 - DNA, 451 bp, Homo sapiens
cagatggtagtaaaatatgtacaatgatagctttgcttcacacatacactcccctcttgacccacccacacaactgttaaaatttttgcattaagaaccaaactggttacaagcgtctatgattattggtgtggaaaatgcacataaatacaggcacataaactatccagatgactaaaggagttatgtttgcattatttctcaaaacaatttctgaaagcagttgtggttgcagtgagttttgtccagctttatgactatggaacaagtaagattcttcctttatgtgtgtacaccatttacctttaagataaaatcatgtccatgaggccaggtgtggtggctcactcctgtaatcctagcactttgggaggctgaggtgggaggatcacttgagctcaggagttcaagactatcctgggcaacacagtaggaccctgtctccacaaaa

SEQ ID NO: 233790 - DNA, 480 bp, Homo sapiens
taagttgtgatgtccctagacttgaaggatattccttcctttaggcaatggtatactttaactagctcccatgggatatttagtatttgtcaatttccctgtggggcaatttaaacttttgctttttactcctatgctggaactgtggctaaattactatatcttgcagaaattagttctacctctttatgaagatagtctcatccggaattgtgcaataccaatttgaaaactaatgacattcatgatgtggttaagagagcagttttcaagatcagactgattgtgtttaaatcctaactctattattaaatagttggttaatcttagttaatttttaacttctcacagcttctgtttttctcctctgtaaatggaaaataataattagattaaataaaataacacatgaaaacacttagcatggagggtggcacagagaaattatcaataaatgttagctattatggttattatatt

SEQ ID NO: 233791 - DNA, 324 bp, Homo sapiens
ccatagcacagtcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgttaccgggtttcctttctgtttcgtattctgtattcagcacatgttatctatctatctatctatataactataaccacacgccgtgtagacacccgctgccacacactacaggagtcaataaacaaggtgcaatattttcaaatcg

SEQ ID NO: 233792 - DNA, 196 bp, Homo sapiens
ccaaatcctacacgtagctgcttcccctttcaggttgataaaatgatcaacctgagctagtctatcttgcactgcttctcctgcttagaggtaattgcgagtgttagatgttgataaacagcaatgtagtaatgatgtgaaccagtcaaaaccttaatcctctccacctaaaatacgatcacatcacttccttttt

SEQ ID NO: 233793 - DNA, 658 bp, Homo sapiens
ctagaaagagaatgtggaatgtacaggtgccattgctctgtctgcgctcagatgtgtctgtgtctaggatctcttcagcctggtaggattcaccctaacagtaattgtgacatctcataggcagatagcattagcatggtctctggtcataagagtgaatttggtgacacacaggaatgcctgctctccacttttgcctcaggaaaggtctgagtgctgatcttggcaccctaggatccctctgttgtaagatcaagtctactaatctgccctttgcactctgggcatcctacatcgggcccccatgcagcaacccgggttcccagggtaagactgtggtggctgcagggctccacaggtgtcatttgccctacagctggctggggttctgttgaaaggttcagaggcttcatgcagctgcctgctgaagtcatccattcttgtgttttgttgaggctgtgcagaggggcttcatgtagtcttctctgcacccacagccactccatgtgagctgcagcacttgttctcaaaatggtctttccaaagtctctgatgtgagttgcctgtaagaaattgatagtaatgtcaattaatccctagtatatagtatctgtctttgatatgcttgttgttgcatcacttaggtcttaaaaaaaga

SEQ ID NO: 233794 - DNA, 481 bp, Homo sapiens
caacaaatgtatgagggtagccattgcagagaacaggttcattatcacattgctaaacagaaaaagtagtttccagaaaaacaaaaaaacgtattttttcaatgaaataaagtatatgtaaactgttacaaagaagaaagaatcttgaaaaatacatgtaattacaaggatgagaatttaaatttttattctatataattctgcaatgtttaacttttcacaaaagttttcatgtattaattatgagatttaaagtttaatttgtgaaatgaacacagcaattcaagacaggaagttccaaaatgtaacatcacaaattaatttattagtgtcattcaaaaaacttgataatgtttcttgtatgttatctattttatccacttgcagcttgtttttagaacatttgttctgtttttgaaaatatgtttgaataaataaaatacaatgtttaaaaattgcagtaattgtagaaatctaaatt

SEQ ID NO: 233795 - DNA, 145 bp, Homo sapiens
tctctgaaagatgtgacacagatggcaatgctctccatctttgtcccctctctcaccttggcttctgggccaccactgccggtggtccagtggtttctaactgccttttaactttctattaaatgctaaaatgtttgcaatgttc

SEQ ID NO: 233796 - DNA, 431 bp, Homo sapiens
tggagagaggttcatgcagtaaggtctcttgtgctcagctatgcaagtgagtcatcttggaaacacattatccagcctgaatccagacagtttcattgtaaccttatgagacactgtgagccagaatcatccaaccaatcttctcccagattactgacccatggaaattgtgtgagagaataaatgcttattaatctttttagtatctaacttttgctttgcagcaatggtttactagcatacaaaccttttgtttgactctgacacatgctaaattttgaaaaacattgagctaaaacattcattcattcaccaagtaattattatttgtatctgctatgtaccaggctaacagcagaaatacaatgatgagcagaacagacactgaccattccttgatgcatccttttcttttccttcgttggacttat

SEQ ID NO: 233797 - DNA, 518 bp, Homo sapiens
cagatttaaaatagtcttaactttttccattatttcaactgttttggaaagcaacatagtatttcctctgaatagagcagtgagttcagaagatactcttaacctttggtccaaattcctacctcttggatttgtgaggaggaaataattttagatgagcataattatatgcccaaatatttatattgtattgtaatctatactactagtacgaaatgagagaaatggtttagtaaagtataagacatcaacatagtaaagtattctataggtttatgtgttggaattacaaagatgaagaaaagatacaggcaagtatttgatatagtaaattaaaaatagcaagatgtagagtagtcatgtatacagtgatagcaagaacatggatccttaaggacaaaactgaaacataatgcaaaaaaagaaaaatatgcaaattatttttcgtatgatgtaagttgtaaatatttaaatggttatcaattaagagtcttggtgtggcagatgaacatttgcta

SEQ ID NO: 233798 - DNA, 616 bp, Homo sapiens
tacactattttttgctctcgtccccgctactctcgaacaggagagagagagagcggcctcgttcctgtctcaccactaatagagaagtaggtactctgcgcaacctgcgtattgagataagagtcatcgatcatgtttttgttgtctcctctcgtctagctccttcactgccggcgtgtggctttcggtgaccagatctaattccatcacttcgaggcgcaccaccgcgcctgtctattactttccttcatatatataaattcacgatcactgtttctttcatatatagagtgggtcctcactctgccttgttttcacatcacacaaataaaacagctgtttggatgatgcgtgcgatataatatttgtggcgcgcgccttcgtagagggagaattgtgtagtagcgggcgccgccgcccttttttttttttttttttgtgtttgtttttttttgtttttttttttgtttttttttttataatgtgttgtcgtgcacggtaagaggcaatctgtctttaagtagggataaattactctaaaacaaaaaagaatcctagatagttttcccttcaagtcaagcgtcttgttgtttaaataaacttcttgtttaaaaaa

SEQ ID NO: 233799 - DNA, 478 bp, Homo sapiens
agcaataaaaaatagtatatccaatagctagtagaaaaaaatccaacccatagtttaaaaccttcctaacaaagaaaactcaagaacagatgtctacctgtaaattcttccaaacattagaaaaaaataccaatctgatagaaattcttcctgagaatagaaaaaatgagaacagcacccaaactattgtatgaggtcatcataactttgatatcaaagccagtccaggacattaagaggaaagaaaaatacagggcaatctcactcaaacacagatgcaaaaatcctaaactaaatattagcaaaacaaatgcaacaatttatataaaggataacacattacaactaagttgggtttattccagaaatgtaaagttactttaatatgtgaataaggagaaaaatcaatagatacagaaaaaaaatttgatacaatttaatatctgctcatgattttaaaaaaccagaactcagcaaa

SEQ ID NO: 233800 - DNA, 427 bp, Homo sapiens
aaagaattgcactgagaatttatctcagcagagtgtggtgaatttggatgaatcatttagccttgggccatgaggttatcccaactataaaataagatccctcttagttttaaaattctgtaaatatgcctctctcaaacattgtaaatattgttttaaagtgaggtacaaattccaagggaaaaaataaaactttgactaggcaattgattccacaaacatttattaagtgataatcactgtgctaagtacaacaggagctgtagcccttgctctccagaggtctggcgaaagagatatgtaaacaagctgttacagccatgtataagtgctctaaaaaaagtattaacaaggtgtgctgtggtacacaggaagaagttgcttcattcttctggagatgttacagaagctttggacataaaaaaaa

SEQ ID NO: 233801 - DNA, 251 bp, Homo sapiens
tcctgctggtgagagactagaaactggttcctgcaagagaggaatgcaaaacggagaatattgagatagcaaggtagaattgctgggctgtacagacaacggtggggcttgtgcaattgctggaattcttatcagaaggctgctacttagttaaaatatgtgttcttcctttgtccaagatgcatttattatccacaaggataaaattaaccctcagtccctccggagtgctgcccacttacagtgcacaa

SEQ ID NO: 233802 - DNA, 337 bp, Homo sapiens
agactcagtgtgttgtgaaagaatatagcagcatgcagcgcaggtgccagaaacagccttggccccatccatgctgtatctctacacttaccactcatagacacatttgcttgcaaatcccagggaagtataaggaatatgtgctagaggtcgactaaatactggaatttatacaattattagaatttccagatctagagtaggaattcaagctacagctacagggctaagaatgtgattaataaaattcactgcccttgtaagagacagatgtcttttagacccaaatctcgaatgtgaattaattacagcatagtaagtggtgttcacatatcta

SEQ ID NO: 233803 - DNA, 580 bp, Homo sapiens
atgaatgctttcattgaatcaagtcatatactataggttgatttatagatgtttattaggggaaaatagtataaacggaatagaacataagaaatagacctgggaatttctgaataggagctgcttggtctgtaacatttgtatgctgcatacccttgggcatattctaagtattagagataatctatgtaaaatatttaggacagttccttctacataatgagcttttgataaatagtggagtttatgatttcttttattgctgctgttgttattattaaagattaccaatatgtttaaaattattgccaggcttacactctttaatttaattctcctagatgtttttaaagaaaaaatgatacaacagaattaaacatctttggctgtcaaactgaaaccaacatttatctctgtttagtttccgctgttttgaaaacgtgtgaggttacaggttagggggagtgaagagttttccaaaaaagtatgaagatagggtgacaagagtttgaggttgcagtgagctatgaccatgccactacactccagccttggtgacagagtgagaccctgtatctgg

SEQ ID NO: 233804 - DNA, 616 bp, Homo sapiens
acgagggcggagacccggaggaccgaagcttacggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccaggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagagccgaacgtgatgtctctttccggtgacacccattggagagggccagccattccgtggagccactgattttgagccacgccgtggactgacccgtggggcattgaaggctccttgtggg

SEQ ID NO: 233805 - DNA, 1172 bp, Homo sapiens
  misc_feature (829)..(829): n is a, c, g, or t
  misc_feature (884)..(884): n is a, c, g, or t
  misc_feature (968)..(968): n is a, c, g, or t
acgagggcggagacccggaggaccgaagcttacggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccaggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtgggcgagttcctgttctgggcttcgctgtgcatgaccatctcagcaggatggcgagganctcatcctctactgaccaaggaattcagttcgtgcagtctcagatgcctacaganggaagcagctgatgcccagaagaaaaacccgacagttggagctgatcggagcagggtggcgtgtgtgggcgggggtgcgggtcngatagccccagggactcccgacctcacgcaagacttcggaggcagaccggtgagggcacatgggcggccagggcacggggcctagcgaatccaaaacgggagccaccaaggtggcggactgaggcgaggcccagcagccgaggttgccggggccccggggggcacccggagggggagagtggccgagggcacacagagagaagg

SEQ ID NO: 233806 - DNA, 153 bp, Homo sapiens
caggcttctcagggtgggatgaggagcctggtaagatagtcacatagtcagcctcatgaaatatgactccccattcacctgccccctaaactgtgcttcctcaggtaagatctagtaaggcagcccaccagagcctcgctgcatgttgaactc

SEQ ID NO: 233807 - DNA, 472 bp, Homo sapiens
ctcatgccacaagtgaaacattccacacctgacctcatgtattaatctgtttccatgctgctgataaaaacatacccaaaactgggaagaaacagaggtttagttggacttacagttccacatggccggggaggcctcagaatcatggcgggaggcaaaaggcacttcttacatggtggcagcaagaggaaaatgaggaagaagcaaaagcagaaacccctgataaagccatcaaatctcatgagacttattcactattaggagaacagcacaggaaagaccggcccccgtgattcaatcacctcccccttggtccctcccacaacacgtgggaattctgggagatacaattcaagttgagatttgggtggggacacagccaaaccatatcacctcatgtgacaggttgcagtcacaatgtaaccaaaatttcattacatttacaaactattaaaaatattgtataaaatta

SEQ ID NO: 233808 - DNA, 170 bp, Homo sapiens
ttatgctaggcctgcagagacatggcccatggataagatgctacaaccctgtgtatatttgtgagattattcggctaatatgttgtctccctgatctgtctgctttgttcaccatttttcttaccagctcctagtagaagggaaaaaaatatttcctcttgttcgtgtga

SEQ ID NO: 233809 - DNA, 436 bp, Homo sapiens
attagcattggagagtcattaaagttctcatatatagaatgcaactaagaatactcatttgcagctcaactctgcatttctaaaaaaagtcattatttagaagacaggtgacagaatataatttctatcatcatttaaaaaaggagagaggagaggaaggagagttagaggaagagatggaaggaagggagggagggaggaagaaaagagcattcgtggtattgtggaaaatcaactaaatgggacctgttgttctttttgtaaaatgccaaaacttgccacaaatatgtctgataaaatctctttcaaagaggtaaggcattactgtgaatttcttcaaaccgttttgctggtctatatattgatatatataatcctatgcccccaaaatactttccagtatgaactggttagaaaagaatgtttgtttgcttaa

SEQ ID NO: 233810 - DNA, 608 bp, Homo sapiens
tctgacccagcactaagaaaaggactctgttttatcttttgcatatcccttgtgtctaacacagtgatgatgatgatgatttttttaaataacctttactgagcatccagggtatgccaggcactgccctgtgcactttacgtgtttaactcattgacgctatgggattgctaccattattatctccatatggcaggtgaggaaactggagcaggagaggttaattaacttgccaaaaggttagctcctaagcagaggagccaggacttaaggccaggcagcctgactccagagcccaagttctcaactccttgcttcaatgacaagagtaagactcactaaagatgcaaatgtctgtgtttttaacaggtgggaaacaggtccagggtcacaaaccagtcagcggtaggtttggagactcagtgagtatctccagctctagttcaagtttctctgtaccacacagaagtcaccatgaacccagcactagaaatttgcctttacacaagaaataataggatgctgaaaaaaaattgcaatgtaaagtgataacagagagaatatctgaaatctgaaatctgaaataaattttcatcatttttctttca

SEQ ID NO: 233811 - DNA, 638 bp, Homo sapiens
caacagcagaggctccagtggtggtgagcagtgtcagtgatgtcggcgtaacacactcacatgcctgtgccacgcagcactgtcatcactaaagcaatatagaagtgtgattgattcgaggcattattcttgtctatataacttcggagcccagttctctagtcctcccagaggagatataataatgagaaataacatatttggtcccttttatcatggaagctttaataggaaaaatagagtttaatcaaataatcatctatgcaattcatcagggtcactgacgacctccacattgctagcacccatgatgcatccttagtcactgtacctgaccagcagcattttacccaactgctcaatccctcttccttattctactctctttccttggctttcaaggtatggcaccctaagcttttcctcctatcttaccctaagcttttcttcccaactcctcaggagtgtcccaagcatcagtcctttgtaggcttctcttttccacctatactcattcccttggtatttaccgttcagtatcatgcacatactgataactcccaaatgtttacctcctactgaaatccatactcgtatgtacctttactttcctggagtatcaaatatctgccccactg

SEQ ID NO: 233812 - DNA, 268 bp, Homo sapiens
acattgaaaactttcctccactccgcaagtattcactgagcacctactgtgtgccggagacactgcagtgaccaaagcaaaggcattgcccccgtgcagcttgcatcacagtgagtccataagatgctgtgcttggagggactagcacatagtaggagctgtaaaaataggacttgctgttttgctagtggagccagtcacttgtgtgaattcatcttttgatatttgagagtgatgatgatttaaagaaagcaggtgagcctccgtt

SEQ ID NO: 233813 - DNA, 603 bp, Homo sapiens
gaaacattttggttggcctagaagcaagggtcttcttttcacaggcaagatttcctattcaaaatgaaatccagtgaggagatgggagatggctgaatatggggaggaagtcagccacttattcaaaacaaagaatgactcccaatggcagacaatgtattgtcaggaattgctgaagatggtgaaaattgtcttactcattgtgatgtttgtaaaggcagcaatgaattcacgggatttttgtttgtttagtaaacaggcaatgagagtaaccatgagacacatatatatgctatactagtttaactatttctcttccctcctgtcataacacttacccagctattttgaagcatgagctcttgggccacagcttatcactgatgttctgacttcagtagatagatgctcctctaacatgttcctccacttccaacccaataaacttcccactagatttagaacttgctgaatttccacatcttaacatattttagtagaataaagtagctcatgtttaaaatatatttagaaaagttggggactcaaatgctattctttacctacacttctcttctggtgtgtgtacaaaatagtgtactc

SEQ ID NO: 233814 - DNA, 456 bp, Homo sapiens
cattctgtcctcattgatgagagaaaatttggaccacgaaacaactgtacataatgagaggcagtacaaaggaaacactagctctgtggcatagaaacagcacaggtgttgagagagtagccacatcaagctcataagaagaggtgggtcttgaacggagacgtaggaaatgaagaaggcgcatagttgcggcaaggaaaattcaaatttgtagtagagcttggaaaaagaaaatcatttttaaaaggaaatatcaagggcccactaccatgatatgcccaagatccatgactacgggccttctgttaacttcctagtgggtaacagagcagtggctggtaccagaggtgtataacggtgagatgcatggtcttggagtcaaatacaaacccagtcatttactggttgtataaacttgaccaattaatctctcaagcctcagttttcttgtttaaa

SEQ ID NO: 233815 - DNA, 336 bp, Homo sapiens
caggctagtgtgagaaaggacttgagcctttggaaacggcctgtagaagtagggacaccaggctgccgagagcctggagctgtgacccaaacgtattaagaaccaagggcaaataggcaaacagtctttatcctctattctgggtggaaaccagagtttattaaacagcagttaatacaagtttaaagttagtggcaaatatgcataattgtacttagggtttgttttcttttcattcttgcttcaattgtatcatgtcaactatatggattcgtttttatatttgattattttcataaacaatttagtaactttcagtcctctgtcaatgtagac

SEQ ID NO: 233816 - DNA, 423 bp, Homo sapiens
tgatttttcccagtgttttgcatgttttgagtttttaatatcaaaggtactgctctttgtaaacaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaagatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttcttta

SEQ ID NO: 233817 - DNA, 134 bp, Homo sapiens
tccctgcccggctctgagagttaatgagacgataccagtgtgagcccccagcacagggcttgacacacagcagatcaaaaaatactttcactgattttcaaaataaaaggacaacagtatcacctgggggcaac

SEQ ID NO: 233818 - DNA, 257 bp, Homo sapiens
agtggccgcacatttcacattttcaccagcaatatgtgagggttctagttcctccacttcctcaccaacacttacctgtcttggtttttgtaactatttaatagtgaatgtgaaatggtgtcgctgtggttttgacaattgttgatcttgcccagaacatttattactgcagtatttcccaattttctacttcagttattccccctgtatttattaattggagttatacagtaaaggagaagagtgtccgtccccca

SEQ ID NO: 233819 - DNA, 169 bp, Homo sapiens
acatagtaattacttcagtgtccaaaatgaagtttaaagtaagttcacgtaatccttccaaggctttaatctcatagcatgttttgttcctgagttagagctgtaaaagcaattcacagtacattgcccaagagccatgtgttcaaaaatcaccagaggttattccggg

SEQ ID NO: 233820 - DNA, 353 bp, Homo sapiens
ttatctggacagttatacaagctataaaacataaagaaaggaggaaaattatgtgcttttactcagactcagaaatactcctcaacatctgttggaaattgaggaacggttctttccagttagtgacaggaatggggaaacaagttgacttcctgtctctgcagtggcatatttttacaacacaattaatatttttttcaacaatttctagtcaaatttgaagcataacttactttgatgaaatactataagttcccagatgatgcacattgacatctatttttcctttcccccgtcattcttgtgcagcaatttatcttattgcattaaaacattagaaaatgcaaataaga

SEQ ID NO: 233821 - DNA, 178 bp, Homo sapiens
tataattaattttattcctgtgcaaacacactatctgtgtattctctattttaccaggattttttgtttttgctaaattagacatacaattttgcagttattttttactaagttgacaaatgtttgtacaatttcagtgtaaagctagtcttcaaaataaaccactgtgaagattgga

SEQ ID NO: 233822 - DNA, 296 bp, Homo sapiens
gctgggctccaagctccttctggaacttcccttcctaccattcgccccaacaatgcctgcttcttaaacataccctcacacttttcattagctaacacacaacgtatatgtttgtttattttgctattgtctctctttctccacttgaacgtaaactctctggtggtgaaggctttgagtgattaactgcagcatccccacctctagaacaatgctggcccttaacaaacagccaacagatattgttggatggacttcgatgagtgtgatccaggatacttctaagaccagaaata

SEQ ID NO: 233823 - DNA, 447 bp, Homo sapiens
caattatagaatttcttgtatatttactaataaatgaatgctaattatcttttatgtaaatggcattttatgccagcaagatgttttatatgtacatatgcacacacacacacgcgcgatagagcgatggctaaataaattgtgatttattcctatgataggatttatgtaactattaaagaagttgtttataaaagtctttcttattgttaagtgcaaaactaggattaggatagacgttaaagaaaaggatcatatagtgtaaaaataaacatgtatattagtagaaagagaccacaaagtgttatgaaaaaatactaactatattaatctctggcaaataaaagtatttgtgttttagtttttcttttttttatttttattttcttgtgtcgtattcatatttcaattattaaaaaatgttgttctagaaattgtgaaccaaaa

SEQ ID NO: 233824 - DNA, 386 bp, Homo sapiens
gtcgccaggctggagtgcagtggtgcgatattggctcactgcaacctccgcctctcgggttcaagcgattatcctgcctcagccttttgagtagctgggactacaggcacatggtaccatgccagactaatttttgtatttttagtagagatgggattatcactatgttggccaagatggttttgatctcttgacttcgtgatccgccctcctcggcctcccaaagtgctgggatttcaggcgttagccaccgcacccagcctggacttgtctatttcatttggagaacttcaattgatctaaatctactttgcagcttttcattgttaattttgaatttatttaaacaagtaaaatatttaagacatttgtgtggaaaacctgta

SEQ ID NO: 233825 - DNA, 549 bp, Homo sapiens
tttgttatgtctctgctaggttttgatatcaggatgatgctggcctcataaaatgagttagggaggattctctctgtttctattgattggaatagtttcagaaggaatggtaccagtaaaaatatggaacgcttcatgaatttgcgtgtcatccttgcacaggggccatgctaatcttctctgtattgttccaattttagtatatgtgctgctgaaataagcacaccacatttgtctcttattgtttctacacacattacttaagctcaacccacctaaaaacattatttctattttattaataccccagtgtttttactaatgttgttgcctctaccaaaactattcttaacaactatccccatttgtcaaaatttttacccatcttggttaacatctacctatctgcaatattatttcatctagactccccttctacttcccatttctagattattctgaagcaaactcaagatgtcacatcactttatcttaaatatttcagtatctctaaaagatactgaaaagataaaagtactatttaaaaag

SEQ ID NO: 233826 - DNA, 1180 bp, Homo sapiens
tttgttatgtctctgctaggttttgatatcaggatgatgctggcctcataaaatgagttagggaggattctctctgtttctattgattggaatagtttcagaaggaatggtaccagtaaaaatatggaacgcttcatgaatttgcgtgtcatccttgcacaggggccatgctaatcttctctgtattgttccaattttagtatatgtgctgctgaaataagcacaccacatttgtctcttattgtttctacacacattactttagaaagagaaatttcccttcatcaacaatttggttactcagagatacagtacatatagagaaagcagaagaaatgtttggttctatttaccaattttcaaagtaacaagttggtttgctggcatactgtaagttgaccaattattttaatatattatgaactcatgtatttaaacatatttgatgttttaaaccattgcagttctctttattgatgcttaaattgtgtcatctttaacagtgagaaccaattcaaatgttggctcttggatccttttgagttgtttttcatagctgccttgttttccagtatgacaaaatgttccatgctcatattgtacatttcctgccccataggtgaaatctcccatttcttcaaggatttttagttccttttagtaggaaatgggagtgtagagatcacattctgggcattactggattggtcattgtttctgggccttttcggtaaacaaagctagattttgttgctgttttgtagctttatttaagataaagtactttaggagttcatactgatacttccaattcaagcccagaatttacttaacttcactaatcttacatgtatactgccttcttggatttttttctgatcacctcagccagaagtgatcactcttcctttgaaccacatcacccacttcaacacttttatagtaatcaacacattaacttttgatttattgttatttctatatatgtctgatattctctaccaaatggtaaggaatttgaggatagaatccatcctttgttaccctttgttaaataaagataaaattcctaaagtgctgatatatttcctgacatataaataccactttctctttgtattcctttaaaaatggaaccatattatacatgtactaaaaattaataaatgagtgttaaatg

SEQ ID NO: 233827 - DNA, 488 bp, Homo sapiens
gattacaggtgtgcaccacaacgcctggctaatttttgtatttttagtagagacagggtttcgccgtgctggccaggctggtctcaaactcctaacctcaagtgatccgtccacctcggcctccctaagtgctgggattacaggcatgagccatggtgcccagccagaatcttctttgaatagatgtaggtatagagagaggattattgattttaaaagcacaaatcttacgtaattagattaagtacatttttaccatattctggaattctaagaattggaaggcagtttaaaacctgaaagtggcaaatttaagattaataaaaggaagcacagagtggtagtgaatgaggaaagcttaccactcttattcttaaagtattgtaagttgggaaacttatggagttcttttttgttttgttttctttttaaaacacttgtccagagataactttgcttcattcaactgagaaaattccatcctcatg

SEQ ID NO: 233828 - DNA, 367 bp, Homo sapiens
ttcgaatttttctttgtactcatggtttatttagtagtgttttattttcagttttaaaaaaatttggaaatttttgaaataactgttattgctttcccatttaattccattatgatcagagaaaatattttgtatgacttaaattattttatatttattgagacttgtttcagaatccagaatatgctctatcttgataaatatttcatgttacgtcaaaagattatatattctggtgttgctgggttgtggtcaataaacgtcagtcaggtgaaattggttattattgtttgagtcttctttatcttcgttgattttatgtcttttagtttatcaattattaaaagagacatattggaatccgtga

SEQ ID NO: 233829 - DNA, 539 bp, Homo sapiens
acaactacacccaacatgagtaaataatacagacataatcttcactgaaagaaaacagatacaaaaaagtatacgtatataacattcaagaacaggcaaatttatggagaaggcagtcagtaaggggtttatctttgggggttgtaatactgaatgcgagtgagcacatggaagaaactagggttctggaaatgaactgtatattaatttggacagtggttagttttacctttcatatctaaattcataaatacttaagtgaaggtattcataatagatacccaaattaagaaagttcaaagttcattttcttgcttaggtttaaaatttccaatatttatcacaaaataaataagcatgtaggatcaagtttttagagtagaattttgcaggtaatttgaaatctcaagccctatgaaggttactaaaaaaaaaaaaaaaaaaaaaaaaattcctaaaatagaaacattaaaaaggagaaataagatttacttcacaaaattactcctttggggtcttgcagtatgatatatatgagt

SEQ ID NO: 233830 - DNA, 635 bp, Homo sapiens
aacctctataaactgaacttcacaagcacttatttaaaaacaagaggcagagatggaagaagcgcatatggactttctcttaacatcccacaggggagcttgccctaattctttttctcctgaaaattaactctcttgggctccaaagatcaactcagcttcacctaagaggttatgtactgaccttcctaacgatcaaaggcttcagagacactgaattgatgcgtctaaaaaaaatagatacaacgggccaggcgtgatggctcacacctgtaatcccagcactttgggaggccatggtaagaggatcgcttgagctcaggagttctagaccagcctgcgcaacatagggaaaccctgtctctactaaaaaaaataagaaaatttgccaggcgtggtggcatacccctgtagtcccagctgctcaggggactgaagcaggaggatcacttgagcccagcaggttgaggctgcagtgagctgtaatcgtgccactgcactccaggctgggcaacagaacgagacctcatctcaagaaaaaaatacaaatttagttaagtagagtataaataatctaaaatatggctccttttagaccttctttgtgaatattgaacacatgtacctaagacggt

SEQ ID NO: 233831 - DNA, 521 bp, Homo sapiens
catggtggcgtgcgcctgtagtcccagctactcgggaggcagaggttgcggtaagccaagagcacaccattgcactccagtgtgctgacagagtgagactctgtctcaaaaaaacaaaaaaaaagaaagaaagggcacgtgttatagcttagtgcttaaaacaggtatctggagccagattattaaccaggtactttaagcaaacataacctttctgagctttttcttatcacctcataacattttattaaggtttaacaaggtattaggcaacaccatataaagttttgctagtatttgacagttttcatgttataagaatgacagctacatgtggctcaacctaatgaatataaagtgctttaaaaagggtccctgaggccaggcgtgatggctcacacctgtaatcccagcactttgggaggccatggtaagaggatcgcttgagctcaggagttctagaccagcctgcgcaacatagggaaaccctgtctctatcattttcgggatcctctagacag

SEQ ID NO: 233832 - DNA, 319 bp, Homo sapiens
aacctctataaactgaacttcacaagcacttatttaaaaacaagaggcagagatggaagaagcgcatatggactttctcttaacatcccacaggggagcttgccctaattctttttctcctgaaaattaactctcttgggctccaaagatcaactcagcttcacctaagaggttatgtactgaccttcctaacgatcaaaggcttcagagacactgaattgatgcgtctaaaaaaaatagatacaacggccgggctccctggctcacgcctgtaatccctgccctatcgtacaccccgcccgtcgctacttacctgcat

SEQ ID NO: 233833 - DNA, 249 bp, Homo sapiens
cggcttgtggatactgacatagttgcaaaacacaatacttaatactttttctggaggagggggcccatgaaagtcacactgggtccctttgagccctgtgtccctcctgggcacgagtctgaagtgttgtgatgatcggctcacatgactgccttctccaccagacagtgggccccgggagggcaggggcatgtcttacattgtcagaacaggcaagcggtaagtatttgctaaataaataaatgctta

SEQ ID NO: 233834 - DNA, 2143 bp, Homo sapiens
  misc_feature (1525)..(1525): n is a, c, g, or t
attacacccctaaaatctcttcacagcaattcttagattagtgtttgaataagtaggagaatacatcagaggctgggaatcttggagggccatcttagaattctgcccaaaacagccagatatttaactatgtgtcctgttacttagcacccattagtgaaaaaacagataaaaattctagtccacgtggagcatacattctaagagagtttaaggggaaaagtgtctatactgtttatttgtattgtcttatcacttccggagttttaggagatagccagatataaatagtcatcagaataagcaaatatacctgttttacattttttatcctcagctagtattcagttaactatttttaacagatggcattttttctctgtatgtgcttataaatgtgtatataatgaaaatgtccgagttgtgttgagcacttcttttttttattttagtcccatggaatttccaaatgcgggaagggacctcaaagatcatgctatattttgttagcatttaagagtaaggcagtcaaaaagagacttttcttgtttatatttaatgaaatgccaaggtgctattagatgttttttgaatatgtatacttcttttcaaatgatcacagatgtgaccatccctaatgagtgcatttcttgaaatagagcagaaactcaagtaacaagaatgggcaggataccaaggaaacagactaatcaggcagatggtgactattttgtagggaaagtctgagtaaaccaatagctctacaacagggatctgaaaataaaggaacattagtgagcatgaaaaaaatgtttttttcatattttttcattaccttataaaaattagatttacatacacatttttacctattaccacagactatatgatgaaacttagtttttctttcattataatgttttcatattagcaaaattttgtcaaaaaacaactttttcataattaagatgcagtaatggatttccttttttttgctctaccttctgagttcttgcaatactttttgaaacctattggtcttttaaaatttcttaatcattttgaaatgaattgatttttaaattgaataaaatagatttatattttgtgtaaaatataaacatcacaataaactgaaatacatttgccaaagaacaacatttttttgtaaaaaaacagaagtaaaaaaacatcctagcaggaaaccaggaacggaataaaaacacaaaaaggtatctcgggcacaatgccctgaaggtcaacaaccatggccaagagcatgaggtaatgtcaggaataagaaaacaccctgggttggatccttgacactctgatcctaagatcattagtgattgtgcaaaaatgtaatgtgtaaagtgacttataaagttgtcaggtgaatgttgcttctcatttctacttgacaaaaccctggtgaggcaaagcagttcttattcccattttacagatgaagatatacatatagaaaaattagtttgccaaaattcgtagttgccagagtggnagagcaagaactaaaactgagtcttctaattctgaattcagtgcaccttgggatttaagaatggaatgatcaggagacagagaggttatcagttgaagaaacaaacttttttccacttagcatcttaatatatacatagcctgtatttgactttattcttactatagcatactgcatttagtgtataaagataatgctttggggttagtgttacataaaaaaaatccctgtccttagtttctttctaaaatttgtgaagggtttaaattgtttcatggacatttcattgcacaaatttgtttctcttcatatgaactgtaagaaatcaaaaagagtggctggatgcagtgctcaagcctgtaatcctagcacttttggaggccgaggagagtgtatcacttgaggtcaggagttcaagaccagcctggccagcatggtgagaccccatctctactgaaactacaaaaaaattagctgggtatggtgtcatatgcctgtaatcccagctactcgggtggccaaggtgagaggatcgcttgaacctgggaggcagaggttgcagtgagccaagattgcaacactgcactccagcctgggtgacagaatgaaactgtctca

SEQ ID NO: 233835 - DNA, 145 bp, Homo sapiens
gaacaaagtattatagtatcatttcccaaatttcatttaactgaacactttatcttcagctgatgttaatgttttcgtttatctcagggaacaataaagaatgttgcattttaaaaagcttactttctgaattactaccaaaccc

SEQ ID NO: 233836 - DNA, 237 bp, Homo sapiens
gccataatgtgaactgtcatagcatctactgggtgccaggtggtttatgttttatttgattctttttccaacttaattcgaaacctttcaaacctttagagcaattgcaaaaatagtacagtgaagccaggcactgtggtgcacactggtagtcccagctactcaggaacaggaagaatgcttgagcccaggaattcaagagcagcctgggcaacgttgtaagaccccatctttaaa

SEQ ID NO: 233837 - DNA, 526 bp, Homo sapiens
  misc_feature (163)..(163): n is a, c, g, or t
agatactatcactctcagtatttctaatattgtgacatatttatggtattttaattttggatgcattttggctttctactcaacaatgcttagccttttaaaatgttttgaagttattagagttggcaaatgtgcttgaaagtaataaaacaatttccataanacaaaacaaaaatgaacaaaaaacaaaacaaaactaaaaaaaaaaaaaaaaaagaacaaaaaaaaaaaagcatcaaccccctcgggtttttttttttttttttaataattttaaaggaccaaaacaaagcttttaaacccgcattttttggaaaaacccctggttctggccgggctggaatctcttttaaaactggaccttggcctcccgggggcctttgggttaaaaagcgggatctttgaaaacatctttattgcccacagttttgcccaaggggatttccccaaagacccttggggccattaggggatggcggttttcccctttcccggccgatttcgaattaaagcttattgataccgc

SEQ ID NO: 233838 - DNA, 316 bp, Homo sapiens
tctcaggccagcgtgaagccacgagatggtcgcaccctcagaggctgtggtcaggggctgaggcgggcctgaggatccggggcttccttgctgctggcctcctgtaggcctgggtttgactgtagcctgggtgtggcctgtccctctcttgggaggcttagtcgctgctctgtgcaggacatccgctgccctctctgtgaaaaagacgagagtgaaggccagcgaaaaggatctgtcttctcatttgggagctgattattatgaaaagctctagaaagcaatgagaatttgatcttgctcagttatacatttattg

SEQ ID NO: 233839 - DNA, 241 bp, Homo sapiens
tctctatgtcatatgttatgtagaaaaagaagtttattatttctccagtttatctacagacaatgagcctattgtatttatatcttcacttctgttttactttcagagtttgcacctgaatattcaggactattcagtcaacacaggctggtgggtggtaaatgtaatgtcatttcatgatacatttgagagtagtattttctccctgaaaaattgaataaaaggcatacaaggacatccg

SEQ ID NO: 233840 - DNA, 344 bp, Homo sapiens
aaattaatttgccaatccttctcttaatgagaagcattgcaaggaatggaaattctccatttatttatttatttatttgtttgtttgtttgtttttattacttacccagagtaaagcgtcatttttcttgagcaagtggcaaaatgagcttattttcttggctggttttgttcattgtttgttgtgtcagagactagcatagaacattgtgactttcttttcactaacacaaaacaaaacatgattgggattcaggcctagataatcttgaaatatccccaggatattaatggtgtaactccagggaggaagaagtgataagtatcttgttaagataagtcttt

SEQ ID NO: 233841 - DNA, 453 bp, Homo sapiens
gatacgtccaatcaccaatctaacacaaggtgttttctcacctccccccattctgtaatttgtatcgtttatctcccacagtaaaatacttggttcccaacataagcgtggttatagttcaaacaaaagcatttatacacaattgccctacagtccaataggtataaaattgcaatgccattaccaacatctaacctactaagtaaacttagtaaacttaatttttttctctttatggttatatcattaatctgatttacattaggcttttttctgtctacagtcaagtttatgtttactttttataacattttttatttaaaatttttagtgtgtaaaatatttacatggttcagaaatcaaaactataaagaaatagagaaatttacttctctctctcttaatttctgatgtatctttcctatatttctttttaaataaacatatttatat

SEQ ID NO: 233842 - DNA, 436 bp, Homo sapiens
atttcctgtacagagggtgctggaaaataagagtatgacacaggaaaccacatgagatgtttctcagcatttgccctgactccaatcacttatcttggtttctcccctaccctctccggccccactccctgcaaggaatcaccgtcctgaagtctttcattgcccacaatgagcatccaggaagcagaccaatcaagcgacgtgagctttcatagctaaagaatagtctgccctcttctgcttggcattcaaggccctggcttacttgacctttcaaaatcaggtttatttcaaatgacactaaggtgtataaaatgaaatgcaaagtctctcgaagtctcattccccaaaagcaaccactgcatacagtttccattcttttttttaaaaaagctttgcgtaataaaacaacatttctatttttgatttatcgatg

SEQ ID NO: 233843 - DNA, 504 bp, Homo sapiens
cactttgggtagcaaagctgtaggaaggttccatcttcctgtgactggggtctaggctgatgtgtgaccagggcctagggtcagtctacaattggggaattgcatcagtccaaaactggagaattgtgtgattgaccatacttttggttttgaccaacactgcatctgtcctccaacctatagccacgagtcataataaaaaaatcacacaagagtgaaggagagaaaagatatttcccctgaaagaggaggtgcagagcacatgggggaaagattcccgtactatccgggttggttagctccttttttgtaaaggtaatttctccctcttcttttctcactctccatccccgcattttacatatgttcttaacaaagaaatatatggttagtgccacatctgggagtcttgtccacaaggcctgatggcaatatataatcagtttgggagagggggtggcacagcataaagaaaggaaatggtttctctagactaggaaagaa

SEQ ID NO: 233844 - DNA, 448 bp, Homo sapiens
aacttgggtaactgactaaatccttctgggactcagtttcctgatctgtaaaatgggggagaatggcagtctctacttcctagagggtgttttgagaattaaagaacagaacaggctgggcgcggtgactcacgtctgtaatctcagcactttgggaggccgaagtgggcggatcacctgagttcaggagttcgagaccagcctggccaacatggtgaaaccccgtctctactaaaaatacaaaaattagccgggcgtggtggcgggcgcctgtaatcccagctgctcaggtggctgaggcaggagaatcacttgaacccgaatgcctgtaattgcagctactcgggaggctgaaacatgagaatcatttgaacccaggaggcaggggctgcagtgagcccagattgtgccactgcactccagcctgggcaacagagcgagactctgt

SEQ ID NO: 233845 - DNA, 240 bp, Homo sapiens
tggctaggatggtctcgatctcttgacctcgtgatccacccacctcggcctcccaaagtgctgggattgccggcataagccaccgcgcccggccagtatgagttattattacattttcagtctattactgaaaactgcaacatggtagtttatcaagttcttaagcatagattccccatttttcagtcatgcagcaacatccgcttaatgcctcctaagtgcagaacactcaggatgaca

SEQ ID NO: 233846 - DNA, 438 bp, Homo sapiens
agaaaatgtccatagttgtaggctttataacatttcaaattctgtaataaactatttggcacattatcatatcattttaggtatatagataccatggcattttattaagcaaaacaatttttttcttctgaagaatacttaaggtgaaatttactggttttgagcttgaaagtggtttgagaattatacatgaactccacttaaactttggagactttcctttttgcagtgctaaagatccatgacttggttccaaactacaaccttttatttgcagatgtatttatggcacagtaccacattctgattagaatttaagagttcacatttctgatatttctgtctctaaatgctgtgttgcttctgtttacctagttttcttcctattcttcctaatttcttaaagaaatctgcacatattcattgaggtatttaatc

SEQ ID NO: 233847 - DNA, 307 bp, Homo sapiens
ttgcctcctgagagctgttccccacacgtggacgggatcgggggaaccatagatttattccagctgaagctgcaaggtccagaaagtgggagagttgatccagataattccccatggcttttctagctataaagtgttaggttccgatcctttaacttggttatttctttattgcaaaatgcaaaaccacgctgttttaaaacaagcctcggggtaagcctcagtttcatggaaaagaagacagaggattattaatcatttttatgctgtaagccggtagttcctaaatttttattatctgaatcct

SEQ ID NO: 233848 - DNA, 309 bp, Homo sapiens
ctaaaaaattattaatcatctatgatgtgtaagactctagatatagttggaaacagagatgagtgtatcactaaaaaaactcctatcataggtgaataagtggtgtgcttgtaaagataattaataatacccagcagtgtagggtaagagacaaatgagtgatgcagaggacaaatgctaaagaagtccaaagagagagaccactgtgggttatacattatttatgccctactttattttggataaaggaagagtcctgactatagtagattaaggagaaagtaaagagagtttaattttttaaaaata

SEQ ID NO: 233849 - DNA, 371 bp, Homo sapiens
caggcctttgttagaacaagaaattgtccagccccttgtgactcaagatgtggcctgggaaccagcagcgtcagcattacctgggagctaccaaggactgtggaatttcaggcccagcccagacctactgaatcagaatctgcatttttaacaggacccccaagtgatttgtatacacagtgaaataggggaagtactggtctcggagacaaccaagttcatcatcagtctttatatccaaacacatagctgcctaatgaagaaccatcaacttagcctgtctctcagatgctaccttttgagtgttccttaggctaatatttgagttgctcacatttactggatgaataaaagggctgtcagaagtcttt

SEQ ID NO: 233850 - DNA, 380 bp, Homo sapiens
gtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaactcatctccaaagaaatcatttaacatgaagttagtctaggattaccaaccaagagcatggcattctcccatgtatctgactttcttcgtggctgccaggattcccggtatagaggcaaatacaacctgtaaaggctc

SEQ ID NO: 233851 - DNA, 488 bp, Homo sapiens
agcaactctttattacatgtctggcactggtctttacatatatcactcatcctcatgaaaagcctgtttcacagctaaagtcacttgtgtttaccctgtcttgagtaaatcaaaacactgaacattctgaaatatttggaaagttgccatgattgtatgaaggctgttaacattgctttgatttctgtaatgagcatggatgtcattctagaggtatgcatgtggcgcttcctcttgcatttctttagtaggaattgtaatacggaaaagtgcacagaagttcagtgaaacagataattagaacatcccttgatcacccagatcgagaaatggactcacacccccgaaacagcctagctccggatgtactttcctcctttcggaagtttgccatattcctgacttttatgctaatcatttcctctcttcatagtttttaccacctctgtgaagttgttgttgtttttttttcccctgcattttgattt

SEQ ID NO: 233852 - DNA, 412 bp, Homo sapiens
ctcaaaactgcacagcaggggcctctggagcaagatcccagcaactactgcaagagcacccacgaaggtgagggagggtgtcgcatagatgttggtattatcagcacttatccctacacagtgatctgcagaacattctattaggtgaagaaaaccctgcagaatggtgtttctagagtgttaccttttgtgtaagaatggagcagcatgtaaatactaacatgtcacatatgcattgcttacatctttcacaaagaaaccgccacaggatacaacataataaagatgcttaccctttatagaacgggaagaaatagagtggagggcacaggaatggaagcatgttttctaaaccctgttctgtggttttgaaattatataaattccttgcataattcataaaagaaatggc

SEQ ID NO: 233853 - DNA, 701 bp, Homo sapiens
tcccagcactttgggaagccaaggcaggtggatcacttgaggtcaggagttcaagaccagcctggccaacacggcgaaaccccgtctctactaaaaatacaaaaattagctgggcatggtggcgcatgcctataatcccagctactcagcaggctgaggtatgagaattgcttgaatctgggaggcaaaggctgcagtgagctgagatcacgccactgtgctccagcctggacaacagagtgagagcctatctccaaaaaaaaaaaggggtggggaccatattcctgctttatgtcaagacactggtaagagacagactagatgggccagggagccccttggcagttatcagtgcagcgcctatttagccctgtccctgaacaacacggcaagagcccaacctgccaagtctcaaatagcagttaaccagagtatcgggttggaggtggggttgagattctgtaattccccgcttattgttcccaatcagagaaggcagccagagaaggcagcttcatcccttcactggcccagcagctgaactatatggaaacctccatgtcagggctagggtactcctggacagccaccaaggatgagaaaccctgatggagctgcctggccacagctctgcggtaacttccttgaactctctgtgctgcaggttttcactttacctaatggcccttcttgcaccttta

SEQ ID NO: 233854 - DNA, 543 bp, Homo sapiens
tctttctactgtggttgcgacatcgccatcgtgtgtggggaggccgcgcggcatgccgcgggctcactggaggctgcgctgtgtagaccaaggcgtcggtggcctgacgtgcaggcgtctggttacctgtggtttctgtggctgtgacgtcgggaagtaagtttctgtaaaacgagacgcccactcaacatcgttcaaagctgaactcaccgtctaacccccaaacctgctttttgagagcattggctttggagtcagtcagcggatctgattcaaatgccggtttcaacagggctttgcttgagaccgacctctccacgcttgtttcctcatgcgtaatatgggggtgataaaacggtcggcttcatgaggtttcatagggctaaatgagcatcactccagagatgctagcgacgttctgcttgttgatgtggatgctggttcatctcaggtgttgttgctttgtgaacattcactaagctctacgcttatttgtgtccttttctatatgtctgttatatattgattaaaaggtttttttaa

SEQ ID NO: 233855 - DNA, 538 bp, Homo sapiens
caggatttctgatgggctgagatcaatcaggttgaatcatcaaggactgagtgcattgccactcccaaagccatgtgtgttaatctggtagtaggagggaagggatgattctgccatgttattaatacttattctctctctgtgcttcacagctccctgtacaaacatcaattaatgcaggcagcacatcaaagcattgtggagacatgtctgtgcctccctccagaccatcaattctcaactcaggctgctcgttagacatacctgaggagctttcgaaagaaaccagtgcctagaccccatgcacagagattttaatgtaattggtccagatgaagccccagcataactaatctgtaaaagctccccaagtgatttgaatgtgcagggtgttttgagaaccctgccatagacccagcaccttaagaaccctgtctatgtccccttcaactagcacataaggctcacaggaaatcctcactgaatgaataaacaaataaatggatggcagagaatttctgctccaattctgcagccc

SEQ ID NO: 233856 - DNA, 589 bp, Homo sapiens
  misc_feature (230)..(230): n is a, c, g, or t
  misc_feature (447)..(447): n is a, c, g, or t
  misc_feature (571)..(571): n is a, c, g, or t
gagtctgatctctagagtatcctcaagatcctgtatccaggggaaaaaaatagccaggcatagtggagcatgcctgtgttcctagctactcaggaggccaaggaaggagaatcacttgagcccaggaggttgaggctgcaagtgagctgtgatcatgccactgtggtccagcctgggatgacagaacgagacctgtctcaaacaaaagaaaaaaacaactctgaatcccncaatgcctaagaggccctggtacacagtacatgctcagatatgtgttaagtaaatgagacagtatctccaagcatggcagcatgaagtgtatgtatacaccccttgctcttttctacagggaacaacaatagcagaggcctttgttgccctctccgcgaaactgcccagtaacctggcattagacgggtccctggctgacctgataaagaaggtagncccttccttatctatcttctctatctatctatctacctacctatctatctatctttttcctttcagttatccccccatccaggctggacctggaggtctccaacatcagggagggaaggggatnggaggcctgctgaacttc

SEQ ID NO: 233857 - DNA, 531 bp, Homo sapiens
gatccagacaccaagagagggttcttggatctcacgcaagaaagaattcaggggaacaacaatagcagaggcctttgttgccctctccgcgaaactgcccagtaacctggcattagacgggtccctggctgacctgataaagaagctccctgtacaaacatcaattaatgcaggcagcacatcaaagcattgtggagacatgtctgtgcctccctccagaccatcaattctcaactcaggctgctcgttagacatacctgaggagctttcgaaagaaaccagtgcctagaccccatgcacagagattttaatgtaattggtccagatgaagccccagcataactaatctgtaaaagctccccaagtgatttgaatgtgcagggtgttttgagaaccctgccatagacccagcaccttaagaaccctgtctatgtccccttcaactagcacataaggctcacaggaaatcctcactgaatgaataaacaaataaatggatggcagagaatttctgctccaattctgcagccc

SEQ ID NO: 233858 - DNA, 771 bp, Homo sapiens
gacaacaatttaaaggcatgtggcttcatttccacatatatttgtgactggattcttatttttagcaagaggggagatcgccacaaaaaaaactttagttcaaagaagactgtgcaaatcagttacctgtactttcatagtctaccatttacattaactgttctagattaatgactaagcatggccattaccataattacatcatttttttaaaaccacatttgttcgaagtatccttttctagtggttagaactgtccctataatttgattgtccctcatatactaaccgaaagcaaaatgctctgatgagatgcttataaactatgaattttttaattcttgaaatttttttcagtttttatgattgttgaatagatatgtatgtttagttccattattatttcactggaagttttaaattttgagaagatgaagcagagatagaaatccattgcagatatatgtatatttaccccatcttgcaggtttcagttagtaaaacacagaatgataggtcggttttaatgttttaaaaaaaaactaaaaaactaaagttagagaaacctttctgtttgagctactgtatagaaaagacaacttttattgcattgctggtccacatgataaatatttcaatgctgttctagactgtatgagaagtacttaatgaaaaaagggatacattacatttaagaattgtatcagctaattactgttttaaaaaaatcaactcatttggaattcttcggactataaaattgagcaagta

SEQ ID NO: 233859 - DNA, 335 bp, Homo sapiens
ttagaatctagtcttttgaaaaataatgatatatttttatttaaattacatttcaaggctgggtgcagtggctcatgcttatagttccggcactttgtgaggttgaggtggacagattacttgcccacctcaggagttcgagaagcagcatggcaaaaccccatctttacgcaaaatacaaaaattagctggatgtggtggagcatgcctgtagtcccaagtacttgaaaggctgagatgggaggatcgcttgagcccaagacgttgaggctgcagtgagccaagactgcaccactgcattccagtctgggcaacagagtgagaccctgtctaaa

SEQ ID NO: 233860 - DNA, 460 bp, Homo sapiens
ctcgggtgaaagcaggtttggattaaaatttcctaatgccaaggctgcttgaacgttggattactcttcacctatacttctataaatgtgtaatcttgttataagttttccacaagtggcatagagtctcttctgtgaacactgttcttctgtgcaggtgggatggactagatcaagggtcttcagcagttttgatcagccagtggatttcaaagacccattaattaaaagctttttaatcaaaagctttcttacaaagggcccctgtgttaatcttacctccctgaccttctctttggcacgctccattcttgtcgagattcccagtgaggttgggattctttgaaggttagctggtgttctttcttcattccttattcaactccaggttttctgctgggtcaagaccacatccctgccttcaggcctcaaagatttcattaaaagcaatctacaacct

SEQ ID NO: 233861 - DNA, 381 bp, Homo sapiens
tctagtatggtggcccttggccacatgtggttattaggcattgaaacgtggctagtctaaattgagatgttctgtaagtgtaaaatacacagatattgatttcaggctgaaaaaccaatattttggctctgttgaattaaataagagatgactaaaattatgtttacttgtttctttctcctttctttaacatgactactagaaaatttaagattacatgtgtgagtcatattttcattagacagcactgctctaaacaatcattttaactgactacttagcattactcctactgtgtattctcatctgcatttttccagggagttgacagaagtggaagataaactaacttatgcctaaagaaaatgtttttaaaaattg

SEQ ID NO: 233862 - DNA, 224 bp, Homo sapiens
ccgttttctcatctgtaaaatggagatgatactagtacctacctcatagggtggaaggattacataaactaatctatgtaaaagtgtttagaatgaggccgagcacagtggctcatgcctgtaatcccagcactttgggaggctgaggtgggaggatctcttgaagccaggagtttcaagccaggggaccagcctggacaacataacgagaccccatcactatg

SEQ ID NO: 233863 - DNA, 550 bp, Homo sapiens
ctagatataagatatcattgctatcagataaaaataaaggggaaaaaatatctgcaaatacataagactaatctgttgaagtaagttagagtgaagactagtctgatttaaagtactgtaaaatgtcaaaaatttaaaactatgcctgtaaccccagctactcaggaagctgaggtaggaggttcacttaagcccaggacttcaaggcgagcctgggcaatatagtgagatcctgtctttaaaaaagttttttattaaattaaaaactacatctctctgttgttcttttttttgttttgagatggagtcttgccctgtcgcccaggctggagtgcaatggcgcgatctcggctcactgcaacctccgcctcccgggttcaagaccaacttggagaacgtagtgagatcctgtctttacaaaagtattaagatgggcatggtggcacacacctgtagtcccagatacttgggaggctgaggtggggggattgcttgagcctgggagttcggttccagccagggcaacatgctgagacccagtttcttaaag

SEQ ID NO: 233864 - DNA, 401 bp, Homo sapiens
ctttcaaatatgtggtcaattttaaattagcacctcacagttttcgggctggcttcttgtgaaccgctacgaagctaccttaattcaccagacaagaggcaagaagctgctgcttgacttcaggagaggtcctgggaacgtctccagggactgaggttgcttgcaaagctggatttgcccccagggttcaacccattgtttaactaattttattaaactttaaaaataatctttcactataattatcttttaggttttcaaccatctagtgacatttctataactttaccatggttttattaaatgaaagcctttctgactggatctcatgtgacgctgttacatttaatgttggacttcctgtttgctttgtaataaaatacaactaaaatgtgcccatg

SEQ ID NO: 233865 - DNA, 418 bp, Homo sapiens
ttttaagggtagggatgggaatgtcttatagagaaacaagaactgaaaatagatacagccattaaagatgggcacaagtcaatgaatattagaaagatctgtaggacatataggatattcaccatataagaagagattgcagggattcgtagttcagcaggcagtcttaggatatgtaactgaatgaaattgagagtgtctataaagctagtatcatagagttcagaagtcaagacacagcattaagaaattctaatagaacatagagtgccatcaggaatgtttatttactcttagcagggtgtatggatcacaggtttatgggtcatagactggtactcagttagggaaatatgttaggacaagttgcaatttccaaaataactgaattactgaataacaaaataactgaataggc

SEQ ID NO: 233866 - DNA, 773 bp, Homo sapiens
gagcagaagttgagttctggccttggcctgggattgctcagagggtagcagcccctttgcccaagagattgagctgcagccgtgttgctgcctcttcatttggtgaccaaagacaagacaagatcaccacgtggggaggagacagaagtgaaaggcccacctcaatgcaagggtgattagctctttctccagcagtactgactcactttggcctactaatcaatgtgaattcttcataacaggcgatcccctttgagtccaggaggacagagttgatgacagtgtagcctgaaattcctggggccctggattgaagctgtggccctgccatttcctcagtaactctgagctgttattgggcaacagacttcctaggttgtggaggaggctgggttaactggggactttaaatgcttgagccgtgtgttgactcattaactatgtctaccctaggctgaactggtgttgcccttcccttcccaggaaaggcctggcctctcccattctgcccaaggaaaccctctgtgaacttttacattcttccaaactattctgatgtttattggtctggatccattacatcagaagctactgagggtaatatcaggcatctatattttaaaaattggttcccttcacctacaccactcaccttcatggctgtgagattaggggtgggagggcaggggagggttacaccaagggccttgaagctctcaggacagacttgaacaacctttttctcctccatgttcccttcccctttttctttg

SEQ ID NO: 233867 - DNA, 881 bp, Homo sapiens
gagaattgcttgaacctgggaggcagacgtgcagtgagccaagattgcaccactgcactctagcctaggagactccgtctcaaaaaaaaaaatctgccaaattaatactgctttataatatcctctagtagtttgtaagatttttgttctaggctttctctctccccatgtgttctataataaattgaagctgcaaattaagccgatccctccagaatatccagtttccagttagcctgtttatgcccttttgactgtgcctctgggggcactagcagagtctgcactcttacagagagaacaccttagagcctggatagccttgttccagaagcgacttttccaatggagcaaatgtccatgaggctctggataaaggaactgagatgtcagtgtaaatggctgctgtgggctgggccccaagctccccagggtgaaggggccagcacagtccattgaaatgaattcccaaggccagcccttgggtatagtggggggaaaccctgtggctttcctcttcctttctctttatcagctcaggcgccccattgaagtgggaaaggagagagggagaagttagaaaactccatgagaagaggctagggttggtggctcacgcctgtgatcccagcactttgggaggccgaggtgggcagatcacctgaggtcaggaggtccagaccagcctggccaagatagtgaaaccccatctctactaaaaatacaaaaactagctgggcgtggtggcgggtgcctgttaatcccagcttctcaggagactgaggcatgagaattgcttgaaccctggaggtggaggttgcagttagccaagatcgtgccactgtgctccagtctggacaatagagctagagaccccttct

SEQ ID NO: 233868 - DNA, 167 bp, Homo sapiens
ggagcagcatggatgaaggcatggaagtgggaaagggtgaggctggtgagaccacaagcaatacatgtaaagaggatgatgaggctggggcccctatcacatgtcatgcactttcaaatctctaggcatttaaacatgctgttccctctgtgtggaacacaccttcc

SEQ ID NO: 233869 - DNA, 442 bp, Homo sapiens
aacagggctcccacacaccactccgggctgcaccctcctgctgtcttgccacaggggccctgtgccccacaagtggcccgtcctattgtggatcctcaaatttacatgcactgtttcagcataagcctcccattccactctggctttgttttctctttacatccctttgaaaggacagggatataaaaaaaaaatgggctaagagtaaccctactatgcccaggagtggctgctgcatgggggctggatttccttatctgagaggctgtctcacagcgctctgaacgaagctcctgccttagaacaattcgaagccatacacgtgtggcctgtgacaccaaggatctactgggcttttcccatggggctcagtagtgacctaggtgcccagatccctcttctaggcatccatgcaaataaaccgtggtctgtttgaaaggtt

SEQ ID NO: 233870 - DNA, 425 bp, Homo sapiens
ctggatgccctgggacctttgcatgcctgtccttcaaccacactcccagcagatcccagccacagcttgcagaactagagagggcacaggcgggagatgacgactcattctcagcctcctttgccagcttttcttcctccttgagtcctgtgtgccccaggttccatcaaaggccctctgctcttctcttccctcctacacgtttccaggttgtcccacccagacccaaaccttcaattctctcactcctgtggatgaaccccaaatctagatgtccatctctggctgctctcctgtgctcctgacctgagctcccctagaacataagctgcattgaggacaagcatgggtgtctcttttctctgatgtgtctccagctcctggaatatatttggtgatgaataaatatctgttgaatcaattaa

SEQ ID NO: 233871 - DNA, 508 bp, Homo sapiens
cggcagcagagcgagagttcgtctcaaaaaaaaaaaagaaagaaagaaagaaagaaagctatgccccttgaagaataatcaaagatccaaaagagttttgggctgggtattggagaagaggagagaaaggtggtgtagcagagtggtcagggccattgcctttgaaatatcagaggtgccatttacatagctgttggaccttgctaaaatcataagctcttcaagccttatttgcttcatctataaaataggaatcaatgataggaccttttcatagattgctttgtggagtaaatgtgttaaaccttataaacctggcaggtagctgcccagcatatagttgcgttatttactcaattcaaagtactttcctgccgggtgcggtggctcaggcctgtaatcccagcactttgggaggctgagaatcacttgaacccaaaaggcagacattgcagtgagccaagatcgcacccttacacttcagcctgggcgaccgagactccatctc

SEQ ID NO: 233872 - DNA, 455 bp, Homo sapiens
cggcagcagagcgagagttcgtctcaaaaaaaaaaaagaaagaaagaaagaaagaaagctatgccccttgaagaataatcaaagatccaaaagagttttgggctgggtattggagaagaggagagaaaggtggtgtagcagagtggtcagggccattgcctttgaaatatcagaggtgccatttacatagctgttggaccttgctaaaatcataagctcttcaagccttatttgcttcatctattgttaaaccttataaacctggcaggtagctgcccagcatatagttgcgttatttactcaattcaaagtactttcctgccgggtgcggtggctcaggcctgtaatcccagcactttgggaggctgagaatcacttgaacccaaaaggcagacattgcagtgagccaagatcgcacccttacacttcagcctgggcgaccgagactccatctc

SEQ ID NO: 233873 - DNA, 473 bp, Homo sapiens
ttcacctgtgaaatcaaaagataaaatttttaaatttttaaataagaataataattaaacataaaatcttccagagaactaaaaaataaaaaaataaaaatactttctaataccttttatgaatctgtgtaagtttcttatcaaaatttgacagggactttacaagaaagacaatttaagggccaatctttctcttaaatacaaatgcaaaaaccctaggcaatataatagcaaactgaatttagttatataatatgctaatacattatatccaagttgatttattacaaggataaatattgtatagcctttacgaattaataaaatttacaaaattaataaatttaagggcaaaactgcacaaatattttaaaagttgaaaattatttgataaaatttacactctaagtgttaaaaaatttttagctaacaagaaaggcaaaaagaccttcttcaatctgttagatggcacc

SEQ ID NO: 233874 - DNA, 569 bp, Homo sapiens
ggacgcgcatgaaatttggtgctgtgactcggattgggggacctcccttgggagatcaatcccctgtcctcctgttctttgctccatgagaaagatccacctacgacctcaggtcctcagaccgaccagcccaagaaacatctcaccaatttcaaatccgatcttctcggcttagcggctgaagactgacaccggccgatcgcctcggaagccccctagaccatcacggatgccgagcttcgggtaactctaacagtggaagaggccaggctaacagggactgctgatggggaaataaagaaataatcaaggatgaatcctatatctggggcttgagcaaagagtctatcatctacgtagaactgaagatgacagaagacaccaaaggaggacgggggcttccaggaagagccagtaagatgtgctgagtaggaagatgtgaagaaaattgttgaacatgtctgacaatagaagacctaaggcctaagaagtccatttcaatgaatcacaaaagaaatcaaagaacagaatttctctcttttgaagagagaataattgctttattaagt

SEQ ID NO: 233875 - DNA, 440 bp, Homo sapiens
actgaaagaaatttatagctataaatgcttacatttaaaaagaagagtctaggcatggtggttcccacccataattccagcactttaggaggctgaggtgggagaattgcctggcccctctacaaaaaatttaaaaattagccagggatggtggtgcacacctatagtcccagctattccagaggctgaggtgagaggattgcttgagcccaggagtttgaggctgcagtgagctaagtgagctatgatggcaccactgcactctagcttgagcaacagagcaagatcctgtctctaaaaaaaaaaaaacaaacaaacaaaaccaactgaactgtacacattatttacacattaaggcacaaaaaaagagcaaatgaaagagctaacagaaggaagccaataagaacagagctagaaggaagataacagagctagagaat

SEQ ID NO: 233876 - DNA, 1159 bp, Homo sapiens
  misc_feature (14)..(14): n is a, c, g, or t
  misc_feature (136)..(136): n is a, c, g, or t
taaaaaatgtttanagtaatggggtctcactacgtttcccagcctggtcttgaacccctggcctcaagcaatcctctttcctcagcctcccaaagtgatgggattacaggcataagccactgcgcccagctccccnttaattgtatgctgaacaaaccttccattccaggaacaaatcccacttggtcgtggcttataatccttttcatatgctgaatttgatttgctagtattttgttgaggatttttgcatcaatattcatcggagataatggtctgaagttttctttttttgtggtgtctttgtctggctttggaatcagggtaaagctggcctcatggaatgagcttggaaatgttccctcctcttcatttttttggaagagtttcaggaggattggcgataattcttctttaaatgtttggtagcattctccgatgaagccatctggtcctgggcttttctgtgttgggaggtttttgattactgattcaatctctctcattattggtctgatcagactttccatttcttcatgattcaatcttggtaggttgtgtgtttcctctagaaattggtccatttcttctaggttattaaatttgtaggcatacaattcttcataatattctcttataatcctttttatctctgtcgtattggtagtaatgttccctctttcatttctgattgtagttattgaatgttctttttttttcttaatctagctaaggatttgtcagtttggttgatcttttcaaagaaccaactcttagttttgttggttgtatttgtttatctctgctctgatttttattattgccgtttttatgctggttttgggtttagttcttttcaagttgaaataaaaggatggggccgggtgaagtggctcatgcctataaatcccaacactttgggaggccgaggtgggtggatcacaaggtcaggagttgaagatcagcctggccaacatggtgaaacctcatctctactaaaaatacaaaattagccgggtgtggtggcacacacctgtaatcccagctactcaggaggctgaggcaggagaatcactttagcctgggaggtggaggttacagtgagctgagatcatgccattgcactccagcctgggcaaaaagagtgaaactccatctc

SEQ ID NO: 233877 - DNA, 1036 bp, Homo sapiens
gaagggcaaaaccctctcacgccccaccatgcataaatctgcccctgtcgaatagaacagggggatttttagggagattcagctgcccccgccatctgggaggacatcgcaaacctctacatcgggcttgaaaggttaccctggacactggaccctacggcagatggatctcccagtccaaaatggtttacttggtttagctcacaagcgcatgttctgatcattctccatcccaccccatgcccactgtccccaaggccttcctccggccttcccctctgccagattcacaacgtccatttttctttttcggctcttttatgctttaaacatcattgtgatcaaactgggggaaacgttgtcttttctaggggtaggaaggagactctgcttcaggtgatcgaggtggatttgcctttccttcatcgaaagcatcatgactctgaccaagcgcacccaaccagtgcctccgacagccagcgccacgagggtcataacgcccggggcatttgttaccccctcctcaccaccatccccattaaaggcttcgggggcggccgccaggtgtttcagtacagtgggggtggggtgagaaaaaaggtcggtactcaccctcccccccgcccgggcccctagaaactcttgactcctgggaacgcgacagccagcgggtctccggactggagctgctgcagagggccgggaaggagctgggcgggctccgggcccctcgggggctcgaggggccgccagggcccaaagctctagggacacctgtgacaggggccgctgccgcggagtccccagccccaggccgagcccgagccggagcccggctgccgagagcttgctgcctcgtgcgcactcccgtaattcgttaattgctgtaaatcccaaggacggccacatttgagtacacatacagtataagaaccgacaacaaagcgacgaattaattaccaacttcattaacataggtccccaaattaaaggcagcgagctgtttctttgggcccactggccgtggtggtgatgg

SEQ ID NO: 233878 - DNA, 1475 bp, Homo sapiens
  misc_feature (3)..(3): n is a, c, g, or t
  misc_feature (590)..(590): n is a, c, g, or t
  misc_feature (696)..(696): n is a, c, g, or t
atntcagaggcgggcttccctcggaaaacggagggttgaaacccagaaagctcctcggagcccttctggggttcgggcgatctgggcagagaactctcgggtggcaaggaattaagggcagcgcgaacgacggtctctagacaagtatgaagcctcccctgagtgtgtccggcgctcagggggtggaccggggtgttggtttcaaggagggggccatcgtttgcaccacggcgtccagaaatactcatcctttgcccttcggggaggcaacagagcagccaactgactgttctggccaaagagactggagatccagtatcagcaagctactttcttggtaaacctccatttcccaatgctcatctttgtcctctacccccacccatcccaaggcaaatgatgaaaacatctattggatccagcctttgctatcttctccatgctgctcatagtgggtctagcaatgtcccattctcggtaatgtttggtaggtctaaaacatcctcacgaaatgttccccaaatgttctgctccagctgagcaactaataacaatgggaagatgcagaaaaaaaatgcatggagcataangttagttttgggactcgtcagtggcaacgttttagagatgccatgaagaattcctggtaataatccttcttcctacagcatttagcaatgaatactatgggattanggctaaaagatggtcaagactgcctcagccattaggatcagaattctaagttccaaagaagagcaaactcaagaggatttcctcaggcctctgactatagatgctgcctggggagaacaggtgctacactcaaaacattctcattttatttatatcctccctgaactagtacccaactccataaccccagactcaaataacagaaataaaagccatctcactgattataagctctctagttattacaaaaataaataagcatcaatcaaccaacaggcatcagaatgagaaaatcactgatttgagacattcaggctgcaggaaaagaacactttttgttaatatgtaactatatcttcagtagtacagaaaaatgagaagaacgagagttcttacctggatttgcggctcacttaaagtagagcacctgagatgctgggaaatcataaagataaataaccaatctaacaaattcctgccatgagaccaaagtgatccttgactactctattagtaagcgactctgagccaagagtacgaacctgtaagtggagtggtggttggcccattagaaatctctgaaagatctaaacatgacagttaccttcctactggactcatacttctcaattccctctcctaaaagaatacttttgggctggccccagtggctcacacctgtaatctcggcactttgggaagccaaggtgggaggattgcttgaggacaagagtttgagaccagctcggtggaaacatagcaccatccatgtctctacc

SEQ ID NO: 233879 - DNA, 991 bp, Homo sapiens
  misc_feature (3)..(3): n is a, c, g, or t
atntcagaggcgggcttccctcggaaaacggagggttgaaacccagaaagctcctcggagcccttctggggttcgggcgatctgggcagagaactctcgggtggcaaggaattaagggcagcgcgaacgacggtctctagacaagtatgaagcctcccctgagtgtgtccggcgctcagggggtggaccggggtgttggtttcaaggagggggccatcgtttgcaccacggcgtccagaaatactcatcctttgcccttcggggaggcaacagagcagccaactggtaagccctttggggaataaccttgggcttgcacacggccaggcctgaggatgatcgccgctccagtcccgggccctactccctccaggcctcggccctctgcctcggagcggaagacgccacctccgcgtggcgagcaggcggccaacgccgcgggaagaggccgcagccaggccccgctctccaccctcgccctaggagagccaggctgaaggcctctaagggctgggagccgatccggccaggatgcaagcctcccccaccgcttcccggctgcgccgtacagaacccccacctctgttacttggccttcgcagcatcccccttcccatttcctggaggatctctgtggtctgggcaggaaatttgtacccagtgataaggcagaagacaatgaagggggggccactagaccggaggctctacgggaggaaacaatccccgcctcaaggagctggacgccccctggggacccggcccgctggccattccgctgaggccgggcacgcctggagcctgcaggtgctgccggctctcccccagcctttctacgacacacacccggcggccagaaagggtttccgccgggaaactgcctggggcccagaaggggcgcgcccttccttcaccttgtggaccaccagcgacctccccaggtcccacatttataattccactttccagaaggtagaggagagttaaaaga

SEQ ID NO: 233880 - DNA, 1121 bp, Homo sapiens
acctaatttcttttcttccattcctagaaacaccataatgtttctaaataatgattttatagtcattgtcacacccttggcttattttacactaaagaacatagttgagtttttggaaggtacaggatttaaaaatttggtctgtaatatacacacacacatataaatgttgcagttaatgaaacaggaaattattgatgcataagatgaatgtttattgtgaaacagtatttcaaatgttattttttaataatttggtttaattggatatttttctgtactataagttgataatggttttttgaagtaactataagttgataatggttttttgaagtttatttaataaaggtgattcattatactgttttatcataccagtaggacttttaatgttaaatcagtatgttgagttagataagtgtttatattagtatttaaataatgaaatattggccagctagtttataccaaatgtttttgcagtccaggggtgaatgtttctgctggtttgatgcctaatacagcttcaaagaaaaaaaaaaagcaaatatgaattcactgttttttatcttttcttcatggactaccccttagaaccaaatttaaaagaagcttctttgtagagcaagagaaatgagacgttctctttttctataatcaaaactccaagaaatagtagatatccaagaattcattctggtaagatctctgaaacattgcgtgagtaaaggaaaggtaatactgacaaaactctcaggatttgcagtgcagtgaatgctgaaataatctttaaccagcaatatagtatcatcaagatttccagtgttagaacattatgttaaaatgtgattattgtttaatgctttgtctctttaaattaaatttgtgtccataaagatgtacagcataattgttcatgtatttatttacagactacaatttccatcgcagctcaataaatagtctttcccctgttagtgctaccctctcttctgggactcccagcgtgcttccttatacttcaaggccttattcttatccaggctatcctttgtcaccaacaatatcacttgctaatggcagccatgttggacagcggctatgtatctccaatcagg

SEQ ID NO: 233881 - DNA, 408 bp, Homo sapiens
agggggaatttgaagtatctggcctgggggtggcatctaggaggacctgtggctctcagtatgtgtgtaggaagagagaggatggggggaaactgcagtgcttctgggctagctgggtgggacagcatcttcaatatgtcttctctattcacggaccccttccctggagccccatgtaggccatcggagaacttcatatagaatgaaaaggagagaagggtctgggttcggccagacagggagggaagagaccttgatttgtgcctttcatcacgaactccccatgttcaccttccctcttggtaaaaatgaagggcttggagaagccaggggagagggtacttccttggtacctggagatactgtcactatggggagcatgcaaggttcatctttagcagaggttat

SEQ ID NO: 233882 - DNA, 417 bp, Homo sapiens
ggcttctcttctcctgatgaaacctggatgtcaactgtccccctctgctctgattctatggctgcatatctgaatgtagaacttagaacctcctcaggttcttgttttgttttttctctgtctccaaaaaaggaaaaaagaatgaatgtgtaattgtgtctgtcagtaatgatattgttttaatggactatgggacattaactctattcctttagatccttcactaccaattctccaggtagaattcagagcccaagcagtcatttcatctacctcttatgtctgagtgcagttgtgcttaagctatttgagaagatggttattttacttattaacacacataaacacacacaaatatcacattgttaataatgaagtattttccagcctgggcaacaaaacgagacttcgtctcaa

SEQ ID NO: 233883 - DNA, 387 bp, Homo sapiens
tcaggcgaccaggaagagctgaaacgcggcctctccatccctgctacagcagcacctttctcactgggctgcaggcaccctgaccgcaaaggtgttctcacaaccccgcagggtcttgctcctccctgtgccgccaagcttgccactccatctgcctggcacgctcatccccgccatccccatcactggcttcccattgtcccctgggtcttgtccgtgaggaagcctcacaagtcatcctgtctaagtagcactgttggtcttctccatagaaccttctcttcctttcctggcatctatatcatcctggaaccattttatctgcgtgttcacctgtccaaccacactgcgatggttttaaaatatgttcttaattcttagacactc

SEQ ID NO: 233884 - DNA, 479 bp, Homo sapiens
tctggcctcaagtaagcttcctgtctcagtctcccaaagtgcttcagttacaggcaagacccaccttgctcgcctctttctaatcttatactgtcataatatataacatttagcattttgtttcttcttttaaattactccctatgacacattttcagaatcagagatgatgaacatttttacatctaatacaaaatcaaattattaggcagggtgcagtggctcacacctgtaatcccagcacgttgggaggccaagacaggtggatgcctgagtttaggagtttgacaccagcaacatggtgaaactccatctctaccaaaaatacaaaaaaaattagcctactgtggtgatgcatgcctgtagtccaagctacttgggagactgagttaagaggatcgcttgagcccaggagattgcagtgagctgtgattgcgccactgcactccagcatggacaacagagccagacttgtctca

SEQ ID NO: 233885 - DNA, 412 bp, Homo sapiens
caggcatacggtttgcaaatatttttttcctagtctttagcttctttcttcatcctcttgacagtttttcaaagcaaaaaaaacatttcatttcaatgaagtccagtgtatcaatttttccttttatactccttgcttttggtgtcaagtctggagctttttacctaatcctagatcccaaatatcttctcttaggttttttgtaactgtatcattgttctgcattttaagtttaagttcatgatccactttgagttgtttttttgtgtgtgaggttaagatcaagattcaatttttttgcctatggatgtcccattggtccagcactaattgttgaaaagaccatatactctctccattgagaaaggattgcacatttctcaaaaatcatttatgcttatttgtgtgggtc

SEQ ID NO: 233886 - DNA, 549 bp, Homo sapiens
ccagttaagttttcatatccctctaagtcctttggaagcacaggaacaaatgggtccaggggcctcgggaggacaccctctgctcctgctgatgccccagctttctcctgagcttctctaggatattaaagcctggatctgatattgaggagcctctgatctctggctgctggactgactgcccagctggactgactaatgctgctgttttattcttaatatcttacatgccacctcactcctcagagataagtgccttaggttagtgacctaaataacaaaggccaggtatagaacgagaaatcagtggacctgatttaaattgtcattgtctctcattctattcctctctttcccacagaacagtctaatggacctccccaggaaaatgcacatgcacaaaaaatttgcatacaaatttgagagagttctttaatcctttgaggtccatccatggaatccaaattagaaactcctgaacatattactgaaataatccagacaaaagacaataaacagaaagaggcaagagtcataggaaatagtaga

SEQ ID NO: 233887 - DNA, 425 bp, Homo sapiens
ctacagactgctcactagatgggaatggtagccactagtcttctgggcttgcccctttcaacatggaacctctaccctataagcaatctggggaggggctatcaggtccaccattcttggcctggtgtacctggagcagagcttgtgccctatgagtggggcctgggtgggggaagggggccccaggcctcttggccatcccaccagagagagactctgcaacagagttgagagggatgacaccagtggcctgggtttctcagtatgaaactgtagcctcagaccgggagcttggagtagaggcagccccgtcttcttggcagtaaagcttctgtcacactgagctagggcaggaatgggggagggctgtggctccaatgccatagacttttgcttttcttaccaagatttaatagattttcttg

SEQ ID NO: 233888 - DNA, 372 bp, Homo sapiens
ggaaagccccgcgcccgcgttcgttggggcaagcgggatgggctccctcccgcccttaagtctgtcctgtcggggctgacccgcaagaaagcactctttcacagccgctgagggaatcctctccacagcccaggaaggctggaatcagtgatttccttatatgatggacaaggagactgaggctcagagaggtggagcgtatgtcccaaagtcccaagctgcactgagctcctagatgctgtgacccaccctgcacgcctgacacatggaccgacttgaatgcccaggagtggacctgcctgggggccataagggatacatacaactaaatgcagcagagataatcctaataaaagtttttaatgtactgga

SEQ ID NO: 233889 - DNA, 305 bp, Homo sapiens
aggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttctta

SEQ ID NO: 233890 - DNA, 497 bp, Homo sapiens
ttgcatctgtgttcatcagagatattggcttatgggtttcttatgttgcatccttgtctgtttttcgtatcagggtaatgctcacctcatgaaatgagttagggagaattcccttcaattttttggaatagttagaggagaatgggtgttcttctttgtaagtatggtagaattcaataataaagccatttggtcctggattgggaccaaatgggagacattttattactgattgaatctcattactcattattggtctgttcaggttttctatttcttcctgattgaatcttggaagattgtatgtatccaggaattgatccatttattctgggctttccagttcatgcacagcagttagcagtagtctctgatagctaggcatggtagcttatgccggtagtcccaggactttgagaggccgaggtgggagatcctttgaagccatgagttcaagaccagcctgggcaacatagcaagaccctgtctctaccaaa

SEQ ID NO: 233891 - DNA, 257 bp, Homo sapiens
ccccagatctctggcttcagtgacaggccaggtggaggagccgttggtgagagagaatccagaacaatctggaggggagagtgaacagagccaggagtatggcttgggcttcactaagttggggacgtttggggaacccacttggaaaggtctaggaagcaagctgacataagtgtctgaagctcagagaagtttgggataggacatatatttatgtgcagttggtggctccaaccttggtagttggggcctctggc

SEQ ID NO: 233892 - DNA, 415 bp, Homo sapiens
tgaggtgctggaggaaaacccaggctctattttttttactacatctgtaccctctctcctgctagctagtgtcctttctgcaagaatagaatttttaaagtttcacttactgtttgctgttcctcatttacacatggaaaacagattggcttaatgagcaatagaagatattaaaaattcattatattttcctttacttgggattttcatgtaggctgtctttttatctcatttactaattaattcatcagtcattttctgagcttctaccatgtgccaggcactattgtagacacagaggatatggcaatgaagaaagcacacacagcaccctcgtttcctgcttagacctttctctgctgtgctgatagcctgaatatgcccaattttgagacatttcagattattgtttgaa

SEQ ID NO: 233893 - DNA, 511 bp, Homo sapiens
gttattttatggaaaaaaattatatatcatgatcaaataggatttattcttggtatgcaaatttgttaaacatatgtaaataaatcaatgtgatgcattacattaacagactgagagacaatcatatgatcatatcgattaatgcaaaagaagtatttgacaaagttcaacatactttcttaataaaatctcctagcactctatgtatagaaggaaagttcctcaacataatcaaggacatttatggaaaacacacagctaacattataatcaatgaggagaaactggaagttttccacctgagatctacagtgcaaggatgttcattttcaccacttccattcaacatagtactggaagttctagccagagcaattaggcaagaaaaagaaataaaaggtctacaaatcagaaacgaagaggtaaaactatctgtttttgcagattacataatcctttatatagataatcctaaagattctgccaaaaaactgttatgtataataaatgt

SEQ ID NO: 233894 - DNA, 489 bp, Homo sapiens
agctgcagtgcgctatgatcacacctgtgatcactgcactctagcctgggcaacataatgagaacccatctctaaaaaaatactaataattaaacatttttaagaagacaagaaataaatgctgaccaggattcagagaaaaagaaacatacgctgttggtgagaatgtaaattagtacagctattggccaggtgcagtggcttatgcctgtaatcccagcactttgggaggccaaggtgggcagatcacttgaggccaggagttcaagacttgcctggccatctctactaaaaatacaaaaattagccaggcatgatgggacacacctgtaatcccagctacttgggaggctgacgtgggagaatcatctgagcttgagaggtggagattgcagtgagccgagatcatgcctctgcactccagcctgggtgacagagtgagactccatctcaaaacacacacacacacacacacacacacacacacac

SEQ ID NO: 233895 - DNA, 462 bp, Homo sapiens
ccacctgacagggctagtaaaatgctgccgattacaatttatctagaaagcatagacgggaaatatacaggtcttcttttacagaattggcagctgatggttattgaacctgagctaacattcccaaatgaaatgaggtggggcaatttgagtcatatgataacaatgttgtcatcctggagaacagtctcggtatgaatcagcacagttctgtgaaaattaaacatgtgaacaccaagcaaatgccacagaacctccttcagttacaggcatgcatacctgtatccataggagggccccccactagagcgtgaagtggcccaatgttcctggagaaagagaggggctgctgtcaccgactagacgaggtttgtaatagtatcgtcctgttttcactctccacagtagaaaatttctactaggctaacaaggcagagggtaatgagaaacatgccaagttta

SEQ ID NO: 233896 - DNA, 368 bp, Homo sapiens
gagtgcttactgctctacaggcctcccaatgggcctgggctcagagaatacagtggttaataaaacagacatggaaatgacagtttcctcatctgtgaaataggtacagagatagaatgcgtgctcttccacggagggatttcatgcaatatagtacaggctttagcgatttgcattaaaaggcttgtgaacacttaaattttaataaagaagttataaaatttagaagttgaatctgttttcgcttaaacattaccatattcaggaattattatgggtttgaaagtacatttaatttaaaaaggttagttgaacattgttggcaaatataggatattataattgaaataaaatcattaaaaacttga

SEQ ID NO: 233897 - DNA, 500 bp, Homo sapiens
cctcctactctaccttccttcccttcaaggaaagggaataactcttgatagacataaactaagttaatgtctacccatttttatcttaaggcactgatttcttaatttaaaaaaaagaggttgtgaaaaataagacataaacaaaccatggtacgtatggtccagaatgcttggaacctgaagttcttcaacagagaacaaataggcaagcatcaggaagacagagaggggccaggccatgggtaacgtggcacagggaagggaggggatgaacatgtgcacagagcacatccctgttttaacctgagatgcagaagcagattcaagatgtcagcgtatcccagagagtggagcaccaagtcacacatgcaaatcagtaaagaaagcagagtccctgaagccaccgaaatgcatgttccaccagcctagaaaagcagagggagagttcgtatacaattcccaaggaggcagaagagaggggttcatggctgaaatgcctg

SEQ ID NO: 233898 - DNA, 320 bp, Homo sapiens
gtaacttttcaatacaactggctttctttgtagtccagcttattttatgcatttaaaaatattctgagaggggttccacagaactttcagcctgctaaaggagctcttgccatacagaaaatatgagaactactggctttatttaatcccaaagcctacctctctttccattttgccacccagcctgcctcacactgtattttcctccctggttctcttcttttccagattatcttaaaatgggtccctacacagaattaaaaaaaaaaaattcactggaaattcaaccactaaatcaactaatgcactgtctcctatta

SEQ ID NO: 233899 - DNA, 569 bp, Homo sapiens
tcatgttctagttggcttcaactagaagcatttctcccactagtccattaagttcaaaaaagaactgggaggtgagaatgataattctatttaatttatgtgcaagaaaggaggttcaggcaatgactgagaaactgagtaacgatggcatataagagaaagactgcatgagcaaagctaatgttaggtattgtagcaggccgcaaaactagaggtgctcatttatttttctgttttgctcttaaaacaaataataaaaatgtacgctttgggttaatgaacttaaaaatcttgccaaagtatatgtgttaacacagagagagcccaaggctggctgccagcaccccggagtctgtaattatatatcagcaggtagacactctcattgtgactccttgaatttgttttaactattaacaacaacaacaacagaaaagtctttaaaaatctccttaccaaatatttcagtagagtttccaacttcaattatcaataatctctgtttttactctgagtttctcaatgtaaaaactaaaggatataaaatttccttaacagccgggcgtggt

SEQ ID NO: 233900 - DNA, 382 bp, Homo sapiens
agtttctcaatgtaaaaactaaaggatataaaatttccttaacagccgggcgtggtggctcacgcctataatcccagcgctttgggttaatgaacttaaaaatcttgccaaagtatatgtgttaacacagagagagcccaaggctggctgccagcaccccggagtctgtaattatatatcagcaggtagacactctcattgtgactccttgaatttgttttaactattaacaacaacaacaacagaaaagtctttaaaaatctccttaccaaatatttcagtagagtttccaacttcaattatcaataatctctgtttttactctgagtttctcaatgtaaaaactaaaggatataaaatttccttaacagccgggcgtggt

SEQ ID NO: 233901 - DNA, 521 bp, Homo sapiens
gcctgagccatgcgcacagcattttgttttgttttgttttgtttttgagatggggtctctcggtgttgcccaggctggattgcttattcacagatgcagttacagtgccctatagcctcgaactcctgggcctaagtgatcctcttgcttcaatcccctgagaagctgggactacaggcatggaccaccacccctgattgatcttctttagtttctataacaaaatagtacactgtttccacaaacttgggaaggctagtatttgggggtggggggcgtggaaatcactaaacaacaaagaaaatctgatgaattggacagcataaaaatattggcataaagatgaacataacataagcaggaatatttaaagcacatactttttatagagtgtctcccctgtaatgtctctggttaaatgaaagggtttcaaatgtgaagacaaccctaaccatactcattatctgtaaaagatgtagcattgtcatggactccttaataaacgtgaagactttaatcca

SEQ ID NO: 233902 - DNA, 373 bp, Homo sapiens
gcaccattgcactcctgaactccagcctggaccacagagtgagactctatctcaaaaaaaaaaaaaaaaaattgctttctgggtaggaaaaaaagggaagggaaaggaagggaagggattgattttgaaaggaataggaattctatacacatatacctccatatatacaaacttgaagtatggataaagattgagattgctatgtgggttataaaagcatgaggttggaagtaacttatatgtctagcaataggggattgattaagaaatcaaagtacagtctttcaatggaattgctatgcaactgttccaaagattgaggaatgtctagataagctctggttagtaagagtctccgagatgtattgtcaaa

SEQ ID NO: 233903 - DNA, 487 bp, Homo sapiens
ggacttccagtaaaatattgaaagtgggccttcttatttggttcctgagcttttcccttttcactatgatgttagctgggagtttgtcatatatggtctttattgcgtttaggtgcataactctatacctaattcgttgagaaattttgtcatgaaaggatgttgaatcttgtcaaattattttctgcatctattaaaatatcacatggtttctgtcactctttcttgtaacgtggtgtagtgcatttgttgatttgtgtatgctaaatcatcttgcatcactggcattaatcccacttgatcatattgaatagtcttcttaatatgctgttggatttggattgctaacaccttactaagaatttttgcatgtacattcatcaaggagtttttgttggcctgttgtttttgttgttgttgctgtgttgtttggttttaccaggccactactgccctgattccaaaaccaaacaacacagcaacaaca

SEQ ID NO: 233904 - DNA, 753 bp, Homo sapiens
agagactactatatagagactacttatatagacatagagtccctggacacaaaacacctgaccaaccgaccaaacctttccaccttgcccttcttccacagtgcttcggagcagagaggaagcactcccctctgggctgctggacagctcagcgagtccactgacctggaacaggcccaggaaggcaaagggggagaggagggtagagcagacactcaggactcaacagcaggaataaacaggtccagacgggccacccaggatacagtaaagggcctgaagtcattgttttggtaagggagccccatgggacaagagccaggaaaataaaaaaacgtatttcaatagatacccatttctacaaagcagcgataagctaagagctgctttgctgagaagtaattgacaaaaagtaacaagtagaagacttcttggtcttgaggaccttcttgtaaaaggcagaagcccgtgacagatgccaaactgctagctttgagcagcagtcccattgtgccggcccagctggtaaaccatgactagaagcactctcagggctctgaagctacgttaagtgcctcctggactcctcaagacacgaccatgagttgtttggtttcaggtttgaaaagcctggctgagagcctgggctccaccacccatgtgtgttcagagagctcttgcttatgcttcaaaaccctatttcatcagcatcacctcctctgcaaaaccacccgtgggctcatttaaaatttt

SEQ ID NO: 233905 - DNA, 1739 bp, Homo sapiens
gaaaaatatgatcatttcataatgatgaaggagtcaattcaccaagaagacataataatcctaaatgtttatgcacccataatggagcttcaaaatatatgaagcaaaaacatacagaaccagatacatcacaattatactagaagatttcaacacccctttagcaatagttgatagaatagttagaaaattagtaaagttataaaaggcttgaacaatactatcaaccaacctgacctaatttttttgttttttgagacagggtctcattttgttacccagagtggagtgcagtggcatgatcatggctcactgcagcttcaacctctcaggttcaggtggttttcccacttcagcctcccaagtggctgagagtacaggcatgcaccaccatgcccacctagctttttaattttttgtggagactggctcccactatgttacccaggttagtttcaaactcctgggctcaggtgatcctcctgcattggtctcccaaagtgctgggataataggtatgaagcactgtgcctagccaacctgacttaattgatatgtatagaacatgccaccaacagcagaatatacattctcttcaagtacacacagaacatttagtaagataggcattctgaattataaaatacatctcagtagatttaaaggacttaaatcatgttctctgactacagtgaaattaaatttgagatcaataacagaaagtacactggaaaaaaacccaaatatttgaatactaagtaacacacctctaaaaaaaacttagggggtcaaagaataaataaaaaggaaaattataatgtattttgcactgaatgatcaaaacacagcatatcaaaatttgtaggggcagtgaaagcagtacttagagggaaatttatagtgctaattgcctatattaaagaaaagaaggtctcaaatcagtgaccttggtttccatgttaagaaactggaaaaacaagaggagacaaaaatataagtagcataagaaagtctgtagtagaagtaatgaacaagtaaaaagtattagaagagaggaaattataaatatcagaacagaaatcaatgaaatagcaaacagaaaaaaataaacaacaaagagcaaacaggaaaaaacctgttctttgaaaatatcaataacactgataaatgtttaactagaccaatacagaaaataagagagaagacacaaataacaaaattaccttatatctattaaagaaatacaattttaataaatttgaatcatcataaagaagacttcaagcccagatggctttgttggcaaattctactaaacatttaaggaagaaataataccaatttcacataaaatattccagaaaactaaaggaggagggataatttccttctcccgctatgaggccagaattatgatacaaaagataggcaaagatattattaaaaaaagaaaactggccgggcatggtggctcacacctgtaatcccagaaatttggggggccgaggcaggtggattatctgaggtcaggagttcaagaccggcctgcccaacatggtgaaacctcatctctactataaatacaaaaaattagccaggcatggtggcaggcccttgtaatcctagctactcaggaggctgaggcaggaaaatcgcttgaactcaggaggcagaggttacagtgagctgagattgtgccattgcactccagcctgggtgacaagagcgaaactctatct

SEQ ID NO: 233906 - DNA, 1105 bp, Homo sapiens
tgcccgccctcccctgggtgcggagccggacggcgggcactggcaacccccgggcccctggagagccccgcggcggcccaagacccgctcccgagacacgtgggcccctccggacttggttggtccctggagccagctgcgcgcgtcctctccggcctccttgtcggcgctggagtgggtccacgtctgccttgcggagcgcggtggttccacgctcctgagcgcccacgctgcgcagacctggccgctctgcgaggcgacggcagcgcactgaagaccgtggtgtttcccaagccctccctgctctcgggcctccagggcgcagcaggggagggttttgtccccgtggccaaagctctgcaggtcgaaccttatctgctatgggaaggccccgcattttcagattcacgcagggccctctgcagactgttggcagaaaaaaggtagccaccaaacacatgcataagctggacttttcccagaatgctgcagcagaactaccctccagatagacactagcctgcgggccacagtgctacgtgagtcttgcaaagaggagatctttatggcgaggctgagagcactgcctgcatgctttaccagagcccagcctccagcctccacggaaaatgtgttttggaatcaacactctttgcaaaggctccacactgctttctggtagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaagtctgcactaattggtctatttagtagttgctgaggtggcaaaagctgcagctgctggtgg

SEQ ID NO: 233907 - DNA, 696 bp, Homo sapiens
  misc_feature (10)..(10): n is a, c, g, or t
  misc_feature (44)..(44): n is a, c, g, or t
  misc_feature (57)..(57): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (85)..(85): n is a, c, g, or t
  misc_feature (94)..(94): n is a, c, g, or t
  misc_feature (102)..(102): n is a, c, g, or t
  misc_feature (109)..(109): n is a, c, g, or t
ggtaagcccnccccaaaacaacaattgccaataaaggttgggancttttttcccaanaaatgcttgaaanaagaaacntancccntcccaagantaggacanttaagcnttgcgggggccacagtgctacgtgagtcttgcaaagaggagatctttatggcgaggctgagagcactgcctgcatgctttaccagagcccagcctccagcctccacggaaaatgtgttttggaatcaacactctttgcaaaggctccacactgctttctggtagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaagtctgcactaattggtctatttagtagttgctgaggtggcaaaagctgcagctgctggtgg

SEQ ID NO: 233908 - DNA, 748 bp, Homo sapiens
  misc_feature (145)..(145): n is a, c, g, or t
ttctccaaactgccgcattctgctcagatggaccagactttgagaatgggcagataaccagcagaagatgttagtgaacgtgtttaaaagaaggagcttctggtgatgaactgtcattcgaactgggcgggattgtgaggcttcngtcaccccagggctcttccaggaaaggctggcaggggccgcgggtgccctggagctgcctgcaggagtcaggcactaagtcagtgggagccaaggttggaaaggaagacccccttccattccatcctgaatgactccatgggtgagtgggacccaggacggctgcccttcagagctcagcccagttcccagagacgagacggtgagatggttaccaggatggtccctgccccttggccccggcctctgtttccagctgctccccttagcatctgcacaattgcctagtgaggccatcatgaccctgtgggcacagacttctgggactgatgcctgtggttgtggcacccccaccctcaccccttctccccacaggctgaactttgatccacacttttcctttgatttcaccgtctcctcccacgcctaaaataacatacaggcctttggctatttccaaagggtttctgggaactgcgccccagtgaggaggcttcccagcagccttggccttcccttcaggcagactcctcatccacagtcaggagcccacaggtctcagttcactgacctgctgagaaagaggaaaaaccttcaacacatt

SEQ ID NO: 233909 - DNA, 419 bp, Homo sapiens
atgaaggcccacattcttagaaggcccgtggggctctgtgtgatctgaccccgatttccactctagcctcccctctccctgtttcccctttgctgtctgtgctcagggcacagggctttcatctggaactggtcagacgcctttccaccgcagggaaggtccatgctgttcctgctggtttctgctgtcttttgccttgataacctccactcatgttttagaactttgttccaaatcacttcttccagcctcccccgacccctactccccaaagggtcaagttttcctttgtagacttaccacactgtaattaaatgcatgtgtcagggctgggagtgtacggaaaatctctattccttcctctcactttttctgtgaacctcaaactgctctaaaaaataaaagttctttaaaaaaaa

SEQ ID NO: 233910 - DNA, 454 bp, Homo sapiens
aagggtggggaggggtgcaaaaagttcagtcatgaagataagccatatttaatgcaatatgttaaaaatcaaaattaatccacaacaagttataagcaaaatatctagatattattaaagacagcataagttctgcaacagcagaactgagcagttgtggccaagagtgtatcacctgcaaaacctaaaatattaactatatttagtttacttgctaactcttactctacagcatttaggccttagagttattttcatatttcctcttaacagtttctacgttagcatataacgtagattagtaaagttttgtttgacaaaatattccttgccaaagactctgtcaatcagaaaataaataaaataaaatgtatgtggacaataatatggcaagcatgaactctttatttatttattattattatttttttttcttgagatggagtctcgctct

SEQ ID NO: 233911 - DNA, 361 bp, Homo sapiens
tgcaaaaccaggtttgaaacatttcccttattctgttattaaacctcacccttttgtaatatttgaggtttaattttcacatacttacaacttgattttttagtgcatttatagatcaactcattattcaggatttgtatttgtgtcttatattctttaatatttcttggcatccagcacatgagtctaaaagatacatggtaattttagttcctaagatgacaactacacatacacagccatatatccagaggtggggaaaagggtgaaaaatcagcctcatcaggaactgaaaatagatgggtttctatttcatgcctttaaaatattgtaaagcagatcccagggatatataggtttt

SEQ ID NO: 233912 - DNA, 712 bp, Homo sapiens
gccaaagtggcatattttggggtagcgttttctgccacccttcaagcccaaatgtctatcaactgatgaataaataaaatgtggtatatccatgcagtagaacatacttttcagccacaaaatgggataaagtactgatgcatgctacaacatggatgaaccttgaaatcattatgccaagtgaaagaagccaatcaccaaagaccacatattgcatattatgtgattccatgtatattaaatgttcaagataggtaattcatagagacaaaagttagattgttggttactaggagcatagaggaagggggtggagggagtaaggaatgactgctgatgggtagcaggtttctttttggagtgatggaaatgttctggtgatggtggaacatcttgataaatacactaaaagccactattttataccaccatacttggaaaaataatttaaaaatagagaaactggtagttttggagagagaaaatgtatttctacttttggaacactgggagttctcaaatttctcaagcctactgtgaagaaaagactactctgaaatttgggttacttagcttgtttgtttgtagagatggggtcttgccactatgcctggcctaacaaattgtttttgaataagataaaatgagccgagaggggaggatctcttgagcccaggagatggtgaccagcctgggcaacatagtgagaccc

SEQ ID NO: 233913 - DNA, 201 bp, Homo sapiens
gcgtccccactcccggaagaactgcgcgtttagagtaatgctctgccgtcagtgccttgacattctccatcattcttcaacaagaagcctcaggttttcattttgcactgggcctcccaaattatgtagccaatcctatctcaaagccaccatcatcttatgccctgccagtctattctgcttgtagctgccaagagattt

SEQ ID NO: 233914 - DNA, 397 bp, Homo sapiens
aagaggtttaatttgcccctagttctactggctttatagaaagcgaggtgctggcatctgcttctggtgagacctcaagaaacctacagttatggcagaaagccacggggagccactagggagccaacatgtcacatggccagagctggaacaagagagagtggtagaaactgccatatgcttaaataaaacagatctcgagagaactcacttgctaccacaaagacagaaccaagctatgagggatttgtcccatgacccaaacacctcccaccaggccccacctccaacattggggattacatttcaacataagatttggaatagacacatatccaaaccatatcagtgcttataaaattaaatattggcaataaatagaaaggtgtgctttaaa

SEQ ID NO: 233915 - DNA, 351 bp, Homo sapiens
ggagaatctcttgaatccaggaggaagaagttgcagtgaaccaagattgcaccactgcactccagcctgggcaacaaagcgaaactctgtctcaaaaaaaaaaaaaaaaaaaaagaaaagaaaagaaaagataattagggactcggaaagacaaagactgaaggattggtggcaatgagttttggggaaaaaatatgtagatgaaccacagtatcatcaggaaggttatcaaatagatatgaaggtatgaaacaatctctttcaccaggcactacattgcttgctcataaggctaataaacagcaacattggtggtagcagtagtagaatacacataggtttagcaacatg

SEQ ID NO: 233916 - DNA, 2465 bp, Homo sapiens
cagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggattttagttgtaatgctggcaagagttgtccccgtgcagacgtcaccttggaggaaaaggggtgtgcttcccaggtccccagccacagccccaagaaggaattgcctgcggaagagccttcagtgctgggcccatcggatgagcctccccgaccccagccaagggctgcccagcctgctgagccgggacagtggaggcttcccccaagttcaaagcagccgctgagcccggggccccagaagacattccaggccctgcaagaaagcagtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggcgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctccaa

SEQ ID NO: 233917 - DNA, 416 bp, Homo sapiens
caggctggcggaggctggctttggccctggagtcctcagaaaaccccccagcatctctgcctgtgtagtggggactccgagtggtgtgggaggagaggagagagacccaagagcggggctggcgttagggaggcatccccgcagtgaaggatgcttggagaatcagtcccagctgccgtggagcaggagcagctgggggaagtcaaggctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctccaa

SEQ ID NO: 233918 - DNA, 224 bp, Homo sapiens
tgtggaaacaggcaggtatggtcaagagagacactggaagatggaagttacttcagtgttccagttgctggtgtagccagggcttcacagcgtggaagtatggcatcatgatgtctactgcacatctattcccaaccccatattcagttgtttcatgtagtctcttgaaatctatggaaactagaaaacactacaaataaagccttgatttattgttttgttga

SEQ ID NO: 233919 - DNA, 412 bp, Homo sapiens
aagtgaatttgtgagccccgtggcagtgtctaggtgggggtgcctgtgacctccaaagccccagagggaatattacagtgctcttttagctctgccatctgcagagggcttaagtgttagcacctcagttggccttctgctttttcacgtgaggtggctgctttttgccagcaagagcaaagggccagtgtgacagctttttgtatccacacttgtggctcccaagctcttgtccagcacccaggaaaaatgaggtcgcacaaacaaattgaaggatgcgtggaagtatggcatcatgatgtctactgcacatctattcccaaccccatattcagttgtttcatgtagtctcttgaaatctatggaaactagaaaacactacaaataaagccttgatttattgttttgttga

SEQ ID NO: 233920 - DNA, 470 bp, Homo sapiens
atggaggaaactagacatgtgaagtatgccacctccaaagattctgacaccctggcacaaaattgagatgataaattctgataagattccaccagtaggtcatctcttggtagatatttgaacatgccctagaattcctctgttagttggaagtttggcttacctagcaactgggtgaggctgcctactgaatggcattttgaaaagttcagacttaaaatttcctattttgttttttctccattatgagtcttaccagtcctatcacaaacttttatgggaaagtggtttttcagctacaaaggtatttgtgcattttgcccaagacatatgtcctcctcaagaatatataactgtcatattctgtattgacatgagaatcaggatcatattaccacaagtagctagaagatttcattggttgtaagccagggaatggtctgattgattttgtccagcaagtaaaaaaa

SEQ ID NO: 233921 - DNA, 378 bp, Homo sapiens
cacaagtcatgtgatcacgggtgctctgtgacccttagctccattgtccacaaagcggcgacagacatagctcatagatgctaagggcctcactgtgcctctagaaagatccaggtacatttaaccagtgcaggtttcctgctccttctctccaaggaggacctggtgaggtgaccaggccaggtaactccagagagaagctgtgccttccagccaggaacgcttgatgtgggtggtccgcccgagctgtgtccctggttgctgacaaggcccttaaggctgtccccaaggggatgggagtcgtgggtctcagtgacctggctctggcctgagcttctcagagctctttcacacagcagcctctttcctctgcctttt

SEQ ID NO: 233922 - DNA, 390 bp, Homo sapiens
ctctgtttcctaacacgtgcatcaagcagaaggccactgtcctgccaactcccagggcgatggaaggaacagaatgaggtgtggacacaggagtagtttgtgccacagcactgtggggctgggatgtggctgtgtctagaagcgtccaagagagccttgatgtgcaaggtccaaccccacctctgcccccagctccaagatggcctggcacatatcccccacccaggtttttcctcccaggctgtgccccaccccccaagcgtctggccactcccaaggaatgtgggcccccggctccagacgcccacttggcctggcttcttccacaggacatgccccatccagctgcatccctcaaaggagccccagagcaggcagaccctgctgcca

SEQ ID NO: 233923 - DNA, 479 bp, Homo sapiens
ttgttcactgtaagtactttgtagacatatgagttgttttcagaattgttccttgtgattttctttcagcttttggtttttttggagacagtgtctccctctctcacccagactggagtgcggtggcccaatgtcagctcaccacaacctccgcctcccaggttcaagtgattcttgtgcctcagcctccctagtagctgggattagaggtgcatgccaccacgctcgggtaatttttgtatttgtagtagagatgggggtttcactgtgttggccaggctggtcttgaactcctgacctcaagtgatctgcccgccttggcctcccaaagtgctgggattacaggtgtgagctactgtgcctggcctcttcttttccaaaaaaaataataataaaaaaaccttttctgcttatgtattttaaattactgaataaattacatgtttgtacatgtttgttttagaaacactagaaaatgt

SEQ ID NO: 233924 - DNA, 377 bp, Homo sapiens
ggcaggattattctgatttgtatcacagtaacttaatgtaggaacattgacctttggatgtaacggagaggaatattaaaattcaaccttggggccaggcgcagtggctcatgcttggaatcccagcactttgggatccgaggtaggcggatcacctgaggtcaggagtttgagaccagcttggccaacatggcaaaactcccatctctactaaaaatacaaaaattagccaagcatggttgcatgcgcctgtaattccagctactcgggaggctgaggcatgagaatcgcttgaacctgggaggcagaggttgcagtgagctgagatcatgccactgcactccagcctgtgtgacagtgagacctgtctccaaaaa

SEQ ID NO: 233925 - DNA, 402 bp, Homo sapiens
tggtgtaagcgtatggccacaagtcctctctgggtgtcggcagagcctctgtgagggcatagtgtctgcttagggatcttgaacgtccttgctgcgccaacacaaaacaacacgtgctacaatgaaatgcaacccagagaacacgaagtggcggcttctgctgcagtggttacgtggtgactggccagtcctcagaaagttgatgggaaggatatgagcctctgtaacttcccagaaaaagaagaatgaaacctgccaagtgcatctactagacagacagcgaaaataccagctccttcatataccaccactataaaccactgtcgcaacagaaaaggccctgctcacccttgcacctccttcccaaatctgctgtcacattttctcaaagagaagcaggga

SEQ ID NO: 233926 - DNA, 379 bp, Homo sapiens
tatatcttataatttgtataggtagcaatgaaaatctcttttcttacttaaggaccagtccttttattttttgttttagcaatttttttgtggacccaacttttatcttttattttttatttatttatttatatttttgatatggtcttgctatgttgcccaggcttgtctcgaactcctggactcaacagatttgcccacctcagtttcccgagtactgagactacagacatgtaccactacagtcaaccagtcctattttctataaatattcccatcagcccgtcaggaccttactccattattttacatcagccttctgtcaaagtgtttctattgctgtgtcctttctctcacatttctaaatgaaattaaaaca

SEQ ID NO: 233927 - DNA, 210 bp, Homo sapiens
gagagggggtgcctggtgtcttctttctctctctgcccccaccaagtgcggacgcatcgagcttcggcccccacccctgcattcgcgattggctcccggaggaggtggctggtgctgccgccgctgcagcatctcctagggagccgcgaccctgcgcccgccgccgctgccgctgtcaccagcccggccccaggggtgccctgggctccg

SEQ ID NO: 233928 - DNA, 164 bp, Homo sapiens
cctttagaccaccactttaattgattgcagttggaaagtgaaaggaaagtgaaatgaaatgttttccagatactgggccaggtgatttctgtggttcctttgaatatttatcattttctgattttttggaattcccaaatcctggccaaccatctcccaaaagc

SEQ ID NO: 233929 - DNA, 568 bp, Homo sapiens
aataccggggaactgttagaacagagctttcaaagtctctgtggggaaggactgggttggtttattttatttacatgaattttcaatgtgtcataagtcaatactttgtgaactataataaaaatgtcacagtagcggcaaactgctatggaaacacataaacatatactttaaatttctgtacttacctttcatggattaataatattttgcgatggcccctggctgcagaccccctttgaagtagccccgaaggcccatttgtgcttcccagtgctgctctgtagacagctgcaggcgctgcatgggaatcatctgcagtgagccttcaaaccccccacctaagcccgttccatttatgttcatagaagtatgtgaatccggattttcccctaccatgcagcccaaacgagatgaaagtaattagacatatagggtctcttgagactgcatctgtatctacaactcctgacttcagatttttgctttcttcaaaacagccttatactctttgcattgtttgatgttttaaagagtaaatattaaaaatttgaacttataaaataca

SEQ ID NO: 233930 - DNA, 156 bp, Homo sapiens
cttatatttaaatgctcacttttctcagatactgttctaagtgctcagtaaaaattaagtcattttatctttataaccaacccttgaggtagggaccacctttatatccatctcacagatcagacacatttgaaacttcgaaaatttattcaacgt

SEQ ID NO: 233931 - DNA, 112 bp, Homo sapiens
ccagcctggttaacataatgagaccctatttcttttgtttttcttcaggaaatacgtaggtgtggtggctcatgcctatagtcccacctactcaggagatgaccctatcttt

SEQ ID NO: 233932 - DNA, 369 bp, Homo sapiens
cctgacctcaggaaactcaaggtcttgactcaaggtcgtgaacgatttgcaattgtatcttcacatatacgacacaaatgaggtataagcatttggctcaagtcataacgattgcaaattaaggcaaacactttgacgactgaagggcagcttccggacttttgatgggagaaggctaatgctgttttttagaagcattagcacacccgcggtcacttaattcaacaaatcagaactgtcttgtgcatataaaagttaaaaattttaaaacttctgtgaataaagataaaatcttgaacgataccctgatttttcagggaagcgctgtttgtataaatataaaataaatgagaagcgtattgtgtcatc

SEQ ID NO: 233933 - DNA, 313 bp, Homo sapiens
gcatggggtgattgctatagagtgacagtttgcatcccccaacattcatatgtggaaatccttatgtctaaggtgatggtattaggaggtgggccctttgggaggtgattaggccatgggtgcagagcgggattggtgcccttataaaagaagttcaagagagactcctcgccccttcctccatgtgaagacacagcaagaaggcaccatctataagccagaaagcaggtcctcatcagatactcaatctgccttgatcttggacttcccatcctcccgaactgtgagaaatacatttctgttgtttataagc

SEQ ID NO: 233934 - DNA, 390 bp, Homo sapiens
agtgtatcatattatgtcttatacatagtagttgctcaataaatacttactaaatttaattaaaatatttatatatttcatttggatagctctaagtacccatctcattcttatctatttttaattggtgttctttactttctggttttattctttatgtgaggaagcaagtctcaaaatttttggtctcaggcccctttgtactcttaaaaattattgagcactccaaagtgcctttatttgggtaggttatgggtattgttatttttgcattagaaattaacattgagataatttaaaaatatttattagtgcattctaagatagcaataatcaacccattatattttaatacagataacacttttatataagtttctatattttcca

SEQ ID NO: 233935 - DNA, 504 bp, Homo sapiens
agactgaaaatgcaaagtgcacaagagtctctggccaggacaggcattgaaggtcagcttcttctcctcctggagctcagctctgtgatcaggaaaccaattgtaaagtccagaatgaggacacgggctctacatggtgtggaatggcagtgagacgggctaggacttcagaactcaactgatcacacacaggagggagaagaacaaccaagctgggcttcaagatgccttatttggacactagtttttgatgtgtctctgatggttattaaccagacatttcaagggcaagaaactatttccccaaaactaccttttgagacatttccagaggctgccctgtcctctctgtccagagactcagccccgactcacctcctctaggaagtctcccacacggacctcgctctgctccctcctcctcacggctgaccctgctgggtcgtcctgccagctcggacacttgtttgttgtggcttttgtaaaatactctgtagtcatttt

SEQ ID NO: 233936 - DNA, 445 bp, Homo sapiens
gtgcacatttacgtggacgggtgaatggacaaagtcatattgtttgacgtcagattctgtttgctgcatcacttgaccttgaaatgtgccaaatttagatccactgtttgtggtcacttgcacgaaaaagcaatgaaatggtgggggtcggggagtatgccagatgaatagaaagaaatattagccaccaaggccctctcaagtgtacgtgtgtatacatgtggcctacgtgctctatgatacccacatgcatccagagacatttcacattttaaaacttatattttattcttaaaagtggaatggggaggaattataacaataaactgcgtttacttccttaggacacggtccaaaattcagggcttcaggtttgtaggatggaccctggccacagaatgtttggtcacaaatgtgtgaataaacggctcaaagtgtgatttgt

SEQ ID NO: 233937 - DNA, 401 bp, Homo sapiens
cgtcagtccacatcccaaagatgcacacattgggatgtgggaggaaactggagcacctgaagaaaacttcgcagacatggggagaacttgcatgctccacacagacattggcctcggccaggaattgattctttatccctcatcaacattataacaaaacgacactgaacagaataatgttattcaagaacctgctgtactgcacatggtatttttcagttctacagttaaatctttttaagtctcttccctgcccacttccaaagcacacatacacatcactatcactaccttgggggtctacaaaaatctagttcaaatacggaagaaaacaggtcatgctggaaggccatccaggtggggatgttcaaagggcagttggaaacttgtgtggaactcca

SEQ ID NO: 233938 - DNA, 599 bp, Homo sapiens
gggacagagtctcgctccgtcaccccggctggagtgaagcggcacaatctcggctcactgcaacctctgcctcccgggctcaaatgatccacccgcctcagcctcccaaagtgttgggattacaggcgtgagccactgcgcccggccatgctacgatctttaaaatgaaaacctaatcttggcacatctcggcctaaaaatcaccatgacccttattgccccccaagtccaggagctttataagaactagaaaactgcccctcccgcaagtctcatgtctcttttcccttcttgtaggtcaggcttcagccatacaattcctgaaatttctctcccatcctttcttactggagatacctgcacttgcttttcctctgcctagagctctcccctttacactccacccccacctgtgcctggcctgttccccctcacaggttcccccttacctagaaggcctttcctgactccctctgaggagaaggaggagcagggcttcaagctgttttgtgcctctgatttccagttaactgtgagtctcccgcactcaagcatgactgctgtgaggggagttacttcagctgtcatgtaactccata

SEQ ID NO: 233939 - DNA, 172 bp, Homo sapiens
cagattcttaaccaagccactccctgtctgtttgactttgggaaaattacttcatctttgaaaactttcatctgtacaataagaagaatgacaagtgacaagtacgtcatggggttgatatgaagattacatgatatagttaaatgataaaattaaatgctatcattataaa

SEQ ID NO: 233940 - DNA, 852 bp, Homo sapiens
ttaacctcttggactcaagcaatcctcctgcctcagcctcccaagtaattaggaatataggcacatgctaccaggcctggccttacagttattttttgtagaaacagggttctctctatgttgcccaggctgatgttgaactcctgggctctagcaatcctcccaccttggcctcccaaagtgttgagattacagccatgaaccattttgcctggccctttttttttttttaaacatagcattacattgtatgaggtattataagtaatctagagattacttgaagtatatgggagtatgtgagtagcgtatcaaagttgtatttattgagtggctgaaggtgaggtattattttgtggatttgtctttaaaatcaacattgaagtattttatatttttttaaattatgagatagcattacatttcagttaaattacaatgcttttaactaggtagatttcctctgcggcattatgattttaatccagtggttgatgagtatgactatatatgtttttcaatccctgatcaaacattaagtccttattagaaatcagtgaaatgtggccaggtgcagtggcccatgcctataatcccacactttgggaggctgaggcgggtggatcacctaaggtcaggagtttgagagcagccttgccaacatgcgaaaccccatctctactaaaaataaaaaaattagccaggcctggtggcttgcgcctgtaatcccagctactcgggaggctaaggcaggagaatcacttgaactggggagatggagattgcagtgagctgagattgtgccagtgcactccagcctgggtgacagagtgatgatctgtctcaaaaaaa

SEQ ID NO: 233941 - DNA, 691 bp, Homo sapiens
cttgctcctaggttgccttctaggagtttattgttttgtgttttacattaggtctgtaattcactctacattagtttttgggaaaggtgtaaggtctgtgtctagattccttcttttttttttaaacatagcattacattgtatgaggtattataagtaatctagagattacttgaagtatatgggagtatgtgagtagcgtatcaaagttgtatttattgagtggctgaaggtgaggtattattttgtggatttgtcttatttcagttaaattacaatgcttttaactaggtagatttcctctgcggcattatgattttaatccagtggttgatgagtatgactatatatgtttttcaatccctgatcaaacattaagtccttattagaaatcagtgaaatgtggccaggtgcagtggcccatgcctataatcccacactttgggaggctgaggcgggtggatcacctaaggtcaggagtttgagagcagccttgccaacatgcgaaaccccatctctactaaaaataaaaaaattagccaggcctggtggcttgcgcctgtaatcccagctactcgggaggctaaggcaggagaatcacttgaactggggagatggagattgcagtgagctgagattgtgccagtgcactccagcctgggtgacagagtgatgatctgtctcaaaaaaa

SEQ ID NO: 233942 - DNA, 440 bp, Homo sapiens
gagcacactgcgggtccgtgggtcagctggggtgtctccgctcctcgtgtctcttatcctccttggacctagccaggaatgctctcatgggaatggcagaggcaaagatggttgggagaagaacaatcaccaaaaatgcagagtggggagcgggcctgagtgttggacctctccttaaacaaaccttcctgcagcctccaggtcaccatccttgtcacctctactgccagagacatcgagtgccttgaagtcctgggctttccggggattctgtggggtatttccagtgaagtcccactctcctcaaccctcagaggatctctggaaggccacacagaacctgggacaggaaccaaggcacagggatgggatggagactcacaattcactgttaacattttgattctcatttgaatttttaacacacgcatctatcactt

SEQ ID NO: 233943 - DNA, 447 bp, Homo sapiens
ttcatttgtaacattttgatttctccaaatttcactgagggttattgacatcacatctagttaatgactaagttctgaatctggtgaggaggttaaaatcttagagacgagtaacttgttattaggacattagaagagaagaaaattcaaataattgcatttttgttcagttagttttgacagtagttattctaccaaagcgacatttacagttgcagtttctccgtaaaacttttttatgtttagcactaaatgctttttataatttcgaataatttttagacctagtggcagaaaattcttcagtggtccctaagtcttcttcatattgcactcacttggagacctttcaaataatagattactgggtcacatcccaatatgtctggtcctagtgaattgatattgtgtggaacagagaaatctatttttaaagcaagctttcca

SEQ ID NO: 233944 - DNA, 347 bp, Homo sapiens
tgatttactattgactcattccaatgctagccttctctctgagaatatattactatgggtgcccaaggtcaaggcaacacaagtcatttcccactcagggtagtgaggtcaagtttcatttatttcctgccacatgttaagttggaagatgacactagcatggcatcgtaagttcattgtagagctctaatcaccataaaaagcatcaagttttcactgaaaattttttcctttttttcctaccaggacgtctgtcattttcatattgatttatcagcccttagtgtaaggatatcatccattgtttgtcttacgtttgcaaataccaattcttttctcagtcttct

SEQ ID NO: 233945 - DNA, 438 bp, Homo sapiens
agtctctaagatatatcactcaatttcataacagaacacaaattaatgtataagatagtaatgatgggaatgaaaaggtaactaagacatagttccagtcctcaaggacttaaaaatcttactcactgttgagtttggccaactatgtactacctttataaacaggggaaaaaagtagaaaatcatcagcattctggtgttattcagaacactcgagtcagagcaagttctgattccagttctaacagtaactgtgattttagacaagtctctttcttacaacctctctgtgtctgtgcttcatatacttattcaatgaatgaactaaatccactggtttccaatcttactatgcaagagccccatttattctttttctccataatcctgtttttaaaagttttgtctttaaaactttccatttgtaagtcgtggcaa

SEQ ID NO: 233946 - DNA, 484 bp, Homo sapiens
ccatatgtatcacgtcaaccattgcccatctagcatctggcacagtgccaggcatatagtaggtgtccaaaaaatattggaatgaatgaaattctcgagaagttctctcactttagggccttgggatcgagggcaggagtgtgcctgtgaccagctgtcattagttctattgactacctgtgggaaagctggtcaagtggccacttgctcacctcaagacaatgaatgaagctttcctggatgctaagtgactgccaccttgtgagctaagcctggcaagacctttgggctacacttccctcctcactgtgagctgtggcttgggcaggctcaaaggggcccactcactctgcagatgtgcctcagggacatggatgactctgccagctgcacttgagggcaaaataatcatttacagcttcccaggtaaggctaacacttactcaactgcagtaactagatgcccccaatttaataaaaatta

SEQ ID NO: 233947 - DNA, 219 bp, Homo sapiens
cccatcccccatccctagtaaacagcaccagtgcagtttgagttagaaaactggaaatattgagacattcctaaggttttcatcacgactaagggccagtcagatggggctctaatgaaaacctctgccatggccgttctccaataagcaccccatgtaattccctctaagtttgcaaataaaacatattaggtctaatgtaaggccagattctggaaa

SEQ ID NO: 233948 - DNA, 266 bp, Homo sapiens
cctcttctatacttaagttattttgactataactgatcactgatcacccatcatttaaaaaatctgctagtgtttttcattcatgtgaaaagggtatctgcccacaggaccaaatgaaacatagtcacctcatgtgtagccatcacagagtaactatagcaattccacttttgaaaagtgaaagaaagaaagctcctcaagcacatgctgaaaataagtaggtactttcaatcttatccttagcatcctatattgtgtactattca

SEQ ID NO: 233949 - DNA, 2472 bp, Homo sapiens
  misc_feature (885)..(885): n is a, c, g, or t
  misc_feature (2083)..(2083): n is a, c, g, or t
  misc_feature (2140)..(2140): n is a, c, g, or t
ttaggaaatgcagttttagtaggattgtatggactgaagtagagaattaagtgaagaaatttttaactgaggagaatcccttaatgtggttttggtttggaatttttttcttaaatttttgtagatacatactaggtatatatatttatgaggtacacaagatattttgataacggcatgcaataaataatcacatcagggcaaatgtggtatccattacctcaagcattaatcctttaattgtattacataactaaaaaagtataaatggattgatttggggtttttttaccttatatttaaaaataacctttaaaaatcccacatactgaatgccacatgaactaaaagcatgaatttattaccaaaagttgtttgtaaatctaatatttcatatggaatcttactgaacagcattcaggagatttcttgttggctaattcctcttgagtctttttgcaaagtaattgtattctttattccatctatctattgtttacatttatgtattgagggagaacgtagagtttagttttgagcatttttgtttgagtcgttcattaaacatcaagtggagatcttgagtgacaattaagttgtatctggagttctggagaaaaaatgtatactggattagtcagggatagatgggaagtaaagttgtgagactggatgagaactctccaagagaatgagtataaatagacttgcaaaaatctgtgttagaattatcaacacagattatgacccagccaactgaaggaaaggaataagatcagctcaaaatattggcagaggacaagaactagtttaaaaaaaaaaaaatgaatgaatgagtgaatgaaaccctcgcagtacattgtatgctaatactattctcctatntaaggggctttgagtatccgtggattttggtgtcttagggtgggaatgggagggtgattcctggaaccaatcccccatggatattgaggaactattgtaaatttactgctttctctctcgttatttttcagatttacctgtctactccagcatatcattgcagagtaccagatttaattttaacaattcataataaagtctaaaacatttttaaagctgatcaataaattttaaaaatttgttaatcccataaaatggggagagttggcaccaatataatattactctgataaacaattctggggcaggaatatttccatgcctctatgctaaataaaacttagaacaagcaaacatagttgtatgcttgctttaggaaaatctcactcttgatggtgaaacaactaaaatagcttatttatcaagactgatttcccaaaaagacttgcttcaggacttcccatttcatcattcttaccaatccaaaactattttgtcagttctaaccaggttctcaccttgaaaaatgctgattaaagtggtccagcccacccaaccctaaaaccttgtaaatatccttctctgtctttcctcttcttgttcttcctcactgaagtcagtctgctaaacttagctttgctagatgagtgaggttttttaatgttgtttggagagttgacagtatataagctagttatgctgaataatatatggggaagaaatcaagaattcagaatcttaactttcttttcttattttttaactgtctgctagtttatctgtatggacatgcatgtctgaccaagctatgaaatctccattcttagattgaacttctttccttctcgcctccatttatttttctcatctacccccaccccaagtcatgggatagggagagttgtcctattccttttctgtctcctaaagtagtttacccttatagaagtcttgaaaccagattcatattttatctcattttagtaactagtatccaaatcccaccaagtttacataagaaatagcaaaacaaaaggaaccaactgggtatttatctaccaatgaagatactttaaatagcaatacatacaaggtaatgatctaactttgtatgttttgacatagaaaagtaaacaccgtgaaagtaggtgaaagagtatatatattacctcatttttaaatgctttcgtgcataaanaaaatctgaaagtctgtgtgcctcaggaaagaagtagataatcactttatttttttnaaataaatatcttttattacctctgcaattaaaagtattacacatttttaaggatgaaacaatgagagacacaatgatgacatacatctgccaagtagatgctgattttagagaagacttttttcccagtttgttgaaaagtatgagtaggtaggtagttaactgaaggtaactgaaggtagttactgaaacttttaaaaaattaaattcttaaagtctttgtaccgtcttttcccagaatatggaatatgtctttctacttgaacttctgagattcctaaagcaatactgtttaaacacttacattgtcactaacaatggatttaagtgaa

SEQ ID NO: 233950 - DNA, 1318 bp, Homo sapiens
ttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggatgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgactggattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttat

SEQ ID NO: 233951 - DNA, 235 bp, Homo sapiens
tcatgctcgggcctccatgcctggtccagggcttttgccctggcctcggcctgccccctgcagccctgggacagtggcagccacccttctcgagcacctgcttccttcctgccggacttgggtggggatggtaattgctgctcggttttcctgtctgggctgctgtgaggattccgtgacactatggatgccgaaaccctttctaaagaaccataaagccctagagtatggaagg

SEQ ID NO: 233952 - DNA, 409 bp, Homo sapiens
catacacttgccacgcggaccctaaagccagtgcctgggcgcccaagtcaggcagtccacacagcagtggcaccagggtgaaaacctgctgctcaataccatcccggttaccacgaagagccagccctggtggcccctgagttcttggaggaggccaagtcacagcaacccctcaagtgggtgggcgatgcacttgaccctgaggacatcaggtaccaggcctgccagctgactccagcatcggagccgcagctgcagtctagacgtggtgcaccggcaataagtgactggacaccccagaccaggcccgcccccaagtagcgtggatcttgaggccagacccctaggcggcaaaatcaggcgacgggccccgccagcagccgctcagtttcatccatgtggatacaga

SEQ ID NO: 233953 - DNA, 375 bp, Homo sapiens
taggtccatccaaacacctgctttgtccacttttgactgggactttgggcactactgggccatcccaactatccacagggccctccataacgtgcattgcacctgacatctcccagcagtgctcagcagcccccactgaccaggtccctgctgaccatatcccacacatcaggtcctcccagaacacaccctcattgattagaaccccatgaccaggccccactaaccaggcccctgctgccaggcccacaatgaccaggaccccactgaccaggaccttactgaccaggccccactgacaaggtccttactaacaaggcctcactgaccaggtccttactgacaaggcctcattgaccaggtccttactgacaa

SEQ ID NO: 233954 - DNA, 549 bp, Homo sapiens
tccacaaagagcaactgtaaaacctgggtaaaattttgtttaaaaatatgtttgagggattgagaggctgcagaggcagccaggacttggggagccaggttctggaattttacagaggtgagccccactttctgcatttcatggtgaagtattgaacgctttgccgctgaggtcaggaacactgttctcatttctattcaggattgtgcttggaggtaccaggcagacaacaagacaagaaaagaaaagtcttaaggattgaaacagtaagaaacacaggtatcattcattatttgtagacaatgtggttgtgtatgaagaaaatccaaattaagtaacagtcagactcttaagctgagtaagtaatttagcaagatcaatgggcaggggtcaatatactaaacttaattgtattttagtatttttatatatatcaatgatgtacaattggaaaatgaaatttatagatatcacttataatcacatcaaaattgagtacataggaataaaatcatatctaataaaagacgtgcaagacttctaagcaaa

SEQ ID NO: 233955 - DNA, 307 bp, Homo sapiens
atgagttaatttctgagatctgcagataagtagggcctctgagaaagcctggttgtttacttcaccaatatagatttttctcaacagatgcaaatcttaatgaaaggcagctttttagggctattgttgtctgcaggccctctgaatagccgtctcaaaataggtcaaagaaatatatttgagggtgaaatctttttggtttcctttagtctcccacttgaaactttatcttcacaaagattcacatattaatcaaagattggtagctatggggaaatttgggttggagattgtgagatagattgac

SEQ ID NO: 233956 - DNA, 151 bp, Homo sapiens
tgaaaaatttatttgtggattccttagattacctttttgcattactttaaagaagaaacactgtaaatgtttgctgtattaaagagaacaactcatacaccttttcacagaaagtagcaattaaaaactgtatcttagtgctattatctac

SEQ ID NO: 233957 - DNA, 652 bp, Homo sapiens
agtcagtgtagacttctgggaggaaggagtaactgtaaggtagcaaaagtggaccttttagggagtgggtcacattctgttcttcaactggatggtgcttagaaggtgtcactttgtaaaaagtctgtgagctctggactcaagatatatacatttatacctcaataaaaatttattttaaaatattaattagaataattgcaaggtagaacccaggaaacctcccagcaaggagagcaaaaacacagagaaagaaagcaggaaaaaaaaaaaaaaagatgaaaactggacctgtccaggagactgaacatctaggtaataggatttccagaaagaactgagaaaaatggaagaggaggtgatcaaaataattcaggaaaaattcaagaagagaaatacagggatcacctgtttgacagggcccacaccaagtgtacaacccaaatggatgaatctgcttggattcatcactccaaagcacctcatcaaaactgtcacaaagtattaataatcagatcaacactaaattcatcaacagccacactgcaaggtacctaccttaagaggtaggtacctaccaagagatagcatttccttaatcatttcttcctctacatctttcctttcccccaggacaggcaaactaccatat

SEQ ID NO: 233958 - DNA, 472 bp, Homo sapiens
acagggtgtcactctggagcccaggctagagtgcagtggtgagatcacggctcactgcagtctcaacctcccaggttcaagcaatccaccaaccttagtttccccaaagtgttaggactaccaggcgtgagccactgcacctggctccaaagggaaatttatgtatatttaaatgacaagttttggcaagatgctgtcgtggaattggtaaaattttttgtgagtctattaaatctaaaatactcaacatcaatgaaaagtaactataagactcaaccacacagacaaaaaggaaaagcacatatattaaagaatttggccaggtgcggtggtacgtgcctgtagtctcagttacctgggaggctgaggtgggaggattgtttaagaccaggaggcagaggttgcagtgaaccaagatcacaccactgcactccagtaagggcaatagagcgagacactgtctcccaaaaaa

SEQ ID NO: 233959 - DNA, 449 bp, Homo sapiens
ttgccctcatcccctgccctgtctctgagacgtgtccagtaaacctgaggtcagcacctcaggaatgaaataatgtcttttgcagcaacttgaatgaagctggaggccattattccaagtgaaataactcaggaattaaaaatcaaatgccatatgttctcacttataagttggagctaagccatgcgtatgcaaaggcatgcggggtgacataatggactttggagactcagacatgagggtggcaggtggatgaaggatgaaaaaactacctgttgagtacaatatatactactcaggtgacaagtgcactaaaatctcagaatccaacactatataattcattcatgtaaccaaaaaccacttgtacccaaatgatattgacattaaaaaaaatttaaaactaacaaaatttataataaaagctttttaaaaaataaaaaataaaa

SEQ ID NO: 233960 - DNA, 422 bp, Homo sapiens
gaagtttacaatagtgtgtaggatgtagccgctacccttggggccctgggaaccttgcaccacagttatgtatgcgagtatattctctccccaaggtgaacggtggagcttttgagggcaagaccctgcacctcacagcccaggcattgacaaacgggaaatcggacttttattttcaggtttgagctcagtttaattcttccatacagctaaatatgctattgctgtttgggcctttcagcaatcttagggaggcgagtgtgccgtctcgttttttgctcgcagaaacaatacgtggtcattgtattttccatttccgtttaccttttttttttgacagaaaagcacaaagaagcaaataaattataatcccagcactgagagagaataactgttgtcgtgtagtgtgttttcttctgtca

SEQ ID NO: 233961 - DNA, 1195 bp, Homo sapiens
  misc_feature (994)..(994): n is a, c, g, or t
  misc_feature (1146)..(1146): n is a, c, g, or t
  misc_feature (1150)..(1150): n is a, c, g, or t
  misc_feature (1154)..(1154): n is a, c, g, or t
  misc_feature (1156)..(1156): n is a, c, g, or t
  misc_feature (1160)..(1160): n is a, c, g, or t
  misc_feature (1165)..(1166): n is a, c, g, or t
agcgggtttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggatttctctagagtcattcacgccattgctaattcgggaaaacttgtanttggacacaatatgctcttggacgtcatgcacacagttcatcagttctactgccctctgcctgcggacttaagtgagttcacagagatgacaacatgtgtattccccagactcttggatactaaatagatggacagcacacaaacttttacngatntcantnaacnacacnntcctttcgcattgcgaaagcgctcacaca

SEQ ID NO: 233962 - DNA, 954 bp, Homo sapiens
agcgggtttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtaagtatttatattgtatgcagcagctctgtgggggacccaggatttaaagactaaatataatctcttagttctcatttcctttttgaaattctgcggttctcagtgatttgactacatgaagttccccctactttcttaagttgaatactcac

SEQ ID NO: 233963 - DNA, 1112 bp, Homo sapiens
  misc_feature (911)..(911): n is a, c, g, or t
  misc_feature (1063)..(1063): n is a, c, g, or t
  misc_feature (1067)..(1067): n is a, c, g, or t
  misc_feature (1071)..(1071): n is a, c, g, or t
  misc_feature (1073)..(1073): n is a, c, g, or t
  misc_feature (1077)..(1077): n is a, c, g, or t
  misc_feature (1082)..(1083): n is a, c, g, or t
agcgggtttccggaagtcgcggccggcgtcaccgctgcggctgcctcagctactgccgcagtcgccgcggaattcgattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggatttctctagagtcattcacgccattgctaattcgggaaaacttgtanttggacacaatatgctcttggacgtcatgcacacagttcatcagttctactgccctctgcctgcggacttaagtgagttcacagagatgacaacatgtgtattccccagactcttggatactaaatagatggacagcacacaaacttttacngatntcantnaacnacacnntcctttcgcattgcgaaagcgctcacaca

SEQ ID NO: 233964 - DNA, 319 bp, Homo sapiens
acagatgttttatttcccttttccagcattccatggactttttgctatttcagtttggcctttgcacttttaagtatgactacacagattcaaagtaggttgtgttaacaaacgttgggaattccgtttttgtggcacaatgtcacctcctaagtctccttttatcttatcccaggtatataacgaagtcatttaacttctatgttttcccgaaacccttcaatagatcctcaccagatgtcaaatttgtttgtcaggtaagtagcataattgagatttttcttttctgaattgctgatgaggcagcatggaaatgtga

SEQ ID NO: 233965 - DNA, 384 bp, Homo sapiens
tgtgtggatagtggacaggtgctgggaatgatggatggcaggaagatctgatactagagcagttaaaattatctaggcaagtgagatggggaaatgaagtcaaacagcagcagcagggatggagggaaagtgacaagtttatgagtctaaactggagagagagaggatgagggaagaagaatgtagaatttgaagattgtttggttcttctggtcttccaattatgttcaagtatatgtgagatgcaatggtcaaagtaataggtacataataaataaaccatttctgttttcagcatctgtagatcaaactttagcttgccttagtttatcattcgtgtgtttagactatgatcaaataaatatattcattttcacactctat

SEQ ID NO: 233966 - DNA, 340 bp, Homo sapiens
gagaccctgtctcaaaaaataataataataaagcagaaaaattgagataagaagtgaatgtgaacaaaataagatggaaattggtggctgcgtgccatggttcacgcctgtaatcccagcactttgggaggctgaggacagaggattgcttgagcccaggagttcgaggccagcctgggcaacatagtgagaccctgtctcttacttttttaacttttttattatatggggaagactggacccagatgtctgcctgaatacataactaatacttatagagtgcctactatgtgctgggcagtgcttaaagagcttaataaatattaactgaataatttaa

SEQ ID NO: 233967 - DNA, 743 bp, Homo sapiens
attgcttgagcccagaagttcaaggcttcagtaagctacaattaagccattgcactccagcctacatgacaaagtgagaccttttctcaaaaaaagaaaaagtatcaaagatccaaagcaacattgcttagaattcccttcaaacaaatttaagctatttaagaccaaattaaatagaccttattttaattggggttccttgtaaccgtgtacttgacagtagaattctttttctcttgatgttatagtattataaattgggatattgtggttgtcatgacatttgaaatgatataaataaactgagaagaaattgacttaaagtgagagtctggcttcacttacgctgggattcctgagacaaaggtatgtgtccggagcagagtttagagaagaagctttgtcagaatggaaggatctagagttatgctctgcagtatggtggccactagccatatgcagctatttaaattaaaattaaagattcaggtgcacttgccatgtttcaagtactcagtagccacatgtggtcacatgtccttgtcttagcacaggtttgtaacatttccaccactgcagatagttctattggacagtgctggtaaggatttctactgtctgtattttcttatttatatgaaagagcagatgctgggcacagtggctcacacctgtaatcctagcactttgggaggctctgtttgagaccagcctgggaaacatagcaagaccccatctctaca

SEQ ID NO: 233968 - DNA, 535 bp, Homo sapiens
attgcttgagcccagaagttcaaggcttcagtaagctacaattaagccattgcactccagcctacatgacaaagtgagaccttttctcaaaaaaagaaaaagtatcaaagatccaaagcaacattgcttagaattcccttcaaacaaatttaagctatttaagaccaaattaaatagaccttattttaattggggttccttgtaaccgtgtacttgacagtagaattctttttctcttgatgttatagtattataaattgggatattgtggttgtcatgacatttgaaatgatataaataaactgagaagaaattgacttaaagtgagagtctggcttcacttacgctgggattcctgagacaaaggtatgtgtccggagcagagtttagagaagaagctttgtcagaatggaaggatctagagttaatatatatagtgtctagaatcctgcacggttatatactgagctacaagtgttggctgacataattattgtgattattatcaccacccaagaccagtgtgtgatgagag

SEQ ID NO: 233969 - DNA, 369 bp, Homo sapiens
tgaaagatgttagctcctgtttaaagagaaagaaattactctcctctgaaagccgcacttggcagcaagattactggctggtgagaagcagcgtgagcccggacgctgcagctggagtggcaatgcctggcttccaatgagagctgcttacagtgactacatgtccatgcatgcaatcgtccatctatccatccattcacctggtcaggtaaatcctggcgaagatctgggttcacacagaacacaataccctttctccagaggaccactgacacaagactatttgaattaacattcctacctccactaacttggcagaagaaaacaagtgcataaaccaatatacaggttggttgttcaatgtaatcg

SEQ ID NO: 233970 - DNA, 577 bp, Homo sapiens
caagttggacaagcttgaattaaaccaatagaacaatttgggtataatctatatctttactatgttcagcctttcatcccgtgaatatagtatgcctctccatttctttagcttttattactttcctcaacattttatagttttcagcatagaggtcctgtacatcttttgttagatttacaccagaaatatttcatttttgttggagtaactgtaaatgatactgtttttcttgtattttcagatattgattattgttacatagaaatgtgaataattttgtttgttgatcttgtatcctatagccttgcagaacttacctattcgttctagaaatttttttgtatattccttgacattttatacattgacaattatgtcacctgaaaatagagacaattctattatttcctttccaatctgtatgccttttatttctttttcttgtctagtgtattaagacatcaggtatgctctttagtaagaatgttgagagtgggcattttttagttcttcttgatcttggaaaaaccattcagtccttcatcattaaatgtgatttaactgaaaaaaaaaa

SEQ ID NO: 233971 - DNA, 670 bp, Homo sapiens
  misc_feature (670)..(670): n is a, c, g, or t
tgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatttctgcagtcttcacttttttctttttcttttcttttttttttcctttttttttttttttttgttttgttttgttctaggcacccttttcttctctaaaatttccactcaactgccttagggtaaaagtggaacagggtccattattgagcagaatacaaatgcagttaattgactccccctctctctctctccctctctttcttttttgttttaatttgattaaaaagcgagtggcaggaagggaatcgtatgatgcacatctaataactctgccatctgtctctgctgctggctagctcccagcattgtacgcagctgcctgagaactcgactcggagaaaggggagggaaaggggagggaaaaaaaaaacccacaccatgtcggccgccttggccaggcgactctagactgagccagcttatgcatggcgccgn

SEQ ID NO: 233972 - DNA, 780 bp, Homo sapiens
  misc_feature (610)..(610): n is a, c, g, or t
  misc_feature (780)..(780): n is a, c, g, or t
tgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatttctgcagtcttcacttttttctttttcttttcttttttttttcctttttttttttttttttgttttgttttgttctaggcacccttttcttctctaaaatttccactcaactgccttagggtaaaagtggaacagggtccattattgagcagaatacaaatgcagttaattgactccccctctctctctctccctctctttcttttttgttttaatttgattaaaaagcgagtggcaggaagggaatcgtatgatgcacatctaataactctgccatctgtctctgctgctggctagctcccagcattgtacgcagctgcctgagaactcgactcggagaaaggggagggaaaggggagggaaaaaaaaaaccganccctccaataaaaaaacatgtcgccagcttggccagtcgatttagactcggcagctatgcatgcggccgaattgaggtacttggcaacttgccttatgggaggcgattcttaagggccgcgtttacaagggggactggcctgcggtcccaactaaggcttgggttctctn

SEQ ID NO: 233973 - DNA, 692 bp, Homo sapiens
tgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatttctgcagtcttcacttttttctttttcttttcttttttttttcctttttttttttttttttgttttgttttgttctaggcacccttttcttctctaaaatttccactcaactgccttagggtaaaagtggaacagggtccattattgagcagaatacaaatgcagttaattgactccccctctctctctctccctctctttcttttttgttttaatttgattaaaaagcgagtggcaggaagggaatcgtatgatgcacatctaataactctgccatctgtctctgctgctggctagctcccagcattgtacgcagctgcctgagaactcgactcggagaaaggggagggaaaggggagggaaaaaaaaaacacccaccagaatcgagtacttgccaattcgcctatgggagcggataccttctgccggcgttacacgtcggactggcctgcggtact

SEQ ID NO: 233974 - DNA, 674 bp, Homo sapiens
tgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatttctgcagtcttcacttttttctttttcttttcttttttttttcctttttttttttttttttgttttgttttgttctaggcacccttttcttctctaaaatttccactcaactgccttagggtaaaagtggaacagggtccattattgagcagaatacaaatgcagttaattgactccccctctctctctctccctctctttcttttttgttttaatttgattaaaaagcgagtggcaggaagggaatcgtatgatgcacatctaataactctgccatctgtctctgctgctggctagctcccagcattgtacgcagctgcctgagaactcgactcggagaaaggggagggaaaggggagggaaaaaaaaaagagtcgtataccaatcactgggccgcgttttacaacgtctgactgggcaccttgcgtaccccatttcgc

SEQ ID NO: 233975 - DNA, 718 bp, Homo sapiens
tgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatttctgcagtcttcacttttttctttttcttttcttttttttttcctttttttttttttttttgttttgttttgttctaggcacccttttcttctctaaaatttccactcaactgccttagggtaaaagtggaacagggtccattattgagcagaatacaaatgcagttaattgactccccctctctctctctccctctctttcttttttgttttaatttgattaaaaagcgagtggcaggaagggaatcgtatgatgcacatctaataactctgccatctgtctctgctgctggctagctcccagcattgtacgcagctgcctgagaactcgactcggccggcgcagcgaacgtcccggtcctgatcaccccccccccactccctaccccctacccgggcgcccgcgcttacccagctgcccctcgaactcggcccgctctcgccagccgctcgcttcgcggctcctcggcccaccctccccccc

SEQ ID NO: 233976 - DNA, 645 bp, Homo sapiens
  misc_feature (579)..(579): n is a, c, g, or t
tgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatttctgcagtcttcacttttttctttttcttttcttttttttttcctttttttttttttttttgttttgttttgttctaggcacccttttcttctctaaaatttccactcaactgccttagggtaaaagtggaacagggtccattattgagcagaatacaaatgcagttaattgactccccctctctctctctccctctctttcttttttgttttaatttgattaaaaagcgagtggcaggaagggaatcgtatgatgcacatctaataactctgccatctgtctctgctgctggctagctcccagcattgtacgcagctgcctgagaactcgactcgggggaagcnaaggtgagggcctgacagctatgcatgcgcccaatttgagtcacttgcctcgccctagggaggcgg

SEQ ID NO: 233977 - DNA, 278 bp, Homo sapiens
ttccttgatggccagttgcatcaggagtgcaacctggagtggctttggagtgcatccttccagccacccagaacgctctccctttagtacacttgccaggtcatccagtgacaaggaggtcacccacgcatacagtgtcacattccgcatatgacagccataatccttagactgtgcttcactttgttgaccccagctttgcctccatgcagattccaatcatgtatccaggccctgccctctagagtatagaagagtatattgtatttcttccagaa

SEQ ID NO: 233978 - DNA, 484 bp, Homo sapiens
taagaatggtaagttttcctgactttaatggtcagagagaacgctaaacctttatttaggtagaagaattaaatgacacagggaggaatctccaaaaagtaaaagaagtctcctttttttggaggaatctccaaaaaataaaaataaaataatatgctattattttaattccccaatccatgttggtaagaacacttaaccacaaatattatagcactggggcatatatatgacagcctacaggcacattcctttgtaatgattgcttgcctgttctaaattggtgttttttaaaaacctgcttatttacttatatatgtgtgtgtgcatgctactgttgaaaaatgtataactgcgttacatctaccctttcccactgaacaatagtagttctacaaaactcctcagtgcattgtagaccctccagaaagaaagtaggatgaaatcactgggtggtctcggtggtcatgctgccttttggctc

SEQ ID NO: 233979 - DNA, 437 bp, Homo sapiens
gagtaactttagcttgatatagtgttatttcatggttgattatgccttgattgttttgcttgatctgaatgttttcagtctttgcttaattttacctgtgactgaaagagttttgaaaacatcatacagaataagctatcgtctggcaagtaaggaaagctgtaatttttaagtttagaggttcaagtggcctagtagtcattggtaccaacttctactttctatagctagagtttaatgagtgacacaactgacctgtgtcagatcagaaagaaaacataagggcagtacaatttcataaagtctactattgtgcttaaaactttccatttcctcattttatacatttaactgattgtaccagattccactgatagtaataattaagggaagagtttaagatgatgtatttctggacattaaacccatacaaccca

SEQ ID NO: 233980 - DNA, 370 bp, Homo sapiens
gaggtttggggatttttgttactgattattatgggttgaattgcattcccccaaaattcacatgtcaaaatcctaacccccagcacctcaggatgtgatcttatttggaaataagatcattgcagatgtaattaggtaagatgaagtcacactagactagggtgggcccctaatccagtatcactgatgtccttacaacaatgggaaaatttggacccaaggacacaggaagaatgtcacataaatatgaaggcagggattgaggtgatgcttctacaacccaagaaatgtcaaaagattgccagcttttcttagtctattcaggtttctatcatgaaataacatagactgggtagcttagaaaaaatac

SEQ ID NO: 233981 - DNA, 614 bp, Homo sapiens
gagctggaatcagccatggtgggcgtggtgtgagaggtccttccaggctcctcaggactgccccagcctgcagctagacagatgcccttggcgggtgggacaagggctttgtccacctggggcccaggtctcactgggcaggaggactgtcagggttagtcctgatcctctgagggtgcggagtctgttcagcttcagtgactccagagctcagggtaaggcccgggcaatagcaggcatccccttcggctcacaaatgcctgttaggtgaggatggctgttgctcactcatcgaaatgcattcttcagcccaagagtgtcattagggcctgtccacgctggcaggccacgtggccctgtgccacagagccctctgggtacaacacccccgacccaggtgtgaacactcagggcgggtgagtctccaaggcccaggggtgaacgcttagggtgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacactcagggcgggtcgactga

SEQ ID NO: 233982 - DNA, 545 bp, Homo sapiens
acatgagagtctatgggattacaaacagttctgtgtcttcagtggaaaaggcctgagtcaccttttagtagagatggcaactgtctaaaaccactgtgccctctggtgaaaatacaagtacaaggtcatccacaacctgttacagcaataggaaatttttcctgactagctttttataatcctgtatagctaattgagatctacattgttacagcaatgctgttttaaacaaacctgaaaatttgaatatatttagatttaaataaaaataaatgattatacaaaaggaaccataataggatttcttaaaatagctcctcaacctagagatgttgagtaaagtgaaaaattaggattcagtcatgttgactgtgattacaacaaagtaaaaaacatccatctagaaaaagaggactacactaagacattaatagttattgtattattactatgtaattataggtaatttattttccttttacttttcataattttaatattttcatatgcttaaattttcaaaataaattggtaagagtccctta

SEQ ID NO: 233983 - DNA, 454 bp, Homo sapiens
caaacataccgactcagaggcaggttggctagagtggagttaggaaaatactctttctggaaagaaaggtgactttaatcattgctgcctatacatgccactatcaccagtgagtcttcacttaatgtgcatatccacctgctggcagcattgccagagtgactgtctgaaagaatggccgcttgttcattcgttcattcattcatcagattatggtagcatggattacagaggtgaagagaaatgaagagatttgagggtggtctagatgtaaaattgggaggatttgtagtcacatatgaaaggtaatagtaaggaagaaggagctattgagaatgggatcagggatttgggattttggtagttatgatagccattgagtgctgagaatgggttaggctctctattgagctctgtccaggcattattccatatgatcctgaaaaaactaaaa

SEQ ID NO: 233984 - DNA, 371 bp, Homo sapiens
aggggccacaagggatctgccagggccactgggcaagctcgcaacccaccaggcacagtctcaaaagaatgctgtccccacaaggagacaaaacaaatattctaatcctaataatggtcatcagatcactcagcaagtccttattagcaccccacctgccctttcccccagccctgatggaaccctagtcttatgccctgccctagccttggacaatccaatctcacctcttacactagaacaaggcaaagaacatacccccccgccccccgccgagagaatggcctcatcttctaagcctctgtttctcattcttaccctggaaatgggaggctggcctggatgacctcctctggggtagtgggctgcag

SEQ ID NO: 233985 - DNA, 474 bp, Homo sapiens
gatcagcctgcctcagcctcccaaagggctgggattacaggcgtcagccactatacccagcagtatattcttaaatattactgttgagccatatatacgacaatggtggactttgaatgtccgcacatctgtagtaaaatgcaatgctaccttcattttttgttggtatgctaaagaaattttaagtatctcacttttaaaaaaataggtttgtgtattttatgtgcttacacatttttccatagtactgtagatcattttagtgatgaaatttgatacttttgacagaaaaacaggtcagtgagttccttgggatcaaaaaggggttgattacaagggcaggaaggaattgttagtgtgattctacagttctgcatcttgattatggtatgactgtgcgtttgtcaaaccttaacaggatgaattttgctgaatgtaaaatcatacttcaataaacatgactttaaaaactta

SEQ ID NO: 233986 - DNA, 582 bp, Homo sapiens
gagccatgattgtgctactgcaccccagcctggataacagagtgagaccctgtctcttaaaaaataaatatataaaaaattaagttttgagtgaaaagttagatattgtcagatactcaagatctcaaattttgtcttccatttggattttctcaggaagcacctgagtgatacactcctccaaaatggaggagagtaagtcatgcaaatgaaacgggatacaacacaggagctggctatttctggggtgaatgaagtccagaatgccagttgtgcagcagccttacatgcagccattctcgtccataggaccagaactgtgaaatactccagaatggagatcaacaaaataaattgatgataggttatcacatacatcttatgtgtgtaattacattgcgatgaagtgcaaagaaggaattagcaaaactaggaagaactagtagaaaaagaaaactaatcaaatagcaaaagatgtaaagaagcatttttacaccaacatggcacatgtatacgtatgtaacaaacctgcacgttgtgcacatgtaccctaaaacttaaagtataataataataaaatta

SEQ ID NO: 233987 - DNA, 793 bp, Homo sapiens
gtttggtatgatgtttcatatattttaatgctggctgtattacatggagtgaatttgcagaaattgaattgctgaatcaaagcttatacttatattctactaaataccgtccgactgctctccctgagggtcatcatgataataggctatcattgcctgggagcacctgtttcaaactgtccccgccagcactgtgttaacattttaatcagtttcctttgtatgctttgagttcatattgtttccatctttgctgatttccctttctgctgcaacatcccttctgtttaagtcaaaacctttacaaggttctgaaaccaaggtggatacctggactatgcatagaggaatgagatggggttgctctcaaggtcatgtctggtgtagaagacagaggcctctaacagttaaccacaatattgcacatggtgagaactgtagaaatgggggtcctgccaagggaggagcaggacagattggggagggcaggggatggtgttgggagagacctcacagggctgatctttgaagcggggtggagcagagactttgggaggagtgcaggcatgggagcatgaaggtgcagggtgcagtggggaccatggggctggagttcagggtgcctggtggatggcaggagatgagatgggaaaaagagggagaagcctagcaagaagagtctcaaacgccgtctgaggggctgagactccctcctgcatgcagcattgtggcaggccaggtctcaccaacacaggcctccataacaagtgtttcagtactgactgagtggtta

SEQ ID NO: 233988 - DNA, 740 bp, Homo sapiens
gtttggtatgatgtttcatatattttaatgctggctgtattacatggagtgaatttgcagaaattgaattgctgaatcaaagcttatacttatattctactaaataccgtccgactgctctccctgagggtcatcatgataataggctatcattgcctgggagcacctgtttcaaactgtccccgccagcactgtgttaacattttaatcagtttcctttgtatgctttgagttcatattgtttccatctttgctgatttccctttctgctgcaacatcccttctgtttaagtcgaatgagatggggttgctctcaaggtcatgtctggtgtagaagacagaggcctctaacagttaaccacaatattgcacatggtgagaactgtagaaatgggggtcctgccaagggaggagcaggacagattggggagggcaggggatggtgttgggagagacctcacagggctgatctttgaagcggggtggagcagagactttgggaggagtgcaggcatgggagcatgaaggtgcagggtgcagtggggaccatggggctggagttcagggtgcctggtggatggcaggagatgagatgggaaaaagagggagaagcctagcaagaagagtctcaaacgccgtctgaggggctgagactccctcctgcatgcagcattgtggcaggccaggtctcaccaacacaggcctccataacaagtgtttcagtactgactgagtggtta

SEQ ID NO: 233989 - DNA, 909 bp, Homo sapiens
gcgctgccccttgggggtctccaggcacagaatgggttcctctccttccagccagtgctgtctgtgtgccccgcgttatagctttcctttttcctttttttttgtcttctgggagaagaggtcaccagtcttctagttttactaaactggaaatatttttgctatatttacttacagatttcctctttgtagggagaacttgagggaaatgtcacgtatagtctggtaaagatactggaagttgtgctttgaaatggggccatggcaggcagggtgctgcgctggaccatgagcactgggcagtggccatgaacctgttaacccgagcttatttttggtcgctttaatggctcctgtaaaatctattgttggttttatttatccaaaactgagccttctcataggctttacacccggatccttaattaacttttgttgacaaaatgtatgagaatgttaaatatatgtatttatttctgccattactggagaatacagataattaaaagcaaatgtaaatacctagtttaaaaggcactaaacattcctgccacctaggggtaatttcaagtattttcagttgcctagagaaatggtatctttctcatttctgttaatgagaacaatgcagtttttttcaggtttcagttttccctctggctgtcaggaagctcaggggaaattgtgatgcccctgtactcccctttgccctctgagctgaccagtgtctttttggcagatgcaacatccagagaaagcttcccccagcgtcccccttacccacccctccctcccatctgatttgggctactttaatacttggattcacatacccttgttatcagccttgctaaggaaatcgtattttatttgtataaatgctcccactgggctctgagctcctgcagg

SEQ ID NO: 233990 - DNA, 697 bp, Homo sapiens
acttctgggtctaaaaagcacaccaagtcctgctaaatcttaaaccgtaacaccagtcaaaccctcatcttcagacccaggaaaagatgataatcaaaataaactgcattcatgagacacagtgccagaaattaaaactgctgaacccctctaatcccagggactgtcacagaagacatgcgtctgtgaaattataagggccaattttgagagataaacttagttcagagtttccatataaattacacattaatattatagtttgatgaaagaccagcatcaggacccctgcgttagataaacaaggttcttatagcattaacccactttttaatttaaaaaaacattaaaaggttatttaaaggtttatggaaattatagcttatggtcaaaatgattaaaatttaatagatttgtttataagatttgagagacagatttaattggcctcatgcagtctctcttagggctcattgtttgggaaattaagtctcctctctcaaaaaataaagatttttgccttttttaaaaaaactttgagttatcactttgactaaatgaatgatttcttttacaatgacctatgagcctatattatcatattaagtattttaaacttctgacatttgacagactttccaaaattaaattgtaaaattagtactttgacttcatatatttattaataataggtcac

SEQ ID NO: 233991 - DNA, 643 bp, Homo sapiens
acttctgggtctaaaaagcacaccaagtcctgctaaatcttaaaccgtaacaccagtcaaaccctcatcttcagacccaggaaaagatgataatcaaaataaactgcattcatgagacacagtgccagaaattaaaactgctgaacccctctaatcccagggactgtcacagaagacatgcgtctgtgaaattataagggccaattttgagagataaacttagttcagagtttccatataaattacacattaatattatagtttgatgaaagaccagtaatttaaaaaaacattaaaaggttatttaaaggtttatggaaattatagcttatggtcaaaatgattaaaatttaatagatttgtttataagatttgagagacagatttaattggcctcatgcagtctctcttagggctcattgtttgggaaattaagtctcctctctcaaaaaataaagatttttgccttttttaaaaaaactttgagttatcactttgactaaatgaatgatttcttttacaatgacctatgagcctatattatcatattaagtattttaaacttctgacatttgacagactttccaaaattaaattgtaaaattagtactttgacttcatatatttattaataataggtcac

SEQ ID NO: 233992 - DNA, 409 bp, Homo sapiens
ttgcccaggctggtctggaactctaccacttgaaaatttttagcataaagcaattacattctcactcagaagtattgttttaagctaacactttcaaatggtagtagattcatcatttacaagttaaaaaaaaaacctaaaaaccggtgttaatagcatcagacagttcaggtagattttttaaaaggtgattcttaatataacaaaaatgctttgtaccttatcaagatagttttttacttatcactacttaatgtattaacatgcagtatcactgtgaaaattaaaagggctgtgagaattcggaaagtcaatgttgttttcttgtcagcaaagccaaaataatgtagtcatagtttctgaaataaataacttacattttaagtacatgataaattgatctttttgc

SEQ ID NO: 233993 - DNA, 404 bp, Homo sapiens
tgaaagctcagtctctgtgggctcttctccaagtggccccataaagggagtgcttataaacggaggagaggcttataaacgggggcgaggggtggtcaatgcctgctttgtcttttccaagtgtcacacatttttactggctgagagagaaactccagcctccaggtgaggtgctgggccaggtccctcgcctccttgcaggggtagtgtcaggcttcccactcatgatttgcaaagtaacatggggtccccagctgccgccgacaaagctgttacaccttctctatcatttccagatacgatccccgcttcaacacctggatacacctggccagcatgaaccagaagcgcacgcacttcagcctgagcgtgttcaacgggctcgtgtacgccgcgggcggccg

SEQ ID NO: 233994 - DNA, 452 bp, Homo sapiens
cttacagctcaatgctaatcaggccttcttcctgttggtgaacggacacagcatggtcagcgtctccacaccaatctcagaggtgtatgagagtgagaaagatgaagatggattcctgtacatggtctgtgcctcccaggagacgttcgggatgaaattgtcagtgtaaaaccagaaaaaatgcatctcttctagaattttttaaacccttaccaaggaaaaaaaaagggatgttaccaactgagatcgatcagttcatctaatcacagatcatcaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaaaaaaaaaaaa

SEQ ID NO: 233995 - DNA, 302 bp, Homo sapiens
aaatattgccgtatagaaaagcaggaaattaggaagaataattgatcaatcaaaagcaaattgatcaatgggcacagatattataattggaagacaagttatcactgtattctgtatgttcagaaagttaagtagaaatggtgaagatgtaaaaggaagaaaacccaaactttcagggtgaaaaccacaacacaggagatgaagaaggcaccaggtggggtgaatgacaatgatggcaggagaaaacattggagaacttagagacatagcaacagaaacttttaaaaagagaaaatgaaatt

SEQ ID NO: 233996 - DNA, 90 bp, Homo sapiens
gcctgagcaagagtgagacactgtctcaagaaaataaaaaagtccttaaaaatgtagctagaattgagaatatatactgttcaacaattc

SEQ ID NO: 233997 - DNA, 424 bp, Homo sapiens
tgccctgtggtaggaagaaatatattaaaaattgatttttggttactgcctttgtctgcataacatttataataaaagatacaggagaaagtatcccttaaaattgatatttcaaagtattttgggcttgctgatgttaaaaataaatttttattaatggttttttattgcatggtaaaaggtcccgatctgaatatgacagtgttatcttcttagaaaaaaatggtgctagtgttcttcaataattacatacaagccagaaattttgctacattattgagttaaacgatttttatacatgaaattatcctttgaatgcaatgtgagctaagtgtagtaaaacgtgcagctcatatttccttcttctattttctgtcttctttactttcttcccctgtctctttctatatgcaatagggtgcaa

SEQ ID NO: 233998 - DNA, 362 bp, Homo sapiens
ctgcccccacagccaggccctctccctccccaacctatgacttcccaaggctgtcaagatgtaaaaagtattccttgtgctcctcaccgactcccttagatgagtgaaggaagctttttcctggatttatccctgggaagtgacactgctcaccatcctccagccagaaagtcaacactcccagcattgaccatggtggccgggaactctctaaaacacctcagactcagtaggaggtgcagggggacggcgttccctgctaagctccggacactggagtgagtgggagttcccagaccctctcactggccaggctgacgtgtgtgctgcagggctgcaaggagcacaaccaggagacggga

SEQ ID NO: 233999 - DNA, 477 bp, Homo sapiens
tgaaaaagtcttagctcctggcagggagagaaggcggccaggtttccagagggctcttctgggaaactttccctccccactgccccctgcccccaggccactgttccgagggaaatgaagccccccttcctaaagtgggtcccccacctctcccttaggccctcgtgcccacctgggtctcagtctcctcctcggggatgcgctttgagggtggaagccaggggatgggtgacgccagctgggtcaggggacctggtgcgaggcagccggggcaggctgcagtgggcactctggacgagtgggcacctagctggagctttccagcctgcgtcttctgccccacaccccgtgacccgcggcccgctcggcccttaccttgaagcatgggaaccgcgctgccccggccgcgaggacttgggcgcacgtgacggggcgggcgggcgtccgacccgggcagggcgcagctagcggcggccg

SEQ ID NO: 234000 - DNA, 543 bp, Homo sapiens
tcttttagcagagttttgttatgtgaatgtatatttcctgatatttacactttcccatttttgcttctaagctaattaggttataagagctgttactctaaacaagttaatcaatctctttcaacatcttccaaataagataagcaaaacaggtgtgtgtggatacacactgatattcaaaatggtctgtgtatacagctacacaaaacccagttagcaattcttacaaagaaaaaagtggagaattagatatgttattctccatccaaaagaatgatttcatataaagcctagaaaagtcagtgaattggaattcccttggatgataaggggatggtgactttcagggataaaaaccaccaaggaggtagctgtgcacctttggctggggctcagaattgttgattattagcaactctggcttaaagtgtggtcagttaagaccagtggaggttaaagcctggttgaaatgtcaaccggggatgtgaaaaagtggtctggtggaagtggagacagtgagtgagaaaataattttaattatag

SEQ ID NO: 234001 - DNA, 483 bp, Homo sapiens
actacctttcacttatcggaagcaattttgagcgctgttttaaccttactctgtgccttgctttcttcttggaacatggagataataatatgtaactcagagaggttttgtgagtatttaatgaaaaatgtgaagtatgtgaaatattttacatagtgtctagtacatagcaagggtgcaataaatgccacttttaataaaataatgtattagcagaacagacaatctgcagaagtacttgtacagagcctggatgaccataaggaaagtaatgaatgcctttattatgtgagaggatgaaaaaatgttttgaggttctaaaaggaattttaaactagcagtaatctgatacttgacttaaaaagactcatacttataccatagtactcttcaggttattatctgtattcccaggttagagagatgaggagaacagggtggaggataatttctctttgattttcccagatgttgttttgatta

SEQ ID NO: 234002 - DNA, 496 bp, Homo sapiens
ccaccttgacaggagcaaactcgagggggagggaggggagggcactgaagcacccacagtcctgaccctgctctgggagaatagagaccgtgcttagctcctgcttagaccttgttaaatgcccacattaaggttagccactacagaaatagaaacaggaagagagaaaatgcaggcaacagcacagagactgcaggcaaggagaagatgaggaccctgtgttgaaatgtatcagtaatgagaacacaagtaagtggattagaaacagtgaaacattcataggcgaacatctaaagcatcaagaaacaacgattagaactggaggcttttcacacgtgggtcagccaggcccgagaagctggtgtggggatatgaatatcaaacaacatgggtttttggtcaaaagccactgtcaaagatagttattttcctaagatgcaaaatgcataagccataaagaataaaatagaaaagttgctatattaaaatcttaaac

SEQ ID NO: 234003 - DNA, 414 bp, Homo sapiens
aaagtactaggatcacaggtgtgagccatggtgcccagcccaatagtgacattatctgtaggagcaattgaggaagtcctaaatcttgtgacctctgaccacatgactcctgagcagcaaaggattatagaaagacaggctaggggacaatggctggttaccatttagctacacctacgatttagcagaattcaggtttctcctatgatcctaatcttgtggcttttcattagtcttacaaaggtggtttgggtcccttagcaaggaggagttcattttagggagggagtattataatccttgcttcaaagttaaactataaattccttccatggttaacttggcctatgcccaggaatgagcaaggacagccagcctgtgaggctagaggcaagatggagtcagccatgctag

SEQ ID NO: 234004 - DNA, 448 bp, Homo sapiens
gactcattttcaaaatatgaaaagatcattcagaaatgctcaaaatagtaaccaccattttactttctcttcctatgagtttaactgctccaggtactgttaagtaaaatttttaggggataattgatttggaccaggattctgtaccaggcccaacagaagaaaccaatatggagtcattcatgccaagtgaacctagttagcttaggcgtatacccatgtaacaaatagctgagttctggttagctacaacagctaagctttaatcaatcatagatggccacctgattcaaacaaggcaaaccaattaagctccacacctcactttggttttcagcccatcaacactgcctgaccacgttgcaggccagagttctttgaacctattctggttttgtggcctgcctgactctcagttcatcaataaaagccaattaacatctttaaa

SEQ ID NO: 234005 - DNA, 369 bp, Homo sapiens
ttgaagtttatttttgttgggtatagtattgtaggacaaaaaggtttttcatttagcagtttaaatatgtcagaccggctggacatagtggctcaggcctataatcccagcactttgggaggtcaagatgggaggattgcttgaggccagaagttcaagaccaacctgggcaacattagggagacccagtctctacaaaaataaaaataaaaaatcagctggatgtggtgacctgtgcctgtggttccagctatgctggaggttgagacaagaagatcgcctgagcccaggacgttgaggcagtagtgagctgtaattgtgacagtgaactccagcctgggcaactgagatccccatctcaaaaaaaaa

SEQ ID NO: 234006 - DNA, 259 bp, Homo sapiens
agtaccaatctgttttaattactgaagctttagaatgcattttgaagtcaggaggtatgaagccctcagctttttgctttctcaagattgtttcagctgtttgggattctttatggtttccatacgaattttaggattttttttttctgtttccgcaaaaatgctgtaggattttgaaaaggattgcattgaatctgtagcttactttgtggtgttgacatcttaacaatattaaacctttcagtgcatgaacatggga

SEQ ID NO: 234007 - DNA, 543 bp, Homo sapiens
aggatcatgcaatcacgcagtcacttcacagtactcactctgccttcagtgagggttcatcttggtgaaaactaggtcttacagaaatgctggcaggaggggagtctaggaaatgtagcttttggagatttagcagcctctagtattacacacaacatcatgatagaaaggggttgaaatagtgttaagagagtcggtcttcaaaatatgcagcctattaggtgatggggaagccttttactgcagagacagatggtgtttgagcagacacctgaggggagtgaaggagcaaagccagagataacctcagagaagagcattgcgagcagagggaacagttgtaaaggacgatgccgttagtaaaatagccttttgttttgggtaattgaataggcaaagtaacctcgaattttcatgagagacttctttttttccctcccagaaaaataagggaacaatgtactttcttgcaacaaaaaagatgattatattcaccaaatctgtagtgccatccattcaaagacacatcattgttttaggaac

SEQ ID NO: 234008 - DNA, 408 bp, Homo sapiens
ctttgtctctcctccccaaaagacatccttcctaaccttccaaattctcctgaattgcttaaggagagcaggttaactctctgcctttcttcttacccatccccggtaagttgtttctagattcagaaccccttaatacctgttaaaaagtgcagaacaaagcaactcatttttatttattgtcaatttatactattttattcaaaattatttgttgatactttcaagaaaaaaagttataaaaagaagacaatcccttacatttcagaagtaaaggaattcagtgttatcagttacccaagatgatttgattaccgtaattaggtcttaaatttagctgaattaaatttcctggcagtaaagaaaagaaagaagatgtgagttatgaagcattgactttctggcaga

SEQ ID NO: 234009 - DNA, 348 bp, Homo sapiens
ctcttttctctcccagcactgtgggaggctgaggtgtaagggtggggtggcttcagcacagtgtttgaggagtgggcactgagtagcgtcccctgaaatcttgtggtgtacagcctgtgctgaccgcccaaggctgctctgcactagccttttagccagatgggttttctttcaaggacaacttttctttttcttatttctcttcctcctcttctcttacccttttccttctctttcccctcttgctcttcctcctttatttagaaaatgtataaggtgtatatctctctgatctattttctataaatattagatgttcaccaaatgcacattttgatcaaatgctga

SEQ ID NO: 234010 - DNA, 507 bp, Homo sapiens
ggataatagaaatcaggaaacaaaagaaaacaaagaattttctgaggagatggccattgggggagtggaggtagcagctggtttaaacctaagtaaaactagaaaaagaaactgctgtttcctttttcttatatccaccttagaggatcatgtttgaacgtccctactcctcctcctctttttaaaaagccttgtctcagtcattcattcctgtgcttcctgctcttctgctagaccccagcagctgtttgatttggtgaggcccccctccaacctctgagtggaacttcttttctaagggcctgcagaatgtcaaaactgaggctctggcttcggagctagagctttgaacagccaatccacacaaaaaggcagctggctgctttaatgaaaactgctataaagcttcaagaactttagccttgggggatgcatttataaggaacatggaaaatgcatttccaagttgctggttcttgggagagacataataaacatttaccaaaa

SEQ ID NO: 234011 - DNA, 416 bp, Homo sapiens
ccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggg

SEQ ID NO: 234012 - DNA, 527 bp, Homo sapiens
acagtcttgaataggcaaagtgatcagtttttaaaataagcattattgcagacacacaagactatgttttaagatcaaacttacattctagttagaggatttattttactttgtcacaaaaatgaaaaggttggcaaaaaaaaaaaaaagacttcctgccacaaggttttatctttgaacactttattggtttgcgttttgattaattttttttctagttaataagagtttaaatgatcaagttaatacatttgtgaggaaaatctcacttagaaatcagagatttttaagtttaggggattagattaaaaataattttatttgaaagttaggcataaaatgtatgtatatttgcatatgtgcatagtttttaaaaaaaactggaaggatgtggtatgcattaaagaaagatactttgtttgctcctgctttcatttctgttgacaagttgccagaattatttgtatagggcctctattttcggaaccatgatataaataaaggattcaaaatgtttccaatatgaa

SEQ ID NO: 234013 - DNA, 625 bp, Homo sapiens
tctatgtgcagcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccccgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtag

SEQ ID NO: 234014 - DNA, 364 bp, Homo sapiens
tgcccaaaaagggtcagccactctgccagtttaggggagaaaacttctcacctgtccaaagcatagccttgctcctgcccggcctacccagctatgacactgtccctgagcagagatgagcacaggactttgggccctggatgccggagagtgggtgtttgtgtgattcccctgcagtctggaacaggccccaaaggcaacagcatgaaggctgtccagaggttctccatcaccctcagccgagtggggtgctgagcagtgagggaggggacctgggaggggggcccagcctggatcctgcaggggagaagagaagacagccagaagccagcagctgtggctcagatctgagcccgagcagcct

SEQ ID NO: 234015 - DNA, 491 bp, Homo sapiens
attcttcaggtttaaaaagatattaaaatattacataagagacctcccctccctggcccacctccagcctcttaaaaatttagtgtgtcgccttttagacactttctcaaagcttcacttatttaacaggcacttaaggagcacctacctgtgccagaaactctccaaatattaactcaacctgacaccgactcagtgtggccgaatattactctccccattttacagagcgggcagctggtcaaggaagtcgcttgttgaaagtcacacagtggtggagcctgtgtgccaacccaggaccctggggagctgcctccccctctcccacgtagtcctgattctttaagtgtccacatattcctgtaatgcctggagtttcagtaattagcagggacttagtgtgttcagagaaaaaaaaagcttttaaaaattattgttactgtgtttgtaacagtttggatagagaaggaaaagctggaatttgggaagtg

SEQ ID NO: 234016 - DNA, 2234 bp, Homo sapiens
  misc_feature (1036)..(1036): n is a, c, g, or t
  misc_feature (1438)..(1438): n is a, c, g, or t
  misc_feature (1944)..(1945): n is a, c, g, or t
  misc_feature (1947)..(1947): n is a, c, g, or t
  misc_feature (1949)..(1953): n is a, c, g, or t
  misc_feature (1958)..(1958): n is a, c, g, or t
  misc_feature (1962)..(1962): n is a, c, g, or t
  misc_feature (1964)..(1964): n is a, c, g, or t
  misc_feature (1973)..(1975): n is a, c, g, or t
  misc_feature (1988)..(1988): n is a, c, g, or t
  misc_feature (1999)..(1999): n is a, c, g, or t
  misc_feature (2002)..(2002): n is a, c, g, or t
  misc_feature (2006)..(2006): n is a, c, g, or t
  misc_feature (2010)..(2010): n is a, c, g, or t
  misc_feature (2019)..(2019): n is a, c, g, or t
  misc_feature (2024)..(2024): n is a, c, g, or t
  misc_feature (2028)..(2028): n is a, c, g, or t
  misc_feature (2038)..(2038): n is a, c, g, or t
  misc_feature (2041)..(2041): n is a, c, g, or t
  misc_feature (2053)..(2053): n is a, c, g, or t
  misc_feature (2061)..(2062): n is a, c, g, or t
  misc_feature (2064)..(2064): n is a, c, g, or t
  misc_feature (2092)..(2092): n is a, c, g, or t
  misc_feature (2094)..(2094): n is a, c, g, or t
  misc_feature (2096)..(2096): n is a, c, g, or t
  misc_feature (2102)..(2102): n is a, c, g, or t
  misc_feature (2104)..(2106): n is a, c, g, or t
  misc_feature (2113)..(2113): n is a, c, g, or t
  misc_feature (2126)..(2126): n is a, c, g, or t
  misc_feature (2129)..(2129): n is a, c, g, or t
  misc_feature (2138)..(2138): n is a, c, g, or t
  misc_feature (2140)..(2140): n is a, c, g, or t
  misc_feature (2143)..(2143): n is a, c, g, or t
  misc_feature (2147)..(2148): n is a, c, g, or t
  misc_feature (2150)..(2150): n is a, c, g, or t
  misc_feature (2158)..(2158): n is a, c, g, or t
  misc_feature (2164)..(2165): n is a, c, g, or t
  misc_feature (2182)..(2183): n is a, c, g, or t
  misc_feature (2187)..(2187): n is a, c, g, or t
  misc_feature (2205)..(2205): n is a, c, g, or t
  misc_feature (2210)..(2210): n is a, c, g, or t
  misc_feature (2216)..(2216): n is a, c, g, or t
  misc_feature (2225)..(2225): n is a, c, g, or t
  misc_feature (2234)..(2234): n is a, c, g, or t
gaaacatgcaacttatatgaaatttaaattccagtgtctggacacctcgggagactgaggcgggtggattacctgaggtcaggagtttcagaccagcctggccaacatggtgaaaccctgtctctactaaaaatacaaagaacatctgggcatggtagcgcatgcctgtaattccagctactcaggaggctgaggtgggaggattacttgaacccaggaggtggaggttgcagtgagccgagatcgtggcactgcgctctagcctgggcaacagagcaagacttcatctcaaaaaatataaaaatttaaataagtaaataaattccggtgtccattaaaaaagtcttaactgtctacggctgctctattttcttctatctagctagctgtttattgagctagggtctcactctattgtccaggctggagtgcagtggcacaatcacaggtcattgtggcctcaaactcctaggcttaattgatcctcccagctcagcctcctcagtagctgggactacagcagcttgtggctacgttactgcaacaatgactaaatagttgcagagttggaaaaaagacccaaaaagcctaaaatacatactatctagcccctgacagaaaagggggcaatttgtaagagtaaaataattttcaatatcactctctcttcctacactacacattggctaattcatgattagtaaaatgacctaagcacataccagcaaggagattatattttaggaaagggactttaaagtctactcaaatgggggattcaactaacttctcacctaaaaagcactcaaagaatgaggtatatttttccaggaagtctgatgtcatttatctttctccttttgtacctcccaagggaagacagaagctaaattaaacacattatccctgttcttatattcctataaaactgaattttttgaaatgtggtgcaggagaacccatggtcatatatatgccatgtttcatattactagttatgtattaatttcacatatattaggaaaagccacaacangcaatttaaacacacgagcctatacattgtgtttagcttaggacaaagctgcattacaattttcatatttaagtatgtaataaaatacggcagaaaaccatggcaatgaaagttcaggcaacactaattcacaaagtcgctgccaaggttaaaattttaaacatttcctgaaaagcatgctctttatgggaattaatgtgccgaaggattgtgtaattaagtaccatgttttgtgaacttggcttaaatggaaccgtgtcatgaaacaaagtaagcttttaaggactctggtcagaaacaagggggtaaaaaggaagacttttctgaaactgtgtcaacacaaattatgtcaattccaaaacaaagctctatgactcaaccatgagtgtctaggaccacacngctatgaatcagaactagagaaagatatagactgcagcctttattttacagaaccaaaagccacaggctctctctacccctcctaccaccatctggggagcagctagaagcagttcttgaaaataacccaaggaaaagaaaaaagaaaaaaatttcccaagaaacaacacaagcaaagtcagtagaattatttgagttcacaactaaatcctcattattttaactcttggggacattcatggtatcctgaagaactgatgcttgctccttaaagaattcctgtgtgaagggagtgagggagagagggagggagagagagagagaccaaggaaggaagcgagtgtgaaaggctgtccaaggctttaggccagaagcctaaagctggtactccaacctgctttattcattctagaaaatcttccaagacatcttaaactgacatttaataattggagattttacttaaaaacctgacatttaagaattggaggttttacttaaaaacnnanannnnnggccnggcncngtggctcannnctgtaatcccagnactttgggagnccnaggngggngatcacgangtcangagntcgagaccanccnggccaacatggngaaacccnntntctactaaaaatacaaaaattagctggncntngtggcncnnncctgtantcccagctactcnggnggctgaggnanganaatnncntgaacccnggaggnngaggttgcagtgagctnngatngtgccactgcactccagnctggngacagngcgagactntgtctcaan

SEQ ID NO: 234017 - DNA, 441 bp, Homo sapiens
aaaagaaaccaagccaaacaccatggacatatttctgaaaagagtgacacctccttaagaagagcctcaggcaggtccttcagtgggtgttccagaagattgttgtcatagcaaatgacagctccatgcatgctattttccctgaagaccatgcagtgggacaagctgtgcagatggaagacagtgacatcgatgaccctgacctccctgtgtaggcctaggctaatgtgttgtgtgtgtcatttttaacaaaaaagttaaaaagtaaaaaatattttaaaatgttaaaaatagagacttacagaataaggatataaagaaggaaatatttttgttcagctgtacaatgtacttgtgttttaaattaagtgttacaagagtcaaagttttaaaaaatcagtttataaagtaaaattagttagctaatgttaatttattatt

SEQ ID NO: 234018 - DNA, 512 bp, Homo sapiens
agacaggtcactagctgatcaggctgaaatgctcacttatccagtgttgagtcagaaagagaggagaatttaaaattagctgacttcttggactggcacctagcactaaaataaaataatcccttagcatgtttactagccaaaacatactgtatcacattgtaagttgctttaaagtttgtattttctattaagcttgctgcatggtgatcatgtaaaagtgtctaatggttactgtaaaattagaggctgtccaaacgaaacttaaaatcctgaaactttctctccaatgtatgataattcttggctacactagtaaacagtttgacatgtgtttaaacataattcaatttttttatcagatcgtcttttcttaaaggtatgtctaatgaagtgtgtgactgtataatagaggagacagtatttgatttttaatttttatgttaaatggtttccactgttgtatgcccatttgagtttttacaataaaagacaaatataaaaatgtgaat

SEQ ID NO: 234019 - DNA, 351 bp, Homo sapiens
atacaccaaagcactgccagtgaatgcttctgctcttgtgcatacgtctgcatgtcagacaagaggcagtttcgcctgtgtctttagacagggagtgctgacagacccccaatgaggccatgagatgaaggagggggctcagcagagagtgtcgaatgcagctcaaatcttgggtctggaggctcctggctctgatttaagccttggcgacgccctctggccatgaccttcgactggcttgttaatttatctgaatgtcagtttcctcattagtcaaaggggcaatggaggtgcctctttcctggttgtgagagagtcctggggaaggtcttagcagccctggaaggaggc

SEQ ID NO: 234020 - DNA, 620 bp, Homo sapiens
  misc_feature (38)..(39): n is a, c, g, or t
atgtaagtctgaaatgcaatgctatttataactctttnntcagatgttcactaagggagctactgcttaatgaacatgaggtttcctttgggaatgaggaaaatgttctggaaatatgatgatggttgcacatgattgtgaatgtactaaatgccactcagtggtaccttccaaaatggttaaaatagtaaaccttatgttttgtatattttattgcaataaaaaagaatagtcatcatttaccaagaattaacctttccagacacaagcttataatgcgatgtatctcacttaatcctcgcaatagtcctgtgaaacaggcacttttatcatttctgttctactgttaaggaaactgaggcgtaaggaggttgtgtagttcagcctgagcctgggtctgtggagtcactgcccaaatgcttcctccccatgcgtgttggccccactcttgcttccagctttccacatctttgttcataaagttcattcttattccttaacattttctgagtctaagttcccataaattacatagacatatttctgtctcccaataacgttgccaaattattttctaaaagggtgtgacagtgtaccgtgccactagaaaacaatcactt

SEQ ID NO: 234021 - DNA, 565 bp, Homo sapiens
  misc_feature (38)..(39): n is a, c, g, or t
atgtaagtctgaaatgcaatgctatttataactctttnntcagatgttcactaagggagctactgcttaatgaacatgaggtttcctttgggaatgaggaaaatgttctggaaatatgatgatggttgcacatgattgtgaatgtactaaatgccactcagtggtaccttccaaaatggttaaaatagtaaaccttatgttttgtatattttattgcaataaaaaagaatagtcatcatttaccaagaattaacctttccagacacaagttttatcatttctgttctactgttaaggaaactgaggcgtaaggaggttgtgtagttcagcctgagcctgggtctgtggagtcactgcccaaatgcttcctccccatgcgtgttggccccactcttgcttccagctttccacatctttgttcataaagttcattcttattccttaacattttctgagtctaagttcccataaattacatagacatatttctgtctcccaataacgttgccaaattattttctaaaagggtgtgacagtgtaccgtgccactagaaaacaatcactt

SEQ ID NO: 234022 - DNA, 299 bp, Homo sapiens
tgcgctccgcgcaggcgctgtgcgggcagcccgggcactccatcagggcccccttatcctttaggaggagtcctccctgggcggtgctccagggctgtgggctggggcatgacggcccccagctgcgtagctccagcccctttccagcaggctggtgggcggctccgagtggggacctgggatcggaggggactcctcccgggactacccgctgccttcacttgtcccgggacgcagctggaccccgagtcaccgactgcaacccgcgcacgaccctcgggagcctgtctccgcggccg

SEQ ID NO: 234023 - DNA, 226 bp, Homo sapiens
gtggagaatacatggaatttcatgcctactataaattcctaccataaaatttcactataaatataaattcctactataaataaatacatggaacttcattcctactattaatgaaggtaggcttttcctacttcatttatcattctacctacctctatatatgcttcaaggtttctttaataaaagttaaaaaaagtaatgcccagaccaggctctgcaaccatgt

SEQ ID NO: 234024 - DNA, 1524 bp, Homo sapiens
tttaatgctgttcattaaactttcactaaaaggattataacctgcacttttacaaaaacgtatttaatctttacaacaatcctatcaggtatataagcccattttacagatgagaaactgagacacactgaagttaagtaacttgtaagaagtggaactggccttgatcagaggtagtctggcttagagcccaccttcttcacctgtacaacaaagcactcactagagattggccattatcattatcaacattattattaattattattattattattattcagccaggagttaagttatgaagggactcatatttgaattatgaaggaactcaaaatcccacagtcacataaaccagtttcaggatgaaatcggcatgccttccttttgttcaaagggttgtacagctaattagtatgtaaatctcacttctttgaattgaacacattttagagtcatctattacaaaagtgctgcatgcttgaaacagaaagcttgcaaaatctgtaatctcagcactttgtggggctgaggcaggaggatcacttgaggccaggaattcaataccagcctgggcaacataaggagaccctgtctctacaaaaaaaaaaaaaaaaaaaaaaacaaacaaacaaacaaaaaactaattaattaattaattggctgggtatggtggtgcaagcctataatcctagctactcaggaggctgaggtgtgaggatcaagaagatcaaggctgcagtgagctatggtcatgccactgcactccagcctgggtgacataggtagtagacctgtctcaaaaaagaaaagaaagaaacagaaaacttggaaaatccaggaaaaaaagtctttaatggatagagttctgattcattaaaacaattttttggtaaaaatctatatgtgttattttgaaatgagaacagttacctcctaatctatgtggactgggaagtagacttacaatacggcataaattggagagctgataaatttgaggatggtagagacacttgatagaaaacaactgtttagtcttaattaactatgaataactttggcattcacgttttgaaactcattcatgtttgctttacatcagattaattttattttaagaaagatttttgtatactcttatcctctccctttcatccaagaaatacaaccatacatcccaagatagtgatccacgaggcagatctttgggctgcctacgtggtgaaaggccccaccaacctcctataattcagagaactttgcctgtaattccagcactttgggaggctgaggcaagaggatcacttgaaccaaggagtttgagattaccctgggccacatagcaagaccctgtctctacacaaaataaaatataagccaggtgtgctagcacacgtctctagtcctagctacttgggaggctgaggcaggaggactgtttgagtccaggagttcaaggctgcattgagctatggtcacaccactgcaccccagcctgggtgacaggggagaccctgtctc

SEQ ID NO: 234025 - DNA, 272 bp, Homo sapiens
ttgcccatcaaaaggaaatgcattttgctgaaagtagcgcagttttcccagggaaataacatttgagccgagccttgaaagatgagtaaaagttcgtcaagctgaaaaatttcatcgtaagatgagtcgaacacagggtcattgtgagccgttggctggcccccgcagaaacctggcagccccttccaggctttgcaggtgatatggttccttctccatccaggataactccagtgaaggatggacagaggcaagattctagctccattttg

SEQ ID NO: 234026 - DNA, 357 bp, Homo sapiens
actcctccttcatgcttttaagatttataggataaatgtagaacttcaagcaagtcattttttaagtgatgatttttctcccactgaactggaatgtccctcttctatcaccccatgtatattttcatttgaatttgacatgacagatagtaccgatcttttcacatgtggaaaagtgaataaagggatctgcagcatattaaaatgcatggagatgataatacttttcacatgatttaggttataaataaatcaagtgcaacgtttctgggttcttgttcaaagaagatatattttcatctgatatcttttcaacgtgtccctttcctgggaagccattgatgacagtttgatcga

SEQ ID NO: 234027 - DNA, 377 bp, Homo sapiens
aagatggaataatgtacagatattcgctactgtaggtggtgagctcactgtaatcgcgcatccacttgaactacaaaggccagctcccttcggcaaggcaggtgagaacaaggcgtttcccttccaggtggatctgtgataggcctggctccgcattaaaatatggagcaacatcatcttgcgccagcgcccggagcaagtgcagctgcagcgccagcagcgcccaccagccgcggcggcccggccccaactttgccgcccgccgcccgccgcaccgccccgcgcccgccgtgtccccgccggaggtctcgggcgccgcccggggtcgcgagggctccgggccggggcgcggcgccagcgaggggcgggcgcggccg

SEQ ID NO: 234028 - DNA, 1031 bp, Homo sapiens
agcggggaatcggcacttactacgtggcggattctgactgtgaagaggactgtcccaagtgaagagtgggaggcaagtgccttgtgaccgggaggaggtcgaccttaaaggagctggtattgtagctcttctaaagcctagtctacttaggaaggcaaaagcgaagcagcaagaagtggccacagaagccgtgtggtccctagaagtagaagggtaaggaggatgcaggagatggtcctacttgtggccgcaacggggctcagaagtccgcttgttagagatggcagtgacctgtgacaatccagtctgcccgacacgcctcccgcctccttaggaacgggaaggagccccggcccagtgcactgacgtagttagcctaagatcacgtagctggttggtcacagaatcatgactttaattcatgtcttctgactctgacctggcacgctttgtacctcaccaaagacagtgatgaaattgcaaaagggcagagtggagaagactggaatgttcagccaaggcatttgaacttttaatgctgcaagtcaagacttcctgaagatttttgagcagatgagtgaagtgataagaaaatgcatcttcagcagtgacagcatcaacgaggaggagactggccgggaggctattacccgcatcaaaaccagtgaacattaaaaaaaattttttttttagagagagggtcttgctcttttgcccaggctggagtgcagtggcttgaccatagttctctataaccttgaattcctgcgttcaagcgatcttccttcctcagcttccggagtagctgggactacagatgcgtgccaccatgccaggccaatttttaatttaggtttggtaaagatggggtaactgtgttgcccaggttggtctcaaattcctggcctcaagccatcctcccgcctcagactcccaaagtgctgcaatttacgggcattagccaccgcacctggtccaaaaccggtgaagatttgttaaggtgttggcaatatgggtatacctagattatc

SEQ ID NO: 234029 - DNA, 336 bp, Homo sapiens
agaatgaatgttttttggggtggaaagcaaacaaaaatatatatatattcttaattgaaactacgatgctttattgggtaaaagcatatgataaaaaatgtatttgaatattttgcttagatgaatttttgtatatttagctaaaaataagatggtagcatacatgtaggtatataaagttgaatatcatatgaattaagctgtttttaaaaatatgttttaagtcagatttttaagcgtaagaagagaaatttagttttgtgttagtaagaggaaaataaggccaacaaagggattagaaacttgggtctgggtaaaggtctgagagagaggaga

SEQ ID NO: 234030 - DNA, 376 bp, Homo sapiens
gcagaacacaatgatgaatgtctcaattcagacaggaattgaatgttgcctgtggggtaggctggctctgccacctgcactgacaatacatcatccctggaaattaacccatcttcaccatagccattgaaatggaaagaagtgcttgttcattaaaaacacccttcaaatggaaaggatgaaggtctagcgtagtatatatggtgcattaatatctataatcatgtttaatttgcattagtctaactctgccacttggaaactgtttttaagatattgtgttgcctgaatgggtttgtgtatgcattatttgcttcttgaataagagctgaacagaagctaatagctttatataaaatatagtgattaccaaatt

SEQ ID NO: 234031 - DNA, 396 bp, Homo sapiens
ccgaaatggggtctcactctgtcacccaggccagagtacagtggcacaatcacggctcactacagcctcaaccgcctgggctcaagtgattctcccacctcagtttcccaagtatctgggaccacaggcacataccaccatgtccagctaaatttttttttattatttatagagacgaggtctccctatattgcccaggtgggtcttgaacacctgggctcaagtgatcctcctgcgtcagtctcccaaaatgctaggattacagatgtgagccaccatgcctgaccttttataaaggcattcatgatccagctcccaggtacctctacctctgtttttcttcttgagatggagtctcactctgtagcccaggctggagtgcagtggggcgtaatc

SEQ ID NO: 234032 - DNA, 365 bp, Homo sapiens
aaaaagattcaagtaggaaaaaaaaaaaaacctaaaaataattctgtcaaacagactatctttcctagatctaacttgctttagaaaatgtatataggaaattgcattaacatccctttagcaggagacaattcttaaacttaaattaaactgaaaaagccacagaaaaaagggtttgacaccctaaagccagtgtccaaatgaacgctacggttgacctcataggtgtgttatgaatgtttaccctgacctcctagaagaaaaggaaaaagaaaggaaagagagagggagaaggtgagggaaggggggaagaaaagaaaggagagagaagacagagaaaaaacagggagggaggaagctgggga

SEQ ID NO: 234033 - DNA, 595 bp, Homo sapiens
catatcctgttatcttgatttttaagtttcatgataaattttatgagatgaaacttggtacctcctagaagtgttcccatgactaattgtttactacatgattttttatagaaataataaaataatacatttattgtctgaaaggaataaatgcttttgcttttctaattgaggtataaaatgtaagcaccaaaaattttctttttttatatgaacactgtgtttgagtgatttcattggagttttcagtttcaaaaaccaagggaataaatctgacatggaaattaaagcttgaacccagtgactccaacctaaggctaatattgagcctacaaaaaaaaaagattattaaaggcccagttagttctttctggggagcctcccctgcagatgtcccagcctgctcaccccagccatggaagaagtctttccatcctgagagaagctccaaagccttggaaagctggggccccacaggcagatgcagttaaggttaagatgaaaggaaactgggagggtctcactgatgataaagttttttattgttttgaggcactgtctagactttgtaaaataaaacaaagttagatttgtg

SEQ ID NO: 234034 - DNA, 362 bp, Homo sapiens
gcagcactgaggcctggacaggaagatgggactggaatgcagaggggccttgcagggctcagtcggggccaaagggcagagaggcagggcacagagagaagctgtggccgccttggttggtcccatggaatcctcgcccattggggccatgggcattgatcgacactgtggagcttgaaatctcaccaggtggaaacatctctgccagccctgtaatcatttccatagtttcttctggttcttttcatgaacattttccaatatttttatttgagcattaataaaagagcaagcttgtgcaaccacaagcaggtcacatgcagcccaagatggccttgaatgtgacccaacacaaattcgta

SEQ ID NO: 234035 - DNA, 349 bp, Homo sapiens
aaaaaaaaaaaaaaaaaaaaaaaaaaactgtaaggcgagctaagacgtctgtctatcagtgttccattacataatacacctctttccttcacatgtgtgtgcacattctcaggattatattagagatttgattctttgcaagggtcagtatcagtaatggctgagactggtgggctgcagtcatgttgctatgccgtaagaggtttttacaacatttccccttatcacactttattctaacctgatgatgggcctatctcaggtgaagattgcaatagtttccttaattgaactttggtatttgatgcattaaataaatatggctttttaattttgctatcttctgtga

SEQ ID NO: 234036 - DNA, 1192 bp, Homo sapiens
taagtcagcttagggagactgttccgatatcaagattctgtttgaatactatatactctcagctgcttatttattcatatatatatgacacgtttatcatggaagtatttcaaaactatctgaaaatgaatattgattattaaggcattcagttttaggaagaaaacatacataaatatatgatcttcattattttcctttctccatgcaatttcaatagatatttatcaagaactcaaaatatgcctagcactgcctaggtgttggaaacattagagaaattaaaacagataaattccttcctttagtagacttagtctaactaaataaatgatttttaaaagggcataataaatggtataagcaaaagaaaatgaaggtgaggggaatagggcatgccaagtagggagctgctattttaatgaggcctaggagaaaaccatttataaggtgacatttgagcagagacctaaagaaagtgagaaaacgtgatacatgtatgtacatggaaaaagaatataataagcaaaaaaaaaaaaaaaatggaggccaagagggaatcttatgcattacacagattttgaactaaaagcaagaaggccataatggctaaaaataaatgaggattcattaaagagggtgaagaatatagagagttaggactattgctgtgatgtaaagtcattggagagatgacctgagagattagaaccctggggtaacttacatttcatttgctgttttattccaaagtgatattcattatctaaagaaaaaaatcaaatatacagaaatgataaaatacaaaacaatgctgacctttaagaaacattgacctataaatactaagatgttaaatatttgtttcttgtgatttgtatctttattgatgtgataattatgtatctataagtttgtgagtaaaatacataacaagcctggaatgtattttctttataattcacattaattttttgcactaaaattcaatctagtaaatttcctgttatagtcaattaattttgacaacacatattttaatgctccatggtattaacaacccattatgatttgcatttaagattatttagagtattcagtgtaataaataatgcaaatgtaggcaaaagcttttccatgtatacacacacactacacactatatttttaattatttcattcacatagatta

SEQ ID NO: 234037 - DNA, 399 bp, Homo sapiens
  misc_feature (34)..(34): n is a, c, g, or t
  misc_feature (69)..(69): n is a, c, g, or t
  misc_feature (72)..(72): n is a, c, g, or t
atttattgcggcgacagtttgactatgaatccancccaaacatataatttagagtgtttgcttggatcnccnaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggtagcacttcatagtttccacctattcctttaaaatgagggttcagtactatcacactcgtctttaagtaaaaataaaaataaaaaattaaac

SEQ ID NO: 234038 - DNA, 423 bp, Homo sapiens
aattcctagaataaagaaaaagcaaaaacaaaaacgagggaacctttctgtttcctgtgaacgtgtgatatatacatatgtgttcctatacacgtaatgtaaagtatacatatatagcactatatttttattttaaagctctgtctgacgctattacagacattttgtgtatctggtaggaaaggaaaaggaaagcaaaatggaaaagttggcttttttttcctttaaagtctaccccattttatgattattagctgtcagattttctcaaaccctgtttgcagttacagatggtgttttatgtaatgattctgaataagtagagagcctttgtgactccttgtttctgtcgaggatgaattctttatgtattttaaaacgtgttatggctaagtctacagaataaaatgtgtgtcattgggg

SEQ ID NO: 234039 - DNA, 419 bp, Homo sapiens
tgaccttttcttgaaagtgtatataagtttattttagttttctgggattaagtggtatgctatgtcctttattttctaaaaccatgttacaagatgatggtggggggtgggaatggaggattaatactacatatgtgatcaaaatgttttctaaactacagttgttccagtataatttagttggtgtaaaattaagaaattgaatggagaatatagttcaaagaaaatggtttatgtaaaccttgattgtttgtgcaaatttaatatgatttgataacttacccctgttttaaaatagagaaagctgaatttatgtatataaaaccataatctaatcaattattaacatttccaccctagtgtaagatattataattcaagatgaacagcaggacccaatcgtaatcatgtccaacgcc

SEQ ID NO: 234040 - DNA, 481 bp, Homo sapiens
cttccatagcaatttagtatatggaagtcaaacttctttaaaaatcctagtttgcagaaaagaaaggctgagtgctggcagcagaaggtacatgatactggggaactctactctttactccagttgacaagcaagcaattagatccatcgagctgcggatctatgttctcaaggacccaaggaagtcagcttttggaaggcaataaaatttttgtttttaatatgcagtgtccttcagtgaaaatgacaaggaggctgaagtaactttaggatgctgcagacaagaattctttatccagagataaaggtgaaaagacccaagaagctggataagagctaaataaaaatgtcttgccaaaatgatgctagaaagtactaattctcagacatttgcagagtatttctccatgatcaaaaggcatgcagacaagaaatacaccagcacctatgtgcatgaccaaccaaataccaccccaccccc

SEQ ID NO: 234041 - DNA, 501 bp, Homo sapiens
tttttctttattgattcttctctcttcctcactgtcttgtttcacccctcttttctaaagtatgtttcagacatagagggagaggctgtgatggaagtcagccaagcgaagacgaagggtgggggagcagtcggcaattccagtttgacgctaatgatttgtgtacaattcaagatgagaaaactgaagttaagaaatatgtatgaaattcaaggatagctaataacttactgaagaccctgcagctgtgtccttcagtgaaaatgacaaggaggctgaagtaactttaggatgctgcagacaagaattctttatccagagataaaggtgaaaagacccaagaagctggataagagctaaataaaaatgtcttgccaaaatgatgctagaaagtactaattctcagacatttgcagagtatttctccatgatcaaaaggcatgcagacaagaaatacaccagcacctatgtgcatgaccaaccaaataccaccccaccccc

SEQ ID NO: 234042 - DNA, 382 bp, Homo sapiens
ggttcctaggaccaaaaatgttggggaccgctgttttaagatcttctgtaggtaatatgtcattgccgcaaatagcgctacctttgaaagcttgtttgacaaatcttccaaacccagctcacatgtatttaaagaaatagttgacaagtgcagttctaagtgagcctcacaatttagaacatcagtttaggaacactggcgtgcattgtacagatttggcttccctgcctcagctttcctaaaggcactgatggttaagcagcacttaaccagagaacagataacattcagactcttaagccaccactgtgtgactgtccgcacatcatttactctgactttcctcatcagagaaatggggatcctgttttctgtcccagcc

SEQ ID NO: 234043 - DNA, 409 bp, Homo sapiens
atagcatcattcagactgtctgtgaacagctaaatggagataagactacaaaggtccctccatgggccttcaatttttgtctttaagcagactgctcaccatgccttgatagaaatagcaaatatagggccaggcatgttggctcatgcctgtaatcgcagcactttgggaggccgaggtgggtgaatcacctgaggtcaggagtttgagaccagcctgatcaacatggagaaaccccatctctactaaaaataaaaaagtagccaggcctgatggcagatgcctataatcccagctactcgggaggctgagtcaggagaattgcttgaacccaggaggtggaggtttgtggtgagccaagattgcgctattgcactccagcctggcaacaagagtgaaactccatctc

SEQ ID NO: 234044 - DNA, 431 bp, Homo sapiens
ctgctgaactagggatgactcatgcaggccttgtgcaaacatctagtctgatttgcatttaagagaaaaggtacacctatagaagtatccaacatgtattaaaacatcttcaaaatgttttggagttttaaagaagtgcccattaaagatgctttctgctccacctcttaaaaaaagcatggccccaggaaaaatgataatgtattctagaacttttttctgctgtgatattttctcctcccaatcaatgtttgcttcccctttaaaatctctgtgtactttcatgggtgcagtagcacatggtgatgagggcttgggtttgattgagcaatgctcaccccatctccagcccctaccccacaaaggcaagtagtacagagaatatatatacttatgattctgacataaaataaaatgtaaagccaatcaaa

SEQ ID NO: 234045 - DNA, 160 bp, Homo sapiens
aatgtgggttcttatgcttctgcaattcacagttcattgtgagcgtagagatttgcatggcttgtttccaaaaacctcttttttgcttcagactgaagggaaggtaagaagggctttttttcccccaaatcttcttagtgaccattagatgtaaaatccc

SEQ ID NO: 234046 - DNA, 458 bp, Homo sapiens
atttggggaagctaccttcccctatgtattttagaagcaagcacataatcctttaaagttataactgctaacaatggtgaatccagccaacaggtaaagtaatagtcataggaaaaagaacaaaatttccagaactcttaagtgagtaataggttctcttcacttaaggaatatgtaacacttccacatacataagctacattaatttatctgtatttcaggagaataatctaggtttacttttagctaccattaatgaagaaccatcttccttaattttttgaacatagtaactagggcaaaactgtaaatgaggccagtgagaaggcttcatgtgagattggggtgatgggatgggatttgtttagatattagggttactaaagagtaagggtaaagggatttttttaccccctatctcactacccaacctgctccctaagcccctttgccttgca

SEQ ID NO: 234047 - DNA, 551 bp, Homo sapiens
agggattcagaacctgcggatgtggagggccagagggctgaatttgcaagttgggcaatggggaaagccttcacaaaggagaaagcctttgggctggaattggaggagtaggagtcaatagagagagaagagagtaaagggcaaggccatcattccaggtttagggagcaagtacaaagacacagagaaatgaaaaggcttggcctgtttggagaatgtcaagctgtctggggttgagagaaagacattctaacaaggcttccattaaagaggctagatttgctgcttggacattttctagctcttctgagacaactttttgttgagttaagcgaaaatgaatgaaaatcagatggaccatatttctcttgaatgcacacgggcttaaaaacgaaggggaaaaagaacttgacagaatgtgtcttggcttttgccaaacccaaagtatttgaaaaatcacacagtacacatctcgaacccaaaaacatgcctggattctaccacccctaactgcagctgcagccatttaataaaatgaattgtgtacaaga

SEQ ID NO: 234048 - DNA, 383 bp, Homo sapiens
cagaaatgaagaatgcctttgacgggctcgttaacagagtcaacatgactgaagaaagcatcagtgggctttaagctgtgtccgtagaacttcccaatctaaaaagcaaagagaaaaaaaagatgaaaaagacattacagaatatccgtgaactgtgagaactgtgggataattacaaagggtaaacgtgcaatgggaataccagaaagagaagaaagaagaaaaggagcagaagaaatatttgaaatgataatggctgagaatttttcaaaattaatggcagacactaaaacacatatccagtaagcacaaagaataccaagaaggataaatatcaaaacatctgaacctacatatgtcatattcacactatacaaaatcaa

SEQ ID NO: 234049 - DNA, 164 bp, Homo sapiens
tgaagcagacagcaactcattgcaactgctcctgtcctgtcggtcgagaggagagtgcagcatgacccaacagccctgctgctcccagccgcagacaagccatccttcttggctgctgttttcatcattttttaaaggactgttgagggtgggaggaagtagga

SEQ ID NO: 234050 - DNA, 366 bp, Homo sapiens
ccattgtggtattagagcttcatgaactgtgtatctttgattagttgatttaacctgtctggccctcatttttctcatctgtaaaataattgagtcttatgtgatttgaagatcaaaagaattactacacaaacagtgctagtaagagtccctgccacatagaaaggctagtacacacacacacatacatatatacacacaccccctcatacttttatatattaaaggtgtatgatttatgaattattgcattagaaatgtaaatctgttatatatatcatatatatgataagtgaaatacagattatgtaatttacaccacctattttattttgtaacttcgtaaacagattttgaaaattttat

SEQ ID NO: 234051 - DNA, 523 bp, Homo sapiens
ctaaagacccagatgggactcattttgtgccttcaaggcgctcagagttaagaggcagtgagctagagtagaagttaatggtgcagtaagggtaagtgctgtgagctgcagggagaactgtgcctggagtcccaggcgacactcaggtctgctctcacatcgaaagcactgtctatgctcaccagactgtgagccgctgaggccagagccctccattcatctctgcgtccagcacccgacaccaaccctgcccatggatgtttgccggatgagccatccgtttgttttgttttgatttgcacaagtaatccatgctcatagaaactagaaaatagtaaagaaaaagattaaatctcccttaccctgaggcaaccactgttaactgtttttctaggcatgtatgtatacatgcagcccctttattaaaaagtgagttatatatgatacatgttgtcttgttagctgctttcattcagcaggctgttggggccagctttctatgtcagggattatgggcttccgt

SEQ ID NO: 234052 - DNA, 301 bp, Homo sapiens
tcggcttactgcaagctccgcctcccgggttcacgccattctcctgcctcagcctcccgagtagctgggactacaggcgcccgccaccacgcccggctaattttttgtatttttagtagagacggggtttctccgtgttagccaggatggtctccatctcctgacctcgtgatccgtccgcctcggcctcccaaagtgctgggattacaggcgtgagccaccgcgcccggctacagtttcactttctctaaacaaataaaggtgcccactctgggccatcgctagctccttaccctgcgtt

SEQ ID NO: 234053 - DNA, 510 bp, Homo sapiens
agtggagcagggacacaagggggaatacaggtcaaatggtggtgtacttacataactggcaaaaattctgcattagcataaattaataaattaatcaaatgtctactacactgcctctacaataattatcacctaattatatgaaaagattaaatattttaaaatgaaaaattcttattttccatcagcatacatacaataatcattcatctaaaatgtaggcttgattttaacctatggctcatatgaagacaaactctgggtgtgctcatcacttttttccctgccttggttctacaattatacccctcttactccatgtcatcctgcataggttttcagacatcaaagtatgatgtcaaattattgctatatgctctgtgaataaagaaattactagacaggaagatatttgtatatgtaatatgcaagattcaattaacttgaatttccctttttttttaaaaaaagggtataaaatgagatagcatctttttaaggatttcagca

SEQ ID NO: 234054 - DNA, 411 bp, Homo sapiens
accctataacctcagctccccagtgaatcaaaactgtccaagtccctggtccaataggcccgcatcactgagctggcatcattgtctcatggctgtaaccagatctgattgatatttggccagtgagtccctttttaatataggatttgttaagatattgaagtgctctcgaactggttccagcctcctagctggacaaggagcccagggccctgctccaggggctgttcctattggtcacttagcttagctgtaggaggaccctgcttgacttcttaaaattctttcctgagtcctctttcctttctccctcccttcctttctgggtccccttccttcttgttttccttcttcctttctcaaactcttccagaaaggcattaaagtgattgttgaaaatccaaacaatga

SEQ ID NO: 234055 - DNA, 244 bp, Homo sapiens
atatggcttcgagattggaaggggaatgaattgcaacgctgtatgctaaagaagaaaatggttggaaacagaatgtttgctgatgagctgcacaacctcaataaacgcatcagctgtctctacaaacactttaactgacatgggaaatatcgatagaagagaaagctgagaacttcagaaaaggctcatctgtcaccctggagaagggaagctgtacttttccttatgaggaaacggctttgta

SEQ ID NO: 234056 - DNA, 524 bp, Homo sapiens
ctaaagctcaaattcattttggctacaagtttactttcagggaattgagactttaatccttaactggccagtttgctgacagcaaccttttcctaagttaatcagaggccagaggatcagttaaaatcaattctactttttggcagatgcagattaatgtcttaatgtagtctgaactcacacttttcactctggagtgagttaaggcggggcttatagagagccaggggatggactgacaaaacccaggaaggatggtccacgcctcacactgctggtcaagggctccatccgcaagcctgcatggtacatctgtggatgggagagcttgatgcccggagccagagctccaggctgcgtaggggctaagagctcatggtacggagttttctgatggataccaggtgctgtttaacacaggactttctctgtccataaacacattagtcattatacaaaagagtcatctgaagaatttaaaaatgaccaaatggaaatataaatataaaatatcaaaaaatatg

SEQ ID NO: 234057 - DNA, 588 bp, Homo sapiens
ctgcactccagcctgggtgacagagtgatactctgtctcaaaaaaacaaaacgaaaacaaaaaaaacctgtgacttttggttactccccttctgtagaaaagatgagcaggtattgagagaagtaaactgtaaacttgcagaggagttaaaaacagactcaggttttcttgaacagtggacatggtggcactgtccctttgtcatgaacatagtccacatatgccattacaaactgttgacagtactgtaaaatataacacattctaggtaaggtattgtctatatggtagattaaatcagaaatacaaaggctgggtgtggtgtttcacgcctgtaatcccagcactttgggaagccgagggggatgggtcatgaggtcaggagttcgagaccagcctgaccaacatggtgaaaccctgtctctactaaaaatacctgtaatcccagctactcgggaggctgaggcaggagaattgcttgaacctgggaggcagaggttgcagtgagctgagattgcgctactgcactccagcctgggcgacagagtgagactctgtctcaggaaaaaaaaaagaaaagaaaaaaag

SEQ ID NO: 234058 - DNA, 359 bp, Homo sapiens
ctgcactccagcctgggtgacagagtgatactctgtctcaaaaaaacaaaacgaaaacaaaaaaaacctgtgacttttggttactccccttctgtagaaaagatgagcaggtattgagagaagtaaactgtaaacttgcagaggagttaaaaacagactcaggttttcttgaacagtggacatgtagctgcacgtggtggtgcacacctgtaatcccagctactcgggaggctgaggcaggagaattgcttgaacctgggaggcagaggttgcagtgagctgagattgcgctactgcactccagcctgggcgacagagtgagactctgtctcaggaaaaaaaaaagaaaagaaaaaaag

SEQ ID NO: 234059 - DNA, 431 bp, Homo sapiens
ttctcatgagttcacttgcttcagagaaagatacttcctattttcttatgagctaagaatggaaagctaagaactatcaactatattaaaacaatgaaaatgatcaaccttataagttgagtttgtattaaatctgaagtattgtagatataatgatactatatcacctattgtaggtataaatatattataagggcttttacccaaaagaataggacttgcttttagaattattctgggttatatttgtcttaccataaattcttcataaatatatcttacctatattattaacatcattttttcactgttttctcagctgatagactctgtatttggagtaattatttgcctaaaaaatgcatgccatcttgacgaggtcaacattccaaaatattttttgtactgagttaataaaatatgttacatta

SEQ ID NO: 234060 - DNA, 503 bp, Homo sapiens
caatttaaagttaagtttagctctttctccaagtataaggcaaatagcgatctctcagattattttccttatcatggatgattaacaaatggatgtagtcggagaaagcagtcgtatctgtttattgactcatcaaaatcaattatagctagattagcagggcaggattatatagatcattcactggattcattgatgataaaaaggacaccaagttgatatgtgaagaaacaaaattgcaggaagggcatatgcttcttaaatgacccactgttagaggtttcttttcagttatggaaatgttaagcaatcttttcatagaatcttccagggaactaaaatgacttggtgcaggaatgataagtggagaagagtttaaagttaatgcaaatgcatgatctaacttatgcaaacactgtggcaaagcacacagactaaggaacccaagttagcaagcacatcagctagcatcctgtttacatttctgtcctcagctctactca

SEQ ID NO: 234061 - DNA, 676 bp, Homo sapiens
tatgtccaattcctgccaggatccgcctaaatccaagtattatcaagtactatctattgtagacagatccatcaggtactagtcaggaaaacatcaattgttccagacacctccacataacatgcataatgctaagagcatctgcaaacagaggttgttaatgtatcatttatgattttataaatatccacaaaactaatatattcaaatatcatatatattgaccttccttaaagtcttccaaaatcacccaaagtagacttcctaagtgccctatgtactccctgagggctttgaaaaacccctttccataagatttatcatactcctttataactgctgtttgctggtctggctccctcattagactaaatattacaaaaaaaaaaaagatatcttatccctatctctggttctagaaagtgcctgaaatatggcagatagtcagatatttgcccaatgaatgtctaatcaaaaatatgttgcaccaaactgaatactacacttaaaaggtaattcatttcttcctagcaatttttgccatttaaaaatatagagagcagtgcatggtggctcacacctgtaatcctagcactttaagacgccaagataggaggatcacttgaggccaggagttcaatgccagcctgggcaacatagcaagacttcatctcta

SEQ ID NO: 234062 - DNA, 514 bp, Homo sapiens
cagggttctgggctgtggtaaaaattacgattttccacaagactattctgacactacacaagcaaggaggggatcctcatttcttctgaggtagagagactgagactaggggatattgaatcatttacccgaggacacactattaggaagtgtcagggttaggattctatatccagtcctgtctcgtattcctctcttacatagactctgtgcttcagccaatctgcttaaccgaagatgaaattaaaagataaaatggatgcaaaatacttatttagtaagaaagcagtgaatggaggatatatgtggttcgtagggtaactcagctccacagtacattggggacccagacctttgcatcctattggaggattctgaagagtaggaatgaagctgaagagtagaagtagaatctgaaaaagtaggacaactggcttcggatatagaagcattatctgagctcagtaattttttttcaaagaaaaaagcatgaataaatacatgtgtgaaacct

SEQ ID NO: 234063 - DNA, 453 bp, Homo sapiens
aatgatgaactaaatatacagtatttctacattctttggcatgcacatgaaataaagtcatactttttttcaacaaatacaacagctgcaaaagtaggtaaattttatttcataaacttacctttctttagatgattttctttgtttttcatatttttagtttcaaatgctttgtgagatctctagatgccgtttagttttataagagggcttaatattaaacttgggttaaatacgtatatgtttatttgaatatttcacttgctttcaattgtttgttttgcttttaatgacaaggattttatttgatctttataaaatttgtatatgcaaatacaaaaaatattttcctttctatttcttatgaggtcaaatttttaaattaactaaaagaggggcaaaaacttgtacttgataaatatctgtgcataataaaaagaaatcccagactat

SEQ ID NO: 234064 - DNA, 4040 bp, Homo sapiens
tgcagagaacagagaaaggacatctgcgaggaaagttccctgatggctgtcaacaaagtgccacgtctctatggctgtgtacgctgagcacacgattttatcgcgcctatcatatcttggtgcataaacgcacctcacctcggtcaacccttgctccgtcttatgagacaggctttattatccgcattttatatgaggggaatctgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttccgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagccagaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagcctccaaaacaaatcaacctagttctatagatgaagacataaaagacactggtaaacaccaatgtaaaagggcccccaaggtggtcatgactggtctcatttgcagaagtctaagaatgtacctttttctggccgggcgtggtagctcatgcctgtaatcccagcactttgggaggctga

SEQ ID NO: 234065 - DNA, 392 bp, Homo sapiens
atcaccctttcggggccaattttaataacttcttgtttaatgttgcaaaactagatttcctaggaagattgttctgatgtacgagtgtggagcgtcgcttatcctaaaagcttgcattttaaccaggaccctcttaaagtagccagtccccagccaggcgcggtggctcacacctgtcctcccaaagtgctaggattacaggtgtgagtcaccacgtccgtccagtcacggtgatccatttgtaaagtcgggaataaatgacctctgaagtgttgtctgtatgaaacggcacattgactacagtagacaacagatttctcttttctggaaggtgagttttaagcgtcaacttaaaactcaagggaataaaactgaaggcagaaaaagaccta

SEQ ID NO: 234066 - DNA, 1741 bp, Homo sapiens
cctacattaaaagccatatcctttaatacatgcctttcttcctttatcttcctttcagaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagccagaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagcctccaaaacaaatcaacctagttctatagatgaagacataaaagacactggtaaacaccaatgtaaaagggcccccaaggtggtcatgactggtctcatttgcagaagtctaagaatgtacctttttctggccgggcgtggtagctcatgcctgtaatcccagcactttgggaggctga

SEQ ID NO: 234067 - DNA, 449 bp, Homo sapiens
gtagcagttcagcccttatttgccttcaaaaaaagaaaagtacaaagtgttctctaattctggcttttagaaagttctaggaagttaaatgaacacttttttttcactatgaattatatgagtgaattcatcagaacggctgcttctaagaaggattttggtggttttagaaaggtaggtgtttattcctttgcctgggaagcctcaccagagatgttgactctacaacccatctcattcgttagtttttgtggacagcagttgcctcatcgggaatttttttttttcacttccttaccatgtttcccttcggatggatagactagcccgacccagttggtccaggccttttcactaccaaggataatttatctaacaggaacaattaccctgctgacaccatgatttggaaatttttattcagaactgattcactaaaatgattgctt

SEQ ID NO: 234068 - DNA, 798 bp, Homo sapiens
tttgggtccgctgtcaatcctggtgccgtgatcgactcattctccacaaagattatctttaaacttctccaagctaggtgcagtatctcacgcctgtaatcccagaactttaggaggctgagatgggaggactgcttgagcccaggagttcaagagtctgagaccaacctgggcaacacagtgaaacccaaattctacaaaaaatacaaaaaatcaggttggcacggctgcgtgcacctgtagtcccagctactctggaggctgaggtggaaggatcacctgaggccgagaggtggaggctatggtaagccatgatcacaccactgcactccagcctgggcgacagagggagacaccgtctccaaaacaaacaaatgttgaattattgctgtaaattgaaacattagaggttaatgatactttgagtatttacaataacgagatcttgagaggtaggacaggaaaggcttttgtaatgagagcttggtgtgagatctgatgccttttacaaagaaaggagggaactcctctaagcagagggaatcaggcgtgcaaaggctggatggcaggaggaagcacagtgagtacaaaggctgaggaatatctgaggggtttgagctaatcgacctgaatggagtgtggtgtgagttgaagctggagccggaggaagcagagccttagccataccgagaagttttgtgcttatccaagaattaaaggaaaccagtcataagctttaagcagaagtgaatgactggtttcctttaattcttggacaagagcaaaactctgtctcca

SEQ ID NO: 234069 - DNA, 430 bp, Homo sapiens
tctcctcttctcatcgcgggcattcaacattcctgctctgcttcagaaggaggagctctatttttcaagactaaacaaacctgctcttctctctgtaaggtaatgggacctgtatcttccaaggctctgtggtatatgaacgtcctggaagaggtttttcagaataaagtgcagttatggcctcacaagatgttaagaaatgtgaattgaagtaaaagttctgtgatatattaagctatgatatactaaaacttttagtttgcatttttcatctgtgaaaagtctattgaatctttttcctgtgtataaatagattgttttctatgtaaaagtgaatttttggtttcggtcattgctaaatacctagtgcctgttgtagtgtctacacatagtagacactcaaataataaataatatttgttggataaat

SEQ ID NO: 234070 - DNA, 356 bp, Homo sapiens
gaatctcatacctaaggactgcagaaaatgcttgattctcagcctgaagctaggactcgaaagtttaattgatactttcaggctatagcctatctgataccatgaacatttattttcctttgttatttcttaactgtttgttctgtttgaaagagtgcataaagtaccaccattacaagggaatacagtttgaagaagaaaacaaattagctccttaactttcaactgccacccgatcactcttgtttcctatgcacatattctttacattctctcttcccatctgtcactttatctctctcctctttatatatgttcacagacattcacaattctacggaaatagtcattctatc

SEQ ID NO: 234071 - DNA, 654 bp, Homo sapiens
aacccccacactaagttttcactttttctttcctagctgtataaatcagaagctgagtgaagacaacggttttgcttgctgctgctgattttttaaaaacaaaagcaaaaataactgtgttaataaagagaattccagtgcattacacagagcagatcctcaagcatctgccagaaattagagtaaaagcagtcatgttattccaagagacgagcactaactttcactccggctctgcagagttcacaggtgctcacgctattcttaatgctgaacttgtatgactgtggccagcacagcccatccttcaatgcttgtgtcttcatcaaacctgtagcgcttctcagtgcagggggcatcctgcatcacctatttcatcattcaccttgctgaaatacagaccctgactcagcggctctgggtggcgctggggtgagggagagcctgcatttctaacaggctccagggaccatgcatgtcttcaggctgtaatttgaccagcaggtgcgaggcagttgataagtgtctatggatcctgataacatgttatgattatcatccctcattacagagggggaatctgagtcatgaagggtaggtccttcccttcactcaacccttcagtaagttccatgaactctgggcccaggaagg

SEQ ID NO: 234072 - DNA, 437 bp, Homo sapiens
ttttttaaaagttatacatcttggctgggtgcagtggttcacgcctgtaatctcagcagtttgggaggctgaggcgggtggattgcttgaggtcaggagttcaagatcaccctggccaacatggtgaaaccctgtatttactaaaaatacaaaaattagccgggcatggtggcaggtgcctgtaattccagctactcggaggctgaggcaggagaatcgcttgaacccgggaggcggaggttgcagtgagctaagatggcaccactgcaccccagcctgggcaacagagagagactccatctcaaaaaaaaaaaaaaagttatacatcttgacagcaataatcataaaattaagcaaaattagaaggagggagaaactttgtgtgttactttcttcaattttggtggtgggagtgaataaatatggtctaaaattga

SEQ ID NO: 234073 - DNA, 511 bp, Homo sapiens
aaaaataaactcttttacttaacaaacaccttggtaagtgaatgtcatggtatattttctagaagagtaaaggttgaagaaatgatatttcttattaaagaaacttagccagttatttgtacttcaaaagaaaaaaagtcttaaagtgaaacaaacacacacagagaaacaagaacaattattgaacctactaaaaggctgctatagtttgaaaacatccccatcaaaattcagtattaaaagatggggacattaagaggtgactaggccatgaaggctcttcccttgtgaatgggattaaggctatagtaaagaggcttaatgaagggttcacctagcttgtccttctgatttctgccatgtgaggacacataaagaaggccctcacaagatgctgctgacttggtgttggaatttccaccctctagaaccgtaagaaaatagaattccgttctgtacactttacccaaactcaggtattctgttagagcagcacagatggattaagaca

SEQ ID NO: 234074 - DNA, 198 bp, Homo sapiens
cccctgcctgaaatgtttccaagaaatgcatgtggtagaaaacataattaatcagggtccatttttgtcaacctccaggagtcagggcaaagccaagtcattgattttgctgcatttgaaaggctgttgtttggtatgtcagccttgttagtatagttgaaagtacctattaagaggctagaagcttggctagctcta

SEQ ID NO: 234075 - DNA, 224 bp, Homo sapiens
ttacaaagcaatactcatagaaatttagacatagaaggtaacttccttattctgataaagaatgtctacaaaaatattcaagaaccaaacacatggttaatatcatacttaattgtgaacctttataataggaatgatttaaggatgctctcttttacctttttcatttactattacactggatgttctagctatacttaggcaggaaacaaaataagattaga

SEQ ID NO: 234076 - DNA, 317 bp, Homo sapiens
ggtggcctcctgaaattgacccaagcgtgtcagctagtttccagttgttttctttttccagccccagggtctgttctctctttcaagccagttccaggcctacttttttctaggtctccccctagaaaagcggccccacctcccctgcatctctgccactcggatgcatctttggtgagtgccgtgggagcaaacctccaggcatcccagaatttcaggtcctcctggaattgggcccttactcaacatttccagtcctgatggaaacctgcacccaggcaggtctctaagctaacagtgtccttgctggggcctgg

SEQ ID NO: 234077 - DNA, 167 bp, Homo sapiens
aactactgaggcagacattcctaagtgaactgtctagaaaaagctaaattaatgaaccaagtaatcctgggaaatcctgtcccataaaaccattagttgcaataggctaattctcaataaaaagcctggcaaattctcagaaggcaaaaagcctcctgagccttaag

SEQ ID NO: 234078 - DNA, 422 bp, Homo sapiens
taatcataaaacagaatggtagagaggaatattttaatattattcttaattcaggagcccatctgggtcagaacttttcctcctgtttgtttttatttactctacccaggagttcataataatgaactaaaacagctacggggccgggcgcagtggctaatgcctgtaattccagcactttgggaggccaaggcaggcggatcacgaggtcaggagatcaacaccatcctggctaacaatggtgaaaccccatctctactaaaaatgcaaaaattagccagacatggtggcgcatgtctgtaatcccagctgctcgggaggctgaggcaggagaatcacttaaacctgggaggcggaggttgcagtgagctgagatcacaccactgcactccagcctgggcgacagagcgagactccatccc

SEQ ID NO: 234079 - DNA, 524 bp, Homo sapiens
ttttaaaaaatgattaatattgccaaaccaaaggtcatgaagctatccttctacgtaattatttgaaactttttttaccttttacattcacaattagattgtaggggtccaaatgaggcaggagaatagagtctggagacagggaacctaaggccaacccctgctgacttcttggaattggactaagaggaaaacctcacctctccgtgaccaaataacgaggccaaaggccctccttctctgaacctcccctcccctgtgtcacaatgggaatgcctgtgattggttcattctgaatccctcatttgcagggtgcctctgattggtcctgggcagaattcttcattcctatagagtatgacctgttagaggcttctaaaggacgtttaggcgtgctactatgctcttttagtttaataaaatccccaaggaacattataatctggacttttgagccacttgtttgagccctctctaactctgtggagtgtactttcacttcaataaatctctgcttttgttgc

SEQ ID NO: 234080 - DNA, 325 bp, Homo sapiens
gagacagaagaattgcttgactccaggaggtgtaggttgcagtgagccgagatcgcaccatcgcactccaccctgggaaacacagtgagactccgtctcaaaaaaaaaaaaagaaattaaaacatatatatgttaatatatgggaaggacaagtactgctctcctacgtgcatatattgtgtagtggtaagtctgggcttctagtgcacccatcacctgaatcgtgaacagccagtcaattcttatcctggttccttcacctcctgagttgtgattttgagaatctgtggtgtattgattgagatagcggtttaagagaaagaga

SEQ ID NO: 234081 - DNA, 444 bp, Homo sapiens
agtgaacagcatgttcaaaagcaccgggctacaaaaatgcaaggaatgttcaggaactcacaaggagggaaaggaagccagctggctggctaacaagcataccgtaaaagtagtgccagcaaaagatggaactttaatgattccaagacaggcagttgaggcaggacttggtgactaataggaaatgctggatgagggagagaaatgaattgctaatctgaggtttctagaccaaaaatatttttaaagatagaatattaaataagacaaagtgcaaaggcaggttaacaaggaaagctttgtatagttgtggacatgcttagtatatacctgtggaacatctggggggaagcgccctgtgggcttttggaaattcaagtgtagaaagtagatttggagtcgtcagcaggagatgatgagaggctgaagctaatgaaaaagtgt

SEQ ID NO: 234082 - DNA, 803 bp, Homo sapiens
ttgtgcaatattatgaattgatattaataaatgccactgagtggtttattttaaatggttaattttatattatgtgaaatttatctgagcttgaaaaaaaaaagcatggaccttgaaagcaaatagatttataatcaggttccaacttgacttctcattagccatgtgattttggccaaattatattttctctctgaacttctgttttgtaacactagtataaaaataatagactttttttccagttagaaaggccaacagtgttaattagttttcagggaaatataagatgcatataaacataaacaaaatataaaacaaaacaatcaaaatcttacagtccaggagcatatcaagacagagcattttttgcagacacaagagtactatcaaagggaaaaatgatacctggaaagtaaaaggccaaggggcttgggtgggtcccttacccaaggacactgcatttttgtggtgtagccataagatttttttttctttttaaaaagcacttcagtcttaaaaatattagaaacaggccaggcacggtggctcacgcctgtaatcccagcacttcgggaggctgaggcgggcggatcaggaggtcaagagatggagaccatcctggccaacatggtgaaactgtctctactaaaaatacaaaaattagctgggcgtggtggcagatgcctgcaatcccagctactcgggaggctgaagcaggagaatcacttgaacccaggaggcggaggttgcagtgaaccaagatcgcgccactgcactccagcctagcgacagagtgagac

SEQ ID NO: 234083 - DNA, 416 bp, Homo sapiens
tggtatctattaattcagatatgatcatgatactcttctggtagaacctttcaacatctccctttaacaattcttacccaagtttctatataccttagactaaagcacatgagaccagatagttaagagaaggcagttatgtgtgtgttccatgttgagtagataatattctgatagctttttctcctactaattgagaatctgattggataagtaacaccacactttcttttccaaattagagtccaaacaatacccacctcaaaaggttgtgagaaataaataagcacattcatattgcatatgtagcccataagtggtcggcaccaaatatctcttataggtgttttttttttttttttttttttttttgagctggagtctcactctgtcacccaggctggagtacagtggca

SEQ ID NO: 234084 - DNA, 521 bp, Homo sapiens
acctgctgctattattttctctataatccactttggtaaagatacataatagacatttatataatgcatgtaaaaagtcagaaaaccagaaagttctctgacagtaacaccttacaacctgatactgaagaaaatatccttgtaagatgaacattgtgcatttcatagacattgctcttttagttccctaagcctaactggcaggcctagcatttcattacatctcatatagcgactgattgcttggggcatcatattcctttaaaagtcatgcctttactgcctttccgtaattgcattctgtgtgtgcaatgatctgaaagctatttgagaagaaggagcataatattacatatatgttagagagaaataccaaacccctgtaccatttcttgacacttgaaggttttaatagtgctgattcaataataatgtagtcacatcattaatttgtattaccctggtttgcaatttctacaggctttttaaaaagaaaaataaacccatttaaatcttttatt

SEQ ID NO: 234085 - DNA, 159 bp, Homo sapiens
caaaattcagcttttgattttccattttaagttactatggtggaagcagctaaataatctctactatccactctccctttctttcttagttagaacatacaagttgtagccaggtacatggccttaaagattacatactacatttgcaagacctcttat

SEQ ID NO: 234086 - DNA, 291 bp, Homo sapiens
tccaagttctctgaggaaagcagttttgttgtctgcgataaatgaaatgaattggataagagttggtataaaatgcctaagtcttcccggaatgagggttggcagttatcagattcctcgtggaagttggtgctttatgaaactagcagcagtagtttgggacttattttattatacatatcaaagactgcagaaaagagagctatcatgggcccagatttattttcttgaccagatctgagctcacctggaaatgattcatttcagactggaatttaagtgaaggtaaaa

SEQ ID NO: 234087 - DNA, 583 bp, Homo sapiens
tattctgtaatcatgagaaccatgcagcacgtttacatgtagcatgtttagcatgtagcatgcaccatgaatacagaaaaaaggtcaggctccccttctagaggggatcctttgacaacttccatgctaggaagttatcatcaaagaccctcatttcacagacaggaaaacagattaagtcactgatacaaatttatgtaaccataagacactgaattatgtcagttatatttcagacataaatgggcttaaaatattctacaaaaaaaggaatgttctaaaaacagaagaccaagcaaacaagatgttatgaattctctcaatttcataaagctcttctggcagaggagacagattatttttttctaattgacagatgttttcaagttattttaaaaacagatcaggaactaaataaaaatgggtattaagatcacatccacactgagtgcaatggctcacacctgtaatcccagctacttaggaggttgaggcaggaggattacttgaggccaggagttcaaggctagtttgggcaacacgttcaaggctagtttgggcaacatgatgagtccctgtctca

SEQ ID NO: 234088 - DNA, 521 bp, Homo sapiens
aaaaactaactattgggtaccgtgttcactacctgggtgacaggatcatatgccctccaaacctcagtgtcatgcagtacattcatgtaacaaacctgcacaggtacccccgaatctaaactagaagttgaaattataaacaactgggacagcgtgcccctgggccagagctgtgtgtgtgcatgcatgtgtgtgctaaccagctgcaccagatgttaaccccgtagttgctgactgaggggaaggggtctgggggagggggacagtggccagagcagcagggatggggtacttaagagcctgcagcaggccgggcgcgatagctcatacctgtaatctcagcactttgggaggccgaggtgggcagatcacctgaggtcaagtgttcgagaccagcctggcctacatgatggaactatttagtctccactaaaataaaaaattagccgggcatgatggcaggcacctgtaattccagctacttgggaagctgagatgcaagagaatctcttgaacccaag

SEQ ID NO: 234089 - DNA, 481 bp, Homo sapiens
tgttttaaatgcttatgtgtagtgagaatgaagagcttttctccctttgcagggattcaagaagtcctgtctcacaggacagcttttagccctctgcagaggccgaacctccgcttattctcttgggagaaaaagctccaccctccaagtgttggtccaacttttcccacttgttcttctagaaattttcctgtttcagcagggcccggtggctcacgcctgtaatcccagcactttgggaagcccaggctggcggatcacgaggtcaggagatcgagaccatcctggctaacacagtgaaaccccgtctctctaaaaatgcaaaaaatgagccgggcatggtggcggacgcctgtagtccctcccagctactcgggaggctgaggcaggagaatggcgtgaactctggaggcggggcttgcagtgagtcaagatcttgccactgcactccagcctgggcgacagagcaagactccatctc

SEQ ID NO: 234090 - DNA, 482 bp, Homo sapiens
atcgataagacttatgcattaatctttttttttcttttttttaaatttcaatcccttttggggtacatgcagtttttggttacatggacaatagtggtgaattctgagattttagtgcacttgtcatctgagtagtttgcatcgtacgcaatacatagtttttttttttatcacacaccgccttcccactctctcccttctgagtctccaaagtccattattccactctgcatgcctttgcctactcatagcttaactcccacttacaagtgagaacatacagtatttggttttccattcctgaattacttcacttagaataatggcctccagctccactggaggatcgtttctttctcatcaccaataaagttagccaattttcacggtggaatatggaaaaggaaataattttttcttgagtgttaaagagatccctgaggtttaatcactattacttgagccctggctctaagagaagt

SEQ ID NO: 234091 - DNA, 372 bp, Homo sapiens
caagtctctgaaagtttctaaaatattgaaataacttgttcactgcaagtttggaagtactcacccatggaactgtttattttctttatgggaagatttttaatttctaggtcaaaagaactataaatcatcaaatgacaattcaggctttctacttattattgagtgagttttgataagatttttttaaaaaattgagaaaatttaaccaacttaaaatattacttggcaaacacttttatagtattcttgttatattttttaattcatctgtatccattttgtctatcctttccttcgcaatattatttatttgtgcctttgattattttttccttacactgccagctttttatctattgtttatttatt

SEQ ID NO: 234092 - DNA, 306 bp, Homo sapiens
tcccaagatagatggtcacacatgttttcaggagacctctatataaatgactttgatcacttgataccttgaaaagaggtcttggggcactagaatgacatctataagtgacaagtataaaatgtagtgctcagtgacattaaaaaacaaatcaacccacatagaggaagagctttggacgtagggatgtcaaactggtctagaatgtaatgaaaacccaagaaggtgccccagtaagaaagaagaaatcaatctaacaatgggatgcagcagcaagaatactgagacaggaaagaaaatatttta

SEQ ID NO: 234093 - DNA, 484 bp, Homo sapiens
cccttggggtgcagatgaataatgtgtgcacatggaaccagttagcaaattgtcattaggtctgctagatgtttccctcagaccatcctgtctgaaaccaccccatctcaaattgaactcttccatcactttctagcccctttccctgctctatttttcttcataatgcttactactacctggcattatattatgtgtttgttttttattgtccatctctccaattagaatgttaactgcagaaggccaaggactttgtccattggtttcccactttactgtatttggcacatagtcggtgctcagtaaatatttcctcaatgaataaatctgttcagtgctatgaagagctaaaaaatagaacataggccaggcacagtcatgtgtacctatagtcctggccacttggaaggctgagatgggaggattgcttgagcccaggagtttaagtctagcctgggcaacataccaagactccatgtca

SEQ ID NO: 234094 - DNA, 552 bp, Homo sapiens
tggtccaaaagggtgaactctatgtagttctttgctacacagttatgatctttcagtggaattagctcaaaaagctgttctgtgggctgaccactctcacctcctaccaaaaagagagaaggaaaattaaagaatcgtgaacatgctggtagcaggatatatacgcatctgagtgtgcagtttatggggagcaggtctgtgatactctttagtcacactgaggggccagtgttcgaaatgtgcccttagaaatagcaacaggggcccaggcgcggtggctcacacctgtaatcccaacactttgggaggccgaggtgggtggatcacctgaggtcaggagtttgagaccagcctggccaacatggggaaaccctgtctctactaaaaatacaaaaattagccaggcctagtggcacatgcttgtaatcccagctactcaggaggctgaggcaggagaatgacttgaacccaggaggtggaggctgcagtgagccgagattgcgccactggactccagctgggtgacagagcgagactccatctcagaaaata

SEQ ID NO: 234095 - DNA, 422 bp, Homo sapiens
agtctctgtctttgggaagtagagcaagggcgtaggatggtgggtgaagatgaaaccattggaaaagtgattatgatatcatgctgtttttcttattaaaaagttccatctaaccatttggaaaaaggaatattcctaagtaggggatttatgttggcaacttgagaaagaccatgtaactggatgactccctggaccttcatctcttatctcctgtggccttctggtgctatcctgctgttatcctgcagctcagggggtacaagtctctgggccagcttgtttctcacatacccaaagatgagccctttgatcataagcacttcaaaaattttaccttcatgatagaattctttccaaaacgtgttgcatactttcctgccttggtaagaataataaaatggcaatactactaccactaa

SEQ ID NO: 234096 - DNA, 494 bp, Homo sapiens
aatccagcctaaaaacccatggtctcagccaccatgccatgtttcctaaaaaaattacgctatgacagtggaccgtttttgcttaactccagagactttaattcacccacctagaaaacctgtcatgaaaatatagaggattttttcctgagagttcttaggaccgtgaaacagtgtcacaaatcctgttcagaaagctgggatcatgcagatgaccaggcagatggaagaaaagtaaaaatataaaaatttaaaaacctgggatcactgctttaagtttcaccgagctttaactttctggaagaggagaaatataacacagaccctacgcattgagaatagatggcgttggagttgtggattatctgtgcttgccaacagtgtacaggaaaaaaagcgatgcatttgacttccctgcttggcagagccactgcctctagagtattactcaaaaattgattttttaaaaataaaaataaatgaatttgaagacg

SEQ ID NO: 234097 - DNA, 401 bp, Homo sapiens
aattgagatggagcctcgttctgtcacccaggctggattgcagtgttacaatcttggcacaccgaaacctccgccttccaggttcaagtgattctcctgcctcagcctcccgagtagctgggattacagtcacccaccaccacacctggctaatttttgtatttttagtagagatgaggttttgccatgttggcctggctggtcttgaactcctgacctcaggtgaccctcccaccttggccccccgaagtgtggggattacaggcgtgagccagtgtgcctggcccattcattaagttctgacaaaagtatgtatctttgcaatttaaactttctgtcaagatgctaatcatcccctttaccccaaaaagtcccctcatgcccccttctgtcgtcttctc

SEQ ID NO: 234098 - DNA, 472 bp, Homo sapiens
actgagtagagacattagtggctacatactgtggggagatacatttcacagttcgagtccaggccagtcaattgactgctatcccaaccaataaccaacaaccttcagaagagcaacacaaaatccacagttgctacaacatattgcacacaatgtcctgcttctgtctaaaaattattagatgtgcaaagaaacagaaaataatgtttcatactcaagaaaaaaaggtcttaataagcaggtacttagtaagcacagatattcaattgagcagacaaacatgtggaagcagctattataaatatggcaaataactttttaagaaaagctttgaacagatagcaaatctcaataaattagaaaaatcaaagaaaaataatttggtaattctagaattaaaatgtactgtaaccgtaaagaaaaattcactagatgatctaaagcacagatctgagatgacaaaaataaaaaa

SEQ ID NO: 234099 - DNA, 564 bp, Homo sapiens
ggcaggggcatgatgtctgagccatgccctccctagagacctcctctttgccctaatggcttaaagtcagggccatttcaggaaggacagcatctcaaatgctcatctagggactatgagcccctcagatcacctcagtctttaaaaccaactgcaaaggtgcatctcctaaacctgactactaatcattcctcacagagaatggaatctgggattctctagaaccttctacctgatggaggcctttcagtgttctgtttagccacagagctggtgccttttctgctagaccaccacctaatgattccagaggactcactcccctaaaccagttaccctctcccacaagtacccagggccttgctatccacttcttggatgaaaatatttggatcagactcagacaccttgaccccggttcagtttttcctggggagcggctgtggccccctctgatgcccccagctcaatgcatcacagaaagaattccagccactcagcaacctcttgtgatcttccaggtgagcaggttaacaaattaaagaatcattaccattaccatta

SEQ ID NO: 234100 - DNA, 402 bp, Homo sapiens
gcctgggcctcccagtgttcgggctcccacactgctgccctcacccactatgtgcatcttcccaacttctggacatcctcactcctcctctgtccaatgtaaatcagaatagtgggccgggcgcagtggcgcacgcctgtaatcccagcactttgtcaggctgaggcagaagaatcacttgagccaggagttggaaaccagcctgggcaatacagtgagaccctgattctacaaaaataaaaaattagctgggcggggtggcgtgagcctatagtcccagcaactcaggaggctgaggtgggaggattgcttgagtccaggaggtcaaggctgcactgagctaagattgggccactgccctccagcctaggcgacagagcaataccctgtctcaaaagaaaa

SEQ ID NO: 234101 - DNA, 416 bp, Homo sapiens
aataaattatgtgctttgacaataaatatttgaaaataatacttatagtaggtaagtgatatagtttgaatgtgtgtccccaccaaatctcatgttgaaatgtaattcccagtattagagatggggcctggtgggaggtgtttggattatgagggaaaattcctcatgaatggcttggaccatccctttggtgataaatgagctctctctctttgttctcaggagatctggtggtttaaaaatgtgtggcacccctccctctcacactctcttgttcgctccttttcttagcatgtgacatgcctgttccccctttgccttctgccatgattggaagcttcctaatactgctatgcttcctgtgtagtctaagaaccctgagccaattaaacttcttttcttataaattacccagt

SEQ ID NO: 234102 - DNA, 287 bp, Homo sapiens
tttccatgggccctctaatacacaccttaaaagtgcttccttttccattcatttcctgagttactggtgttccagtcagggttgtctaccagaactgcttcctttcctagtaggaatggagtttccacttcttcctcaccttccctatctcctctttgtctcctcggtttgctacaggaggcatgttgctcatctccatatttttctgctgcctgcagaactttctgcttttcagcttcagtgagggtctgacgtagcagcaacgtaacatccctctatgaaggtca

SEQ ID NO: 234103 - DNA, 411 bp, Homo sapiens
taaactactagaaggtcttaccttcaacaacaacacaactcgtattgaactattcatgggtcggggcagcataaaccaccacgcttaacatttattgagtgcctcccatgtgctgagtactttcttttcagacaggccaggcatggtggctctggcctgtaatcccatcactttgggaggctgaggtgagtggattgcttgaggtcaagagtttgagaccagcctggtcaacatgacgagaccccctctctactaaaaatacaaaaatcagctggacatggtggcacacgtagtcccagctacttgggaggctgaggcacaagaatcacttgaacctgggaggcggaggttgcaatgagccaagatcacaccactgcacttcagcctaggtgacagagagaccttgtctcc

SEQ ID NO: 234104 - DNA, 478 bp, Homo sapiens
  misc_feature (12)..(12): n is a, c, g, or t
caaatggataanctgtgatatatacatatacatacacatatagttctcttacataattttcagctttacatatgtagaatcatgctgtttgttttcttctgtacctcagtttttttcactaaaaattgtcttctgaaaaaaaaaagcggaggtatcatacttcctgatttaaaattatattacacagctatagtaaacaaatcagtatagtacttactcaaaaacagacacagtgaaacagaatggagtccagaaataaattcaaacatatacagtaaactaatttttgacagagacaccaagaggatacagtgggaaaaggttaggctcttcaataaatagtgctgggaaaattgaatttccacatatatgcaaaatttataaaatataagacctaaaactataaaattccttaaagagaacacaaaaagctcctggacattggccttggaaataattttttggatatcacaccaaa

SEQ ID NO: 234105 - DNA, 1369 bp, Homo sapiens
  misc_feature (1)..(2): n is a, c, g, or t
  misc_feature (5)..(5): n is a, c, g, or t
  misc_feature (7)..(8): n is a, c, g, or t
  misc_feature (347)..(347): n is a, c, g, or t
nntantnnggaaaaacatctgcctgaactccaggcagtaccagcaccttccttgtgtccagcgttgcatggggagtgccagacagcaaggccccacttgtgggcaggtctgtgcactgtgacatgccagcctcttcacagcccaggtcatcctcacctccaccccatgaggtgcaactagatgaaactgccacttcccagataaggaagatgcacagggagctaagaggcccggctgaaggtcccacagtgagaaaagtcagtagcccagctgtgggcctgagccccaggtgctccagtgggcaggatggagtcctggtcttcagcaaggctcagcttggtgggggngacacatccccgaccccagacagactttgagttctggcagctgggcactgggggagctttctgggaacaagcgtgaaccacacatggtccctgccctggagtcgcttacatctcccaggagagggggatacatccacagactgtgaacacatgggcctaagaggggccacccagggctgcagaactgatccatcccatacaaaatcactgaaaagacccccacagaccttgcttaaaaatagtcttcttggccaggtgcagtggctcacgcctgtgattccagcactttgagaggctgaggtgggtggatcacctgagggcgggagttcaagaccagcctggccaacatgggaaaaccccgtctctactaaaaatacaaaaaattagccgggtgtggtggcggatgcctgtaatcccagctactcgggaggctgaggcaggagaatcgcttgaacctaggaggcagagattgctttgagctgagatcacgccgctgcactccagcctgggcactagagcgagactccgtctcaaaagtctcctggcggtgtgtccgcatcagagttcaggtcgttcattgtgaatggatggtgcatcttttacatctaagtggactcctttttaagccgtatttgagacctagttggctttcccttcccaagaatgtcctggcccatggtcctggagacctctgaacctgggtgtccagctactagacacgtaaaaaccatttctaagtaccccttgtgggccaggcttatatctgtaatcccaacacttagggaggctgaggcaggaggattacttgagcccaggagtttgagaccagcttgggcaacagggtgagacccagtgtctacaaagagtaagatgattagtggaacatgctggtgtgcacctgtagtcccagctacttggaggctgaggtaggaagatcacttgagcctgggaggttgaggctgcagtgagtcttgattgtgccactgtactccagcctggacaacacagtgagatcctgtctc

SEQ ID NO: 234106 - DNA, 455 bp, Homo sapiens
ctcaaaaaaaaaaaaaaatctatcttttaaaaatacttactgaaatgtagctacgtgaattatgattttgggtatttgcttcaaaataattgagtggattgtaacagaaacaaaaattgacaactgggacctaactaaagagcctctgcatagctgaaactatcacagaaaaggagaccatcgacagaataaacagaaaacccactgaataagagaaaatatctgcaaactatgcatctgacaaaggtctgaaatccagaatctataagaagcttaacaagaaataaaataaccccattaaaaagcaagcaaaggacatgaacagatacttctcgaaaggagacataaaagtggccaacagacgtgaaaaaatgctcgacatcaacagtcatcagagaagtgcaaatcaaaaccacaacgagataccatctcacacccgtcacaatggcttttat

SEQ ID NO: 234107 - DNA, 463 bp, Homo sapiens
agctgtccttgagcctcgactctgggtgagccctctgggtcttagatttgagatgcaattttcaaacttgaagatcacggtgagcagagagatctctgagctactgccaatcctaatgtcccttgtattgagcgttgactgtgttgacaatgaaaagccagaagagcctcaaggaggaaagaggtcaatagccaaatgtttcaagaagtcaaggaagtcatgaaatgttggggcaagtcaggcaggtgcagaacaacatgtaaagaaagtgaagtatactatatattatgcaaaactgaggctaagtgctgtgtggatcccaagtatgtacctgtaaaaccaaaattaacagacacaaatacaagcctggaatcaacttctgcagtctgacacctctcttccaaccttgagtctcaacatcatgggatcctgcagttctattaaatcattcttggcaacaccc

SEQ ID NO: 234108 - DNA, 373 bp, Homo sapiens
ctgcgatagctgatagtttcactgatcatttgatcactgcataatataagttgctaatcttttagcctccaataactttccttgcctccttccacccagctcctaaggcttcatcatatattttaggctttttggtaaggcagcaccccacttctggtttctactcgtagcagcttggataagccaaattatgctgtggtaataaacaatgcaaggtctcagtggctttgaaaacacactgtgtggctgggcacggtggctcacgcctgtaattccagcactttgggaggtcaaggcgggtggatcacctgtggtcaggagaccagcctgaccaacatggtgaaaccctgcctctcctaaaaatacaaaaaaa

SEQ ID NO: 234109 - DNA, 523 bp, Homo sapiens
taccaatgtgatgagtgtggggaaggccatagaaaggaccggcgaatgctggcattgatgtgtgttattttaacatttctgaaatcctgttcttagtctgcacaccttgtccgaggctccgatgttatccaggtcaccaggtatgcccctgggctcctgccgcagctgatcgggtgctaggtgctgaggatacacgtctgggagaaagcaattggaagaaatgcaaagctcttcaaaggagacctataaagtcatctttgttttgttcattcttctcatgtttctgcattctgggcattctcctaaattggggagaaaccaaaatgcccagaagtcaaattctgcaactgtcatcaagcaaaatgtcaaatgagagaaccaaagtatgctggattctatattgttaggaagggatggttaatttgattgactcttgggagctatttttctagcattaagtaattctagggaacccttctgtgatcatctctgagtaaataaagaagtgaaattgcaattcaaa

SEQ ID NO: 234110 - DNA, 475 bp, Homo sapiens
tgggcagaaatgcaccagggaaaggacataacgaaactggttttatcagaacagcctgcctgagagagatcaagcagggcacaggtcaccaggtatgcccctgggctcctgccgcagctgatcgggtgctaggtgctgaggatacacgtctgggagaaagcaattggaagaaatgcaaagctcttcaaaggagacctataaagtcatctttgttttgttcattcttctcatgtttctgcattctgggcattctcctaaattggggagaaaccaaaatgcccagaagtcaaattctgcaactgtcatcaagcaaaatgtcaaatgagagaaccaaagtatgctggattctatattgttaggaagggatggttaatttgattgactcttgggagctatttttctagcattaagtaattctagggaacccttctgtgatcatctctgagtaaataaagaagtgaaattgcaattcaaa

SEQ ID NO: 234111 - DNA, 507 bp, Homo sapiens
tgggcagaaatgcaccagggaaaggacataacgaaactggttttatcagaacagcctgcctgagagagatcaagcagggcacaggtcaccaggtatgcccctgggctcctgccgcagctgatcgggtgctaggtgctgaggatacacgtctgggagaaagcaattggaagaaatgcaaagctcttcaaaggagacctataaagtcatctttgttttgttcattcttctcatgtttctgcattctgggcattctcctaaattggggagaaaccaaaatgcccagaagtcaaattctgcaactgtcatcaagcaaaatgtcaaatgagagaaccaaagtatgctggattctatattgttaggaagggatggttaatttgattgactcttgggagctatttttctagcattaagtaattctagggaacccttctgtgatcatctctgagtaaataaagagagtttcgcccgaagttttttttttttataaatatgcgttaacaactagct

SEQ ID NO: 234112 - DNA, 2862 bp, Homo sapiens
  misc_feature (1431)..(1431): n is a, c, g, or t
cagttgacacctgggtcaggtgctctattaaagagtcattaaaatcatgtggccagggaacaaatacagtcttcgaatgtgacgattcaagcttcctcattgctgaacatgtttaggcaggtacaggcatccttaggtgtccacgtatttgggacatgtaagtggagaggcatgaacctgattcatttcctgatccagtgatgctcccagcccacccccaaacagacacagcgtagcccgggccagctcttaaggagttcaggagtgagaagaggccctcagagatctgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctggtgagctgagctctagagggatggcttttcatctttttgttgctgttttcccagatgcttatccccaagaaacagcaagctcaggtctgtgggttccctggtctatgccattgcacatgtctcccctgccccctggcattagggcagcatgacaaggagaggaaataaatggaaagggggcatatgggatttgtggacacagctgtttctgttcctgaactagaagtcttccccagctctgacgtggcagtgaggtgacctgaaggaaagaaaaatataaataaataccacttcatatttgtatagaatcctctaatcccttgtgacatagacttgacagggattgtatgccttctttatggatgaggaaattaaggttttagaaagcttaatgaattaaagagcttgtctaattagttagtagcagaacctggacttgaacctaggtctccttgctctaaatacagtgtaccttctactctaccagttgcgcaagaaagaagtcactgttacagaggcaagcggtgaactaggtaagagttcactcatgaagaaacgagtgctctgaagagccagttaccctgtgttggctgcaataaaggtcattacctctctagccaagagattgtttatgaggtgctctggcattttattccttctctctcttcctctctaactgcccctcccgtttctctagaccactgctcttccaacctaggccctggacctggctctggccagatccccttggcctgaagacataaggtaaagggagtgtctgagcttcatcccccagatccaggatcacatttcctttgaccttaagggacttccgtggccctgagcctgcttgtcacaaacaggctggtgggagctgccagagcttccttcctccngataatgatctcccctgcctcattgctaccctggctctccactctggcagtctgcccaggcctgaggggttgagatgcgaaaatgccatttccctgtccccctgggctacagataccatttctctcgttctggggactggagctggagaaggtatggcttggtattggccagtcctgatggtctctccaacattgcttgaccagcaccatccccttctttcttcctttatctcagtcccaaacaagctgcattgtgtcccatgcctgttctatttcaaacccaaattcattataagacattcccaaccctgctgaggattccactctacctatccctccccatcaactcctgtgcttttttactactgaccagagtcagagtaagctttggagccagacagaatcaggtgtaaatcctgactcccgtctacatgacctcgaacaattggcttgtctgtttctctacagcaaaatgtgaggaatcctacctgccaaataggattccaggtaaagatgtggaaatgctatctatgaaacgcttgtcagccccaagtactgacaggtgttagatcataactagtagtagcaatatccatctttggaaaacacgcagaccaaggcaaatacccccactaaggtctcccgagagacttccttctgccagagtgatgatcatgagtgggttagaggacaagcccgcaggcagagtcctgggagggcagccaggttgtctgagatgatgaggagagaaagtaaggaaaggatgattaaaggaaaggagagcagatcattaaacagttctaacagaatgagggccaataagtggatgagttggtcacaacagccaaacgactgagtgtaaaaacaactgttacctgaaaacagaacattgccatcatcgaatggacttctgggattcttgaataaatctgaagtttatccaaaatctgaatttgttttgaactcttgtggtcagtatactacatttaccatcctaaagagatgattttcacttgtggtgcacagaaaagcaagatacttggggcagccgatttttctcttcattttattcttttttcacaactctatcttctttattgatgatctttcttatggataatatggttttagagacattctcctcacaaaatttaaagtggctaaaattatgccttcaatgcatcctcccaaaataagaagaatttccaactaaaactttttcttgaaacttgacctaatatagcattaaaagttgacctaaatagcattaaataactagaaagttctgaagtaacctgtggtgatacaggtcagaatagttgtagccttggggaagtataactgtgaaggggcatgggggagccttctgaggacctggaaatattctattcttggtctggatatgtttcctatgtgaaagctcattgaacg

SEQ ID NO: 234113 - DNA, 757 bp, Homo sapiens
atggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacgggcccgtgtccctgaccatgtgtaagctcacctcagggaagtatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctgttgcgcaagaaagaagtcactgttacagaggcaagcggtgaactaggtaagagttcactcatgaagaaacgagtgctctgaagagccagttaccctgtgttggctgcaataaaggtcattacctctctagccaagag

SEQ ID NO: 234114 - DNA, 1159 bp, Homo sapiens
cagttgacacctgggtcaggtgctctattaaagagtcattaaaatcatgtggccagggaacaaatacagtcttcgaatgtgacgattcaagcttcctcattgctgaacatgtttaggcaggtacaggcatccttaggtgtccacgtatttgggacatgtaagtggagaggcatgaacctgattcatttcctgatccagtgatgctcccagcccacccccaaacagacacagcgtagcccgggccagctcttaaggagttcaggagtgagaagaggccctcagagatctgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctggtgagctgagctctagagggatggcttttcatctttttgttgctgttttcccagatgcttatccccaagaaacagcaagctcaggtctgtgggttccctggtctatgccattgcacatgtctcccctgccccctggcattagggcagcatgacaaggagaggaaataaatggaaagggggcatatgggatttgtggacacagctgtttctgttcctgaactagaagtcttccccagctctgacgtggcagtgaggtgacctgaaggaaagaaaaatataaataaataccacttcatatttgtatagaatcctctaatcccttgtgacatagacttgacagggattgtatgccttctttatggatgaggaaattaaggttttagaaagcttaatgaattaaagagcttgtctaattagttagtagcagaacctggacttgaacctaggtctccttgctctaaatacagtgtaccttctactctaccagttgcgcaagaaagaagtcactgttacagaggcaagcggtgaactaggtaagagttcactcatgaagaaacgagtgctctgaagagccagttaccctgtgttggctgcaataaaggtcattacctctctagccaagag

SEQ ID NO: 234115 - DNA, 472 bp, Homo sapiens
caaatagaagagaaacagaagatagaaaaccggttacatttcagatgaaaaaagggcgaagacctatctcaccgtgaaaagctgaccgaggcacaccctgtagggtggtaaacggttgcctaccccagaaagacctcagaaggtcgtatgtttatttaacaaacattacgtagcactcatgggccaggtgcttcacagacatgacctcattcgatcctcagaacccccccgagagaggtaccactgctgtctccagctcgcagtcggtgggacacagaaagatgcccacactctactgctgactagcgggaaaactaggacttaaaaaatatgagcactggctagttaaggagacaggggggtcccagatggggaacagggctcctctctatgcctctatattgcttatgacaacacatttatcatttaatgggctgggtgtgggggctcacgcccgaaatcccagcacttt

SEQ ID NO: 234116 - DNA, 180 bp, Homo sapiens
caagaaggaaaaggctgtggctgcagctgctgcagctgctgtgacccctgcagccattgcagctgccacaaccacattagcacaggaagagccagtggcagcgccagagccgaagaaggaggtggaaagaaaaagaagaaaaagaaggacaagaaacacaaaaaggataagaagcacaag

SEQ ID NO: 234117 - DNA, 539 bp, Homo sapiens
  misc_feature (61)..(61): n is a, c, g, or t
atctcttcaaatattttacagagtttgactctttgtagacaaggtaaaaaattggtatctntgagtcttcaattctaccttgaatgcactaagccacgttaaaccataccactaagctttaaaaaaaaaaaatccttcaagcccttttctctcttctaaatatttcttttaatttaagagggaaatggtccctttcccagatattagttatagtgctttaaaatgaaaagaaacttatgagccaccgcgcctggctaaaccaatgtatatcttaacatgtatttgattgatgtctcatatcacccttaaatgtataaaactatgctgtgcctcgaccaccttggccacatgttctctgagagctctctcaccatgggccatggtcactcatatttggctcagaataaatctcttcaaatattttacagagtttgactctttgtagacaaggtaaaaaattggtatctttgagtcttcaattctaccttgaatgcactaagccacgttaaaccataccactaagctttaaaaaaaaaaaa

SEQ ID NO: 234118 - DNA, 660 bp, Homo sapiens
  misc_feature (26)..(26): n is a, c, g, or t
  misc_feature (28)..(28): n is a, c, g, or t
  misc_feature (45)..(45): n is a, c, g, or t
  misc_feature (48)..(48): n is a, c, g, or t
  misc_feature (54)..(54): n is a, c, g, or t
  misc_feature (62)..(62): n is a, c, g, or t
cttcagggtaatatctcacaggtagnanatggggagaaatggtantgnaggtancagcttgnacgtgggagatgttgggggagaccaggtacgtgtactaggttggtttctggcagcattaggagaaatctcagactagcggggcatgttgcccagagcatgtgcttctaagaagttcctcatgaatgaggtggggaggcttttattcctctcgccacaacactgagggataacaactcttttcagaaaatgagattttaaaaatctaagcctagctttttaggcaaactgtataggcaagatcgtctttaaacccttttgtggaatttttttttttttttgaattgcttccccaaatctgatgttgctcatagtgtcaccaacccagggccacattcatatgaaatatttgcctggccgctcaggctgtgccatcttgagtgatgtgttcctctctccccacaccctggttctgcttaacttccaggttccagtttaggtcttgctttttccagaaacttttcatgatcccttctgtcctctttgctgtctgtcatgtctgaaattcttcagcttttatagtctacagcaattaattattaatatatcatgtcttttaaatatttacttgttgattggtgacgtaaagctttatgggtt

SEQ ID NO: 234119 - DNA, 364 bp, Homo sapiens
tgtatttttagtagacacagggtttctccatgttagtcaggctggtctcgaactcgcgacctcaggtgatctgcccaccctggcctcccaaagtgctgggattataggcgtgagccaccgtgcccggcctcatgtgttgtttttttttttttttttttgaattgcttccccaaatctgatgttgctcatagtgtcaccaacccagggccacattcatatgaaatatttgcctggccgctcaggctgtgccatcttgagtgatgtgttcctctctccccacaccctggttctgcttaacttccaggttccagtttaggtcttgctttttccagaaacttttcatgatcccttctgtcctctttgc

SEQ ID NO: 234120 - DNA, 387 bp, Homo sapiens
tataaaaactgattttcccccaaattagaaatatgtaactagaaatgattcaaagctgatcctcctaggtaccaaaacacaatatcctgaaaaataagcttacaccttgaaatatcatacataataagaccacttaaaacacacatttatataaactataattattattttacatattatataatattatataaatacatattactatatatgtaattattattgaattttcacaatttagaaaaatgtaccactagactggatagagagggactaattgaaccatggtaactggtatgaaaataatgatgatacaatttttagagatattaccttttctttttttcttaggaagcatggtcatgcacggtgcttattttgaaagga

SEQ ID NO: 234121 - DNA, 350 bp, Homo sapiens
gcaaacatttatattaactgttaagactgaactatatacagctacactggcaaggctaaataaaaggagggagggagagagggagaggagaaaatagcctcagaattctttccagaagcagctctttgtccctgtttgggactgaatctcagtgatcctccctctgggacctggagattggagaagggggcggagggcaggtacagcctccaagcacctgggctctgcatctgagcctctggatggagagcattcatctctgattgctgtgtgatttgattgtctattatacacatgtcctgtctttgctaaaaatcatcttcctcacagaggaaaactgtcaaaattgt

SEQ ID NO: 234122 - DNA, 225 bp, Homo sapiens
gataacagtatatttataaaatattgatgcattatttagctccagctcattttagtttttcatctcccagtacacaaatcattcccaacttgtctctccacatctgagttcctagttaatttcttccattgccttgtatttttccactgccttctctgtggtttcttctcatgcctaccctctttacctctgatttgttttcagtgttgattctggtccttctaa

SEQ ID NO: 234123 - DNA, 1780 bp, Homo sapiens
aattatgtttattgcagccaaccatgttctactggtacagatagtcccactggcacagattatctctattgtatgggtgaaggcaattgaggtttgacaagttgactcagcaaatgagtggcagtatctgggctttttcctcctgtctgacccagagtaattttttaactttccctggagtcctgataaaaaacgcagattcctctacttcactcccaaagattccatttaggaactgaggtggagtcccaggaatctccattctaagcaagcaacacagatcgttctgatgtgagggcttcttgaaccccatttgaagactcatggtcccatgtcatccaacccctcaatcaagttcatttctttccaaagcctattctttctcccaccatcttgggctgacatcaccatagcatccacacatccactcctatccctcatcccagacacaggtgtgcctcaatataaaagcagaaggtcctggttctctgggatctgcggttcaaaagtacgatcactcaggaagatcggagggtgggggcactgtctcctcttccctcctcttgggaagtatttgtcaaaatggtcatcctgggtggtcacagattgacacaatcagctttacttattcaaccaaccagcccactcattacttgggtgtcaactccctggaaaacagtgaagtgaaatgttcatgagtctttgtttgtgggaaaggggaggggaggaatgggggaaaattgtgcacacgttcatttttatttcaaaagaaacccacatggtttgttgtcattcagctctttggctttgcctgagagacacagaatccaaatgtaatattgtagaaagctgtgaaaccaaagttttgaatttttctcaagaatttcatttttaataataaaaaatcaccaagcccatgtgtcccataaaaataaatgaacgttttcactcatgaaccaataaagcagatgaaagttggaagccacataatactttctgtgtagctcatccaggccatgcaaggccttggagaagaattattttatgttttgcagatgggggaaactgagggagcaccaggtccatgtgcctgggaaagtaacctgccagctgctctaatttggaagagcagctctttggagggttggagaaaagcccggaccctgtagcatggcatgttccagccaagccaggatgtccagctgcatttctggaggggaccttcttgcccctgaggacctgtggttcttcagagggtcatgttgcttcatgccttgtccctgctgccctttcttatggaaatattctcctgctgttttccagatagcacatacccacttgtccctcactcatcacgagaagctgtgggtcctcccacgtggctgcattctctggccctgccacagcactttaacacccactgacatttacggccaccccaccatccccccaccaaacacacacagagtctgttgaaggatcctgcttaatttatcttaggttcccaggaccggtcacatggtcaggcacataatacatgctcattaagtgcttgttgaaaggataggtgaataaacccatgcaggcatggggtaatgtaagaaaaaagatgacaccttcaacctcttgttgttctctaaaagaagctggagggaggaagcccattcaagtttctggccagccttttcccaggggctgtgtctcctcacttggtttcaggaatgtaaacactgaaagtatagttcagattcctttcactggtaaataacttcttccactc

SEQ ID NO: 234124 - DNA, 582 bp, Homo sapiens
ttgtaaaaaactttgtgtataaaatatatcacacactaaaattaaaacttaaaatcacatggaaaacatattttcaactaacttaagaaacagtaacttaggattagtacacctaatgtaaaaaaaattccttcaaattagtaagaaaaacacagacaccctaatgagaaaataagctaaggatacaaataacacagacaccctaatgaaaaaataagttaaggacacaaatagacaattgacaaaagatagagtaaaatttgccaggaaacatatatattctacttcactaatagctaaataaaagttactatttttatctatcaagttggcaaatttaacgaaatggtaatattgaatggttgtgagtgtagtaacacaggctccttaatacattagtggtgggtatttatgagattgaaatgtataagatttataggggagggggctggacatttttaaatcaaggtcttcaacaacattcacacaatttaacccagtgatcccactccttggactctagctaaagaaatatagaacaagatttatgtataagaaaatcaacacagtgttaattatttt

SEQ ID NO: 234125 - DNA, 1002 bp, Homo sapiens
taaatgcatctgcattactggactggcagagaaatattactgtcatcaacttcctatagatacttggaaataaccttattgtatggtactagaggctgtgttaatgtttgttaaaaaggattataccagtctagaatcaaagcatatgtgttatctcattgatctgttatacttatttgcagtaacactgttctgaagctgcgtccaattagaggttgtccttcattgatagagggctagtatttgtagtcaaatcgctaaactttcaaaattattctaatagaatctattgtggatttttaaagatcaaactacctttttgcttccttatacagtatgtatttaaccaagtatgtatccactagggtgatagggggtgggacaggcaaggacactgaaatttatatcagatagccttcctaccagttaactactgtggtataaagtttggaggaagaatggataaaacacatgtgaacataagttttttttaaaccactaaaatgactttccccttaaattatgagatgtacttttatagtaataatagtcttgattacatttttattttttaaaaataatgtatattttatagttcaaagctgtttaaatttcctattcttggtggctgttttctttaaattcagtgaattcctatatttaaaaggatagatgttttatttatgtcagatttatgaatgtggcccagcaggatggctcaatgcctgtaaatcctagcactttaggaggctggatcacttgagctcaggagttggagaccagcctggataacatagccagaccttgtccctactaaaaattttaaaaattagccaggtatgatggcacatacccatattcctcccaaagtgctaggattataggcatgagccactgctcccgaccctactaatcaatttaataaatactgtgccagttaatttgaggacttacataaaaatggacaagctcctaggaaaagataacttaccaagatgatgt

SEQ ID NO: 234126 - DNA, 714 bp, Homo sapiens
ctctctttctaattttaccagctgttctcagtaatacctgctttgggtaattacttgaactttttgtcatctcagttggtaggatccttttcagcaagtgatacatgtttgttttcctaacactaatctttgcatttagatcacttattgtcatgcaaagattgtcttttaaaaattaaccttttaagagaaacattttttctatcctgtagcagcatttttcatgtttctttgacctcgtgaatcctttagaaaagtcaattctaatcaataggctaagtttcaagtttttttaaaaaaattttcattgcacaggtaaatgagaatttttaagaatctgttaacctgctttgtagaacttaactatttcgataaatacttgattgggtgtgttggctcacacctgtaatcctaacactttgtaatcctaacactttagcaagagcatcacttcagcccaggagttcgaggctgcagtgagctgctgtggttgtgccactgccctccagcttttgtgacagagtgagagcttgtctcttaaaaaaaaaaaaaaaaaaaaaaggaaaaaatatagatgaatacttgaggaaaattaagcgttaggcatactatatatctgaaaccgattttattgacagatactgcaaatgaagtaggaaaatgcagtttgctttctgatgagagctgtcctagatatatttggcttaagagcat

SEQ ID NO: 234127 - DNA, 141 bp, Homo sapiens
gcgcagcactttcatcaccaaagcaatggattttaaaaagactgtattaattagatgcaaatggctgcaagggaaacagaaccttttagtttttgagaaccagagtttaaatctgatatattgtagggtatgatatggaaa

SEQ ID NO: 234128 - DNA, 578 bp, Homo sapiens
gtgtgttccaccaggaggcaaaggtttctgttcaaatcttcctgttcacttgatttaggtgtttgataagtgactgcttgagtagtttcctcctgtgttttgttcatctgaacaatgcattgacttgccctatgtaggaaggctggagagctgcttatgaattgtagtaagatgtcttatggcttccagggagcaaacctagggagttcccaggtactgattttttttttttttaatattaattcttgttctgttgtccaggccagagtgcagtggtatgatctctgctcactgcaacctctgcctcccggattcaagcaattctccagcttgagattacaggtgtgcatcaccatgctaggtattgattgattaattgattgattgattgattgtggtgcctccatggactagactctgcctcccactttacttgtagcctaaatgtaggtgacaggtgaatgtagggttgccagatttagcaaagagaactatggggcatccagttaaatttcaatttcagataaatagcagatattttttcgtattaagtatgctctgtattttatctggcatcc

SEQ ID NO: 234129 - DNA, 485 bp, Homo sapiens
gcccatcttcgtgcatactctctctttggtcactgctgtgcggcatggtgagcttggcacctggccttcagaatgcagccacagaagggagttcatgggctaggcattctgctaagggacacagctgtctctggctcctgcatccaattactggactctctgcttcattgctctggtggagctgccagcctgagtctccacatgttctttcaacactcccttggtggccagcccagtgtgcttttaatcattgacaagcaagaggatgccacagagaaggatgttggctgctgttcaggcatttggggactggcagggagggctgctgtccacgacggaggatgccacaagtggattcaagactgagttttttgtttttctatccatcaactcaagcatttgttattttgtttgtgttacacatagtccaattatactcttttagctatttttaaatgtacaataaatttttattgattctagtc

SEQ ID NO: 234130 - DNA, 324 bp, Homo sapiens
cttggtatctcaggggtggcagaggcagaagaaaatttttgtataagtgggcccatggagttcaaatccatgttgttcaagggtcagccatgtgaagaaccatttaaaactagctgtaaacctttttgggtaaatggttatttgtagcaagggcttgtggaattttgaagggtgcattcttatttatataatagctttattgagatagtttacatactataaatttggccttttaaactatataagtggatttttatatattcagagttgtataaccatcataactacctaattttagagtatctcaacacccccaaaagaaac

SEQ ID NO: 234131 - DNA, 507 bp, Homo sapiens
gctctgatacacattttatatttttaaatattccgtttttatctcatgtttgagctgtttttattaaaattcaagtttttattaacttctattactcaaaaaatccaaatggagaatcttcaccttgggttatattttcccccaggattgaatatttatctgtatttgtgtgctacattcttttattgctgctgttttctaattccaaaatgtttgggtagatgccacatctttgttttttccctctcttattcatgcttattaggcagacacagcttttcctagacctcagcctgtacaagtgtcacaggtgaattctcgctggctcttttccctccgtatctgagcgttgtctgcttcgccaggagctgcagttccagggcggagtactgccttctctcagctttcctatagctgaaccggaaaggagaggggctcagacaaggctgtgtgtggctctgcttgacaggtagcctctgctctcctgtggctttcctgagtgtccta

SEQ ID NO: 234132 - DNA, 452 bp, Homo sapiens
atgttcctttaagaaatgtctcacgatcaagtaagaatgggagatgctggggtgtacacattttgccttccttctcctttcccctccgttgagctgataatagcagaagagtctttatatacagttgcttagtgtgggtgaaactagataaatccatcacaggccctcccttagaatatggaattgggactaagagaccccaacctcgaaagtctcttggacctgggatcccttgggcagactggttccatcctgtaagacagggaacctgtagagaaagagtggagttgagagagaaaaggagagtgctgacaatgtctctctttcacatgtttctgtgcctggctggctgcctctacccttggagtctgagccgcattcctggatccttatggtaaattctgcttctttgcttaagctagataaagtgaatttctgttacaaccaagagt

SEQ ID NO: 234133 - DNA, 349 bp, Homo sapiens
gtttctgaatatatgctggaactgcaaagagaaatacagatgctctttaattcatgatgaggttatgtctcaataaacccacctggttaaaatatgtcagaaatgagtttaattcacctaacctactgaacatcgtagcttagcctagcctatcttaaatgtgctcacaacacttacattatcatatggttgatgaacaaaatcatctaacacaaagcctattttataataaagtgttgaatgtctcgtgtaatttatcgaatactgaaaagtggccgaatgcttgtatggatacttgatgtatggtttctactaaatgtgtatctcttttgctccatcatgtccaaaa

SEQ ID NO: 234134 - DNA, 208 bp, Homo sapiens
acaacccttggacagcattcaataacccacctcttgccaaccccatctcatcccaacctttcagagggcctggagtctgattccggagcctctcgggtggatcctcaaggtcttctgcctgcacctctgactgcagacactcggtagccagcttccttccctctgctaagtcaccgcccacccatggctgtgtctgctttcctcttca

SEQ ID NO: 234135 - DNA, 360 bp, Homo sapiens
tgccattcctcagccttggagtaagagatcacttcacctggggcatgtttgacttgctgccccagggctaccttggcactcatccgtgaaagtacctgatattctgtttcatggtttatcctacccctcacctgttagagacccctcaacttctgtcagccttttgtgtgttagggagtgtatctccagcccagttgagaaattatgttgtgaaatatatagtctcagcaccattgccactggaggtggcaattctggaaggcagtctataactcagagttttatctagtcatacttgatctcacctcttagaaaacaggatttctggagagtcgacatgatactagcaaaggtaggcct

SEQ ID NO: 234136 - DNA, 283 bp, Homo sapiens
cattgaattctaatttcataggtagatcagtgactcagagagtctagagaaaaaagactgctcttagaagcaaaaagaaaaaaaaggcatgttaattaatgttaactcttacagacatttcaaaactactcattacttatggaatcaaatagtggaaaagtcttaaaacactaagggaaggttttctgtgaaagtccttaagtttcaatactagttggctgaataaactaatcctcccattgggaacaaactagaaaagctgaaccagatatatatatatata

SEQ ID NO: 234137 - DNA, 282 bp, Homo sapiens
agaagtgacacacccagcatcaggtcctggaacacttgtctccaaaggctatgtacttagccctatttgctttaactggagtattagtgggcattacaaaaattgatgcatatgtacaaaggatggtaattttgtccagtatgtttttgttaatacttttccaacttgagttaattttaagattttctgttgtacagaattctttaaaagtttatagtaaaatctatttatcttcaatttcctattcatcttaaaattaaatgtcacctatattttcttcta

SEQ ID NO: 234138 - DNA, 496 bp, Homo sapiens
cgttagggcatgagctgctgaatgattcatgtgaacaccatgcacatgggagtgaggttttgagcagtgtgccacaggagcctaccctcaggccccaccataaaatgtagggccagtcctacattttatcaatgacttgcgtgaacacagaaaatgtggatacaaccaaaaggtaacaatccaattaaaaaatggacaaaaaacttgaataaacatttctcaaaagaagatatacaaatgatcaaaaagcatatgaaaaaatgctcaacatcgctaattgtaagagaaatgcaaatcaaaactataatgagataccaccttatattgattaggaagactgctataaaaatagtaaacaaacaaacaaacaaagtaagtcttggggaggatgcagagaaattaaaatttttgtgcattgttagtgggaatgtaaaatggtgcagctgttacgggaaatggtatgacagttcctcaaaaaataaaatgtagaaacagc

SEQ ID NO: 234139 - DNA, 451 bp, Homo sapiens
cactctcatacagagaaatacattttaaatgactaccatagtgcttggtacagagtatatgctattatgattgagaatgaggtagagtgctgaagtttaactagataaattaagtaattagtggcttaccattagagaattcattgttgcagaatgttgggaaggttgaggaaggccatgtttaattgtaaggtatgcataaccttccttacgctggctgaataaaaattccaataccttttttgatgtgccacactgttccaaggcttctctgggacttggggtgcatttcatcttgaactatgaattgcagagatttttatcgtcttctgtcacatacacagcatccttttattgtggtttttgatgcgttaaatatgtttttatggccccctatgtctattgtgcctagcatactgttggtacttaataaacgttaaataataataat

SEQ ID NO: 234140 - DNA, 343 bp, Homo sapiens
gaaatcctaaatgaaacccattctgatgggttagttcttaagggcactcccagctgggagatgtgaaggccgtcaggggctgacttcagctgttggtccaagtctacgggcgcgtcctgtggactggccgtcagccgtgtgaatgcaggcctcccgcagccgcccagttccacttagcctcagcattagtgacttcattttctttcacatttcccccttttgaccaagttcttcctccagaaagtgtcacagatcagttggtgaatgtgatgatgtcccttgttgctgggagggacttgtcccagggagtcatgtccctcgttggggacgtgacctcagtcaa

SEQ ID NO: 234141 - DNA, 627 bp, Homo sapiens
aactcctgggctcaagcagtcctcccaccttggcctcccatagtgctgggattacaggcatgagccactgtgcctagccagaaattggcttaaaatgcagatttttggaccctgtccccagcaaaaagattcggtagaaatctttattcgtagccagtttactgtgttgcaggtggtccccagtttaactttgagtaatgctgtcttcattgttaaaataatcagatttaattatatggtagatattttaggtaactagggtatttcaagctgtcccatggggctgagtagctggcagctgcttgacttggcttctagaggacttactgctcagcaaggtaaatgttattaataccttcattgctctctgtgtcccaaaggtcaatacccaaactttgagattttgtagactggaggaatctttgtctcccactccttccccaagaaagacataggttgctaatttttattttgtcgaatgaggacattaaaaataagttaaccgtgagccaggcacagtggcttaggcctttcatcccagcacattgagaggctaaagcaggaagatcacttgaggccaggagttcaagaccagcctgtgcaaaatagcaagacctcatctctact

SEQ ID NO: 234142 - DNA, 435 bp, Homo sapiens
accacaggggtcacacaccctccgttaggaccaccagcaaggcagggccaccgtcccacactgttcttgcagagacggagactggggatcaggagcctggccctactctggcctgcagccttgggggctgctggggctgtggagggcctctggggtgctggcttggactgggggagccattgaaggtccatggggaccgggactccttcagcagcgtttgttttttagctgactcaaaactgctccccttggaggccttggcccaggatggggaagcctcagccgggcaggtccctcggccttgcccacctctcatgggcctcacgctcaggaggtggcatcctgctggccacaccatggcattagccccgtgcctcacccacacttggtggcaataacaggagccacagccccaaccagagccggcggccgcgt

SEQ ID NO: 234143 - DNA, 512 bp, Homo sapiens
tatgcagtctctaatgaaaattggttcttggtggggtaggggatgaaaaactattaaatactactatggtttggaaccccccatagggccacagtacatagatagtatatctgtgttattaaaattcatggggatgaggaaagcaatctaaaatgtcccagggccgggtgcagtggctcatacctgtaatcccaacacactggaagctgaggcaggaggattgcttgaggccaggagttcaggaccagcctgagcaacacagacctcgtctctacacacacgcatgtgcacacaacagacacagtggtgcatacctgtagtgcacgcatgcacacacacgtgcgcacagtggtgtacacctgtagccccagctattcaggaggcttaggtggaggattgcttgaggccaggaggttgaggctgcagtgagccatgatcgcaccactgtactccaggagcctgggtgacagagcaagaccctggggtctcaaagaaaaacgctgtctcaaact

SEQ ID NO: 234144 - DNA, 412 bp, Homo sapiens
attttttcaactaaattgattatattaaagtttgcatgacatagatgaaataaacttgtatatttataatatgtaatttactaatttagacataaataatactttaaaagcatactataagtaataatttttagaagtattgctcttttcccactcttaaatttcatgagggagttttggtccaattcccccttccatgcattcttgagttcataatggtggcacctcttcaggcagctggcctgttttcactacctgtcatctggaatcgagtttaagtagcttggggtgcaggactttgtgaaactgtgtatgatggaaatcttttccccaactacaaaaaaagaaaaaaaaacccacttactacttatctccagtaaccacttaactgttacttttttgagtgatcttt

SEQ ID NO: 234145 - DNA, 579 bp, Homo sapiens
tgactttgagatgatgatctgaggctctgccagtggatttagattgacatacaaatgagatgcaaatgtatgtaaaggagaagggagatttgcaggtcaaagcagatgtggaatcaagtatacccctttagtaagtgctttctctgaaggtgcctgcaatgatatttaggcattggcctgtgagctatgggtgtgtttgcagatgacatgaggatgtgtttggaggtgatgtgggaggttgtagagaagttgcaggtgctttcgcagatgagcctcaggtgtgctgctgagatggggatctctgcaaatatgctggtgatgcatacagatgcgatttcagatcaacgctgtccagtatggtagccaccggacacacatggttatttagtgcttgaaacatggggactgcaaattgagatgtgctgtgagtgtaaaatacacaccaaatattaaaggcttagtatgatgaaaagaacataagacatctcaataatttttagattacttattgaaataataatattttgagcatatcagtattagtaaaaatattactaaaattattttcacctgtttcta

SEQ ID NO: 234146 - DNA, 438 bp, Homo sapiens
agcttgttactcacagctgggcctgggtgttctcctattgaacaaccaaccaccgagcatccacatgatgaggcccctctgttacatgaaagatggagccaaaaatgagaccaccctgccaccatacctgaacacagacccaacgtgaacactgtccaactccccacccctgaaatgcccagacaccccgccctggctgagccaagcctggcttcattaagccctccccagcccacacctgggcctttctaacccctctacacattctcccttgctgcatcaagtgataacccaatctgttcagccttaggggagctctgatggcctgtgcagtgcattgacagagtaaaataactaagcagaatatgtgacttccaaggtagagaaaaaagtattccaaaatgcaggttagacacctaaaaaatgatgaatccaata

SEQ ID NO: 234147 - DNA, 330 bp, Homo sapiens
tgtgtggacgaactagactggaagatgctgaaggacagaccttccagacaatgagctcttcctcaagatccactggcatattgtgctgtgcacactggaggtgcaggagtatccctactgtatactatgttaactgcgagacccaaccttctgctcagaggatgacaacagatggatgcaagttgtcctatgattgccattttggaattgccatttgaagacagcggtgacctgtgggtctggaggaatcactgcagggtgggatatacatatcaaattctgcaagctgggtcagttgtgggggtatctacattgggacacttcacaaag

SEQ ID NO: 234148 - DNA, 410 bp, Homo sapiens
ttctttattctgatttccatttgcttggtagattttcttccatcccttcattttgaacctatggatgtcactgcctgtgagatgggtctcttgaaaagtataccatcgggtcttgttttttatccagcttgccactctgtgccttttacatggggcattggcatggtttggctgtgtccccatccaaatctcatcttgaattgtagttcctataatccccacatgtcatgggagggaccaggtggagataattgaatcatgggtatgatttcctgcattctattcttgtgatagagacagtgatatccagactgtgggaaaccaagtcaaatgatatatgacctcaaatagataaaatgtaagaaaaagaaaaagatggaagggaaaatctgtagattaaaagagactta

SEQ ID NO: 234149 - DNA, 141 bp, Homo sapiens
tgttaaaagacaaactacagaatgttcctgttgatgtaggaatgaattctcataatatgagaagaaaggaataatagattttaaatcagcccaacttggttgtactgcctgcttagtactataaattcagccatggactgt

SEQ ID NO: 234150 - DNA, 681 bp, Homo sapiens
ctgaggtcaggagttcaagaccagcctgtccaacatggcgaaaccccatctctaataaaaaaaaaaaacacaaaatattagccgggcctggtggcgggcccccaggaggcagaggttgcagtgagccaagatctcgccactgcactccagcctgggcgacaagagcgaaactctgattcagaaaaaccaaaaaacaaacaaaaaaaaccccattaattgccagcaccctgaatggagccttgcctgtagatcttctactgtgttcctagatttattagccttttctttaggattatttaagattttcattaaatcattcagaaatgatttagatttctgaaagattaagatttctgaaaaatgttagattggttagactggaagattagtggaattaagccatcatctgtagagtgacattgcataacaggcattgtcttagtgacctttatgtaatttaactacttcatggagcacagttttatagctggtgtggactatgacctctgttaatagaggacgactacaaaaagcatttccaggctaatctgatgatgatgccggaatgtaaattgggtgagctgagattttagtcctttgcgacctaaatagtttgccacaaagcattttagatattaacaacagtttttaaatattaacaacagtagatgctaacagtca

SEQ ID NO: 234151 - DNA, 671 bp, Homo sapiens
ctgaggtcaggagttcaagaccagcctgtccaacatggcgaaaccccatctctaataaaaaaaaaaaacacaaaatattagccgggcctggtggcgggcccctgtaatcccagctactcaggaggctgaggcaggagaatcgcttgaacccaggaggcagaggttgcagtgagccaagatctcgccactgcactccagcctgggcgacaagagcgaaactctgattcagaaaaaccaaaaaacaaacatgtgttcctagatttattagccttttctttaggattatttaagattttcattaaatcattcagaaatgatttagatttctgaaagattaagatttctgaaaaatgttagattggttagactggaagattagtggaattaagccatcatctgtagagtgacattgcataacaggcattgtcttagtgacctttatgtaatttaactacttcatggagcacagttttatagctggtgtggactatgacctctgttaatagaggacgactacaaaaagcatttccaggctaatctgatgatgatgccggaatgtaaattgggtgagctgagattttagtcctttgcgacctaaatagtttgccacaaagcattttagatattaacaacagtttttaaatattaacaacagtagatgctaacagtca

SEQ ID NO: 234152 - DNA, 636 bp, Homo sapiens
agatacagccttaataccattatcacacttaaaaatttaccaataattccttcaattatttaccaataattccttcactggattgtctaataatccagtgaatgttgtcactcacaattattccataaatttttttttataggtgacttgttctaatcatataaagcccacactttgtctcttagatctcttttgaactggaagctcctcctccctctattttttcttgccatatattcagtgaagaaacaggttcatttgccctgtagttgccccacagtccagatttggctgactgtggcctcatggtgtccttccacttgtttctctgtccctggtatttcctgtaaactggtagttacatcaagaggcttgatcaggtcaagctcgatctttttggcaggaacactgcatagatggggctgtgtgtttctctcacgtcatctcaggaggcatctgtctggttgtgtctaagttattatgattgctgggtgtgttcaggcatcaccagcctgatccagtcctgagaaagtcccctgctggcttagctgccactgctgaccattgcacaggtgcatcattccatgaggggttgcaggtcagtgataatattaatttttatcattcctctgcatt

SEQ ID NO: 234153 - DNA, 450 bp, Homo sapiens
atatattatttgcttcttttctctcactgctttcaggatcctgtgtttgtctttgatctttgagagtttcattataatatgtcttagggtgttattatttgggtttaatctggttagcgatctttgacctctttatacctgcatacttatatctttcctcaggtttggaaatttttcttttgtttctttaaaaaagctttctacccctttgtctttctcagttccctttttaactccaataattcaaagatttgctcttttgatgttgtcccaaagatcccataagctttgtttattcctttttattccttttttcctcctctcactgtgtagtctatttatctatctatctgtctgtctatctatctatctatctatcaaactaattaactaactaacatggggtctttgttacccagaggtggagtgcagtggcacaatcatagctca

SEQ ID NO: 234154 - DNA, 330 bp, Homo sapiens
gctgctgcctttggacatcagaactccaggttctctcacgtagaaccgaggcacccatcttctgctgcctttggacatcagaactccagattctcaggcctttgtactctaggatgtgtagcagcaacccctgccccaggttttcaggcctttggcctcagacttcaagctacacctctggcttctctggttctgaggcttttggacttggactgagccatgctgcaggcatccctgggtctccagcttgcatatggcctgttgtaggacttctcagcctccataatcatgtgagccaattcccttaataaatagcctctcacttatcta

SEQ ID NO: 234155 - DNA, 440 bp, Homo sapiens
cgagggagcgtggctcccctcgctgtggttgttggcagcaacggagagatagcagcgcggctggaacgcattcatcaacaacttttgaaacatatacgaaaattatctaaaaatcctcaaaataccaattcagaaggaacatctacaggaacacctgacgaggctgcacccttggcaggaagaacacctgacacggctgaaagcttggtggaaaaaacacctgatgaggctgcacccttagtggagggaacatctgacaaaattcaatgtctggggaaagcaacatctggaaagtttgaacagtcagcagaagaatatgttaggccatgtgtctctataacagctattgaactctgcattgtacagtgaaagcagtcatagataatgtgtgagcaaataggcatgattgcactccaataaaactttgtataaaaaaccat

SEQ ID NO: 234156 - DNA, 216 bp, Homo sapiens
cctcatcagtcacacaagacagaaagccctactttcctcttgaggctggcaacctatccacctagttgctcaagccagaaacctgagagtcgtcctcgtcaccactcactttctcagccccataaccaacccaccgaaataactcttttatctgccttctcatcacctgcactaccagcacctatgtccaagccacaggcctctcacctttcactc

SEQ ID NO: 234157 - DNA, 232 bp, Homo sapiens
ttcctctgaactcaagagaaactagcaatattctgatagttttattggcatttccagtaagaatatttgaaagcctctgtctgaaattacaaagcttaatttttttgttttacaagattcctcaacctctactttttactctatactagtttcaaattggtttataaatagaacttaatgtttaatggctataattttgttattggcaaatattaaagtgttgttagctcta

SEQ ID NO: 234158 - DNA, 325 bp, Homo sapiens
tagtgtattatataataaaagtttagaatagtgagaagaggggaggtttttcttgttgaaattgacttgttccattttgtttcagaatgtggatttgatcttggaaagtatggtactatcttttgaatgataaaagtacattgaatttttctgttccaaattttgtaaagaataattctttagcagaacattctttgttgtaatgattttttttgtcaaattctaattgtaaagtaattggattactttaataaattactagttagtaaatgtaataaatttactttaaataaatttaataaatttatccttagttgcttatgca

SEQ ID NO: 234159 - DNA, 470 bp, Homo sapiens
tactaatctggcttgatttaggattgattttagactaccctaaaggatggatgggaccatgccttctttagccacccttcctggtatggttgttgtgttttgtttttgctttttccccaggattcaggcttttggtgaatatttatagtcagtaaacttaagactgtactctgggaaattcttagcttgtaacttctctgctatacttgagtacagccctattataccctagtaaatcacacaggacataggtttggcattctttagtgaaagctgagggacttgaggagactgtggcctaaaggaaagctgggggacccaatagagacctgaatagaaacccttttgggctccaaagcacatacacttttccatcataccgtgttgccccccaggccccactccccacacctgaaactagtgactgggacctgtaaaactctacaaacattttctcaaaaagaaaaaaa

SEQ ID NO: 234160 - DNA, 478 bp, Homo sapiens
gatgcagtatgtacccttatatctaaaagagaggttagcacaatagtgcacaccaagacatttcaagaggtacttgtgcaaggagaattttaatccattttcatttcctccacttcctcgatactctttccaaaatttgatcttcccatttatatacctgtctcagactggttctcttttcccacctgcccctttcacatatgtccttttttaaaagaaaggcataattttcacccatctttctcagtttcaccattgtcaaggtgggaaaagcaaaacaaacaaacaaaaaacccttccagtctatacaggtcatttgaaaatgtgttgagaaagagactccaataatggctaacccttttttgcaactcactggttttcagttatttgctttcaataaaattaaacaaaagcctaggcaggctgtcagccattaaatcattaaaatttatttcatttttgacgtattactaaaaaa

SEQ ID NO: 234161 - DNA, 483 bp, Homo sapiens
ctgcccgcaaactgtgagatggacaggtcatcttacctttctgcagatcattttgggtttctgtgaaataggcataggagcacctttcaccagagtcctggtgaagctcagatggtggaatgtacttgggagcactttgttcagtggttatcattctaatgacgggaggaattttcacttgttcaaaggctgtctttaaggcagccacaataaaataccttttaatgaaaccctaaaatattgcagaattgagccctttcacaggatgctgaagacagagaagccccacatggaggggagaatgaagttgcagtcatggtgcctcttacacagagaggttaagcaacttgcccaagatcacacagctgacattaattttcagttcaggctttatctcctggattaatcttaaggtctggttttttgtttttgttctttgaataataacctgttttaaaagtcaggattaaaaagaaagaaaca

SEQ ID NO: 234162 - DNA, 454 bp, Homo sapiens
tctcgggatggtgccaggcctccgctggggcagcaacagtccctaaagcttcccaggtgattcccagcaatgggcagccggggctgacaactgtgaccctaggggtcctagagaccatcagaccccacatctggggtctcaaactgtgatgccggaccgtttctccaactggtcccgtatcgcaggtgcctggggggtccttcgaaaattcagcttgccgggctgcctgcccaaaggggttctgtaggtctcgggtgggcccgaacatgtgtatctagttcccaggagacgttggcgcagctggtccagaacctgactttgagaaccgctgtcctgccgctttctgcagtctagcgttcaaaggccagggaaaacttaggcgcttcgagtgctcgggaaacaccatcgccggcacgatgtaatatttatttgcttattttattttatttatgta

SEQ ID NO: 234163 - DNA, 97 bp, Homo sapiens
ctcatcagctacatctgcactttcttttttaccccattcctgttgaatggacagctgcactttaaataacattcaaacccttttgtcaattttctgc

SEQ ID NO: 234164 - DNA, 398 bp, Homo sapiens
gttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcttctttggtctcatggctacttcctgggaggaaaaagtagtaatcagctccctccccccagctaaatgtgcatggtattagcaaattctaacccaagatgttaaaactatctgagaagaggcatgattctgcttcttgtctgtaccctcctaaagtcaaggtgcagcaaggagagagacatttgcatgtggcc

SEQ ID NO: 234165 - DNA, 440 bp, Homo sapiens
ttctctttccatttttatggccaaaaattccaagcctgctggtaggaatgccagtccttatcgatatactggaaaacaactgatgtcagtaaaagtcttcaaatatttttagttttcatcagcaatgttcacttctaagaatttaaaagaagaaaatgataaaaatattgtcacaaacattcatgaacaaaggtgatcatcacagccgttatttataattatgaacacttgcaggaaagcaaaattacagcagtaagggtttggaaatgatttagttgttgagatcataattctccctggcacatcttacactataataagtgaaattgccagttataaaaacgatacacagtcttcaattttgtaaacaccaaatatgtgcagttttgtaaaagacttaagatatgcacctaaatataaatgtttttaatcatacatgt

SEQ ID NO: 234166 - DNA, 140 bp, Homo sapiens
atgcttggactggagccccaaaggcggcacacaccccagttctgagcctgctgctcatttcctctatgtggctccatttgcagcacatttgttgcactgagaagcggctccaagtaagtttgtcttgggccaaattctaa

SEQ ID NO: 234167 - DNA, 308 bp, Homo sapiens
aggaaaaaaatagaagctccttcttacaaaagatctgttttacaaaagaagaaattgtgtgtatagccataagttatattatctatgaattccaggttaagatagcaaagaaggatttataaaatattttttaaaaagagtggaggtgtccagtggagctgaggcctcttgtgcaggacccacattaaatgggagcgatggtccgcacaccatggccagggtccccttcccatctgagggccgggctggagggcgtcagacagaagttagggaagcctctcagtgccagcgagatggggagagcatgc

SEQ ID NO: 234168 - DNA, 447 bp, Homo sapiens
tgtcaacctcttggtcaatatggttcaaactctttactcccccaaagagtaaaacatgatgtcgtctgcaaatccatgtctcatattggctgtcttcctactccaaggcctgtgttatcccaggccttgaccctctgcaatttttgctccctctgaaccctgccggaactcagccatctccctagatatctgatgtaatccttctctctactgattcccacagtatcatcagagatgatctcagtagaatgtagtggcggtggtcgtatgtagacattatttgcctataagtaaatctgttatttctaaattgaggaatgctttgtttgtgtgacttctttacttttcatatcaagtgcactcatcagcaataatgaagcaaaataatttgcatttctggttttctgttcttataattaaaaaaaaccacttttcttccacaaaata

SEQ ID NO: 234169 - DNA, 436 bp, Homo sapiens
  misc_feature (81)..(81): n is a, c, g, or t
ggttgcagtgagccaagattgtgccactgtactcagcccgagtgacagagtgagatcctgtcaaaaaacaaacaaacaaanaacttggcaggcacgatggatcctcctgtctcagcctcccaaagtgctgagattactagcataagccactgtccctggccagcgaagatttcttatgtaagacctgaaaaagcataggctatcaaagcaaaaataggcaattgggattatgtcaagctggaaagcttctccacagcaaagaaaacaatccacaaagggaatagattacccaaagaatggatgaaaatatttgcaaactatcaatctgacaagggattaataaccagagtctataaggagctcaaacaactgtataggaaaaatctagtaatctggttttaaaatgggcatgagacctgattagaaaactcaacag

SEQ ID NO: 234170 - DNA, 354 bp, Homo sapiens
aaagcaaggaaagtataaagggctttcaagtaaagatagtgggtcaaacatgtaagttcactctcaagtctaatgaaaatgatagtgaaggaatttattttaaaagacataaacccacaaggtcatagaaacgtgagtatgcaaaccatcaataaagttttggaggcaggaaagcagatggacaagaggtaatggatttagtgaaactgagaagaatgaatcctaatctggcaagggagaaatctgagaagtaatccaatttaaaccatagaaccacagaatgctcagtaactggcagtgccagaaaactctgaaagtggagtttaagctcgcactaaaaacaatgacctagtt

SEQ ID NO: 234171 - DNA, 484 bp, Homo sapiens
tgtggttcaaatcatatagtttcaaaagaagtgacttttgctgggaaattatttagacagaaacagattgctttgttgatcacctgttttatttctaaagcagccagcatatttaggctcactgtttttggtaagaagaacttatttttctgacttaagccgtgtatcagttgaaacaaagtgctgatcatttaaggttttggtccagggttttggaaattgtaacaatctcttcatcatttgatgtgcaacaggtgttgagaaaactgcatctatatttggatacatgccatttctgttaagtagcgacctctttttctccactccagtgacctaaatagttcctacaaatagagtagctatcactacaggaaatatgttaaatccaggcctccagatacactgcgaatgaattccacaaaacaaatatactgtgtattgaaatgtcgttctagataataaattgagtgtgaagaaagtaatt

SEQ ID NO: 234172 - DNA, 1772 bp, Homo sapiens
caccctaaccaccccccacttgactgtgatgcccctctagatccccccaagacatgggcttttgtctctcatagcacagagcaggaggggcctgtctcctgggagtgctttgagggtggggcctgtatgtgccctctgccctcagggccagccaggacacagcagctggcagggagagcctagagctcacctgatgcgccgctccttctcctttgccctctcggcctgctcgatcttgacctggggcacgtgctccaggttctctagcagctcatccagctggtgctcaatgatggtcagcatctgcacggtgcccaggttggcctcctgctgggtgccggtgcagtgccggtacacatccagcaccttgcagttcaggctctctagcagcttatcctgtggaggaggtggcttccagcagggtgctggcaggcagaaacccacccccatgccagtgccttcagcggtggcctgctgacctcccagggtgggggccaccgcttggcacacagtgggagctctgagaacatgggctaaaacagaacttggggaactggcttttcttggccagagcagcctatcccccgggccccctggagtcagccagatccctggttccagcccctctcccagctgcctctggtgagccaacggggcccagtcccctcctccagggaaccctgcaccctgggcaccccacagggctatgtcttctctgagactgttctgacacttagaaaacagataacagcccctccatgtgggctatatgaggagagaggagcagcaggcaggcagctcagcccagcctgggcacagccagtgcccatggattctggctgtatcgggagcgctgtcttgctcatggctgcatcccacacccttggccctgtgcctggcacacagcaggcacttgacagtaggaagccatcccatgcccggggtggccccaggctgtcaggttgggagcgggctgagcctttgtctgggtcctggcttctgctgctcagaacaccactggctttctcttctctcccaattctctcaccctctcagcctggcttgaggacacgcctcttcccccccttcaggatcaccttgccagacacaatatatgtgtttaagaagcagacacatttgttgaataaaagaatgaagcaatggatgaggcgtgggggcaaccaagctggctggcacaggcatcaatacatgtggtggctcctggagggaggcagggcaagggcagctgcagggcactcacccgggccttgtcctccatcttcccaagggctgtcagggctcctccagtgggtgcccaagggtccctccttaccctgggcctctggccaccttgatccccagcctacctgctgatcgcccttgtactcgccgaagtggaagactcgggctttgagctccagctcagctgctgtgtcctcctccttggtgatggacatcatcattgtggtgacccactgcttcagctggttgacctccctgtccctggaagaggggaaaaccggcagggcatcagtcactcagcacagccctgggcacatcgcttctctgagcctgtctgtacagtgctttgcccctaccagctgtcctgagggctgaaggatcatgggtgccaagtctctgcatgcccagggggtcagaaatgctggtagaatgtaggggaaaatgtaaaatatttaacaatcaacattaaagaaaataaacagcttcattgaggcataattcacagacaataaaattagcataaccatcat

SEQ ID NO: 234173 - DNA, 856 bp, Homo sapiens
tgtacaagagatcattgtcatcctgggtgttctttgtattcttcatactagaaatccataacacgccaaatgcccttagaaccatggacagcacccaggttttacaaatgtcttctccaggcttcagaaggaaggtggtggacattctttccatcatgacacaaaccaacaattacataccaggctttgttggtgagaaagcaaggtggcccacctggagatttatgccgaaacaaccactttacaacacaacccacggagtccttgacgttggcttggtttgtcaatcccaccacctcataccatttagaaacttatcagctatttctagataactgggtgttttagtttcctgtagataaaactgaaggctaaattgaatatatgactaagttatttactatgaggaatcttagtccaggaaaacctctcaaaatacacaaatgtctgagagatgtaatatatttaattaatcccttactccttttatttttattttttattttttcagagacaaggtcttgctttgacacccaggctggagtgcagtagtgcaatcagaggtcattacagcctccaactcctgggcttaagtgatcctcctgcctcatcctcccaagcagctggagctacaagtgtgcaccatcatgcctggcccctttattcctaaacgtttcttcatgaaggaagatacaaatttacatgagcccatgctcttcacatgggtaaggggaaaacagagagaactcacagggcacccacatattgtgctttatcatttgacctaggaacagtcttgaataggcagcttgggtttctactcccagaaaatactttgacatacattaatttattc

SEQ ID NO: 234174 - DNA, 1015 bp, Homo sapiens
  misc_feature (2)..(4): n is a, c, g, or t
  misc_feature (6)..(6): n is a, c, g, or t
  misc_feature (12)..(12): n is a, c, g, or t
  misc_feature (15)..(15): n is a, c, g, or t
  misc_feature (17)..(18): n is a, c, g, or t
  misc_feature (423)..(423): n is a, c, g, or t
annngnggcccnccngnnggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctgaaggcagcccccaacaggggggctccctactcccacccaaccctgcccacactaagcccatagacttggggcctcccccggcacatcacccaggtctgccggacggcagaggtggatcgcggccttccactcctctgtcacgggnccccagctgggcatggggcttcggcaggaaactgaacttgatcttgaggccccagaaaggcagcaactggagcagaagcaagacttcatctcttgctgacagcccaatttgtcaatagcgctttcctcagagccagccttaacctgctgttgagtccattaaaacgtttgcttaaagtttttaccaataattagatcatcagggttgtttagtgtgggatcaagccataacaaaactgcctagcctctcaggggcctagaatttacagaaccttcctcctccctgcagctagtctctcttctttattctgggggctgggaaggatcccaaaacagggaacttggccgaaccctgggctttggatgctaaccactgaagtaccagcacctgtaggatgctgtctttgaagaaactgaggcggacctccaaatgcagccctaaggcagaggtcaacgtggaagaccagcccttctccaagccccactggtctttgcaagctgtacgttgtaggcaatctgagaactggaaagggggactacaaccagaaagttggttaccctgccatgggaataaagtagctgttttccacccc

SEQ ID NO: 234175 - DNA, 443 bp, Homo sapiens
ttattctaactaaaaggtaaattctgtgagggtaagaaagttgtctcttttcttaatgccctgtccctggtacttacaacagcatatgataaaatcaaaaatattgtttgtaaatgaacgacttaagaataaatgtattttcaatttttaaatattaattacagtttaatatgcacttaacaatatgacctagcttctatattttaatctagaacaatataaacctagattcttttggctctggagtagatttttacatttaaatcaattaattaatttcaggttggccttaaataactattttccttttatttcatggatacacattatgtctgtgggctttgtcccatcaataaatagatatcaatttgttccattgcaaggtaataatagttattgatctctggtctccatcttaaataaaaactaaagctagctgctca

SEQ ID NO: 234176 - DNA, 309 bp, Homo sapiens
ctgtggagcataccttttgctgaacacccactttgagtatggccctgaatgtgccagcagcttgcacaactgatgtacccctgagatcaatttgtaataagtggcttcatatcacctgtgtaaggcgagcctgcaacttaaagagatcctggcatgattcctcttgcaaagtagagaatcctttctgaaagtaaatcctgagaataagctctctgctgaaagaaacaatcctcaaatttcagcagcttaacacaatggaagttctatttctcgctcatatgatgattcaatataagtgttctgaggcag

SEQ ID NO: 234177 - DNA, 666 bp, Homo sapiens
  misc_feature (505)..(505): n is a, c, g, or t
  misc_feature (567)..(567): n is a, c, g, or t
  misc_feature (594)..(594): n is a, c, g, or t
  misc_feature (654)..(654): n is a, c, g, or t
  misc_feature (666)..(666): n is a, c, g, or t
tggactaatacactcccccaactagtgggatgactcagatgtgaaaatctgaccaacagaaatatcattattaagtcatagcaattacttatttcatatgttttgggaatacattcaatagttagtgttcaagcaattggttaatatttactgttcttagcatattctcaggcactggtagtagctaattatatgtctctcttctaaattactaggcaattattacctgtaatatctgtaatattcatttgaccaaaagtcttgcattttacatatttttttatttcctcccaagagccaggtattatgctaaatgtttgatgtgtaccattcctaatctccaaaatctcttattggtaggaaatattaccagcactttataaagagacactgagactcatggacactggatgacatatctaaagccacagacctagaaagtaatggagggcttttctaaactgagactctttgactccacagctcagcttgggctacagagcangactccatctccaaaaaaaaaaaagggaccccagacgtcttcagtgccttggataagctganagagtttggaaacacactggaggacangggctcggaacttatcaaccgcattaaacagagtgaacctttttggcgatgccggagttnttttcgactttn

SEQ ID NO: 234178 - DNA, 410 bp, Homo sapiens
atctcaaaaaaagtacattccttaaagtcatcttgaccttagtttatacttgtagttaaattctctcataagaaacaaatctgctgggattacagggcgtagccaccacacccggccagaaatgctttttaaaaacggttccacccgggcgtggtggctcacgcctgtaatccttcaaggcaggtgggtcacctgaggttgggagttcgagaccagcctggccaacatggtgaaaccctgtttctgctaagaatacaaaaattagcccggcgtggtgatgtgtacctgtaatcccagctactcgggaggctgaggcaagagaatcctttgaacctgggaggcggaggttgcagtgagccgagatcacgccattgcactccagcctgggtgacagaacaagattccatctc

SEQ ID NO: 234179 - DNA, 185 bp, Homo sapiens
  misc_feature (3)..(3): n is a, c, g, or t
ggntcactctagagtatcccctcagctcggacaaggcggggtaacgcaagaagcagctacacccgtctggctgctgttttatggaggagttggaatctgcacaggcctctgggtctgggggagaagagtgatccagaccatggggaaggacctcaccccatcacgccgtccaggtaagcctgggt

SEQ ID NO: 234180 - DNA, 166 bp, Homo sapiens
gtacccgactgcatccaacgccgccataaaacagcagctacacccgtctggctgctgttttatggaggagttggaatctgcacaggcctctgggtctgggggagaagagtgatccagaccatggggaaggacctcaccccatcacgccgtccaggtaagcctgggt

SEQ ID NO: 234181 - DNA, 186 bp, Homo sapiens
cctttaaaagtccaatctggggccacattggagaagcagggcatatttatgagtgacagtcatttttacctttagaaaatgtctataagtgcacaggcaccacattcaagacagggaagagctactttgggggacagttgtcattgaaccagcagttacttttgggacactgacttttgctctctg

SEQ ID NO: 234182 - DNA, 357 bp, Homo sapiens
gtctttactttgtactggaatatagttttgtttttgccataaagatttttttccaacagaaataactcaggaagaataaaaaagaaagttaaaaaaagggaaaaaaattgaccacaaaatgtactatgaagcttttaatataaaatgtagaaaagttaggtatgcacctcatgttaatagggatagaccaccttgaatgcaatggagagaatgatgaaatacttggctgggatactggtagccaggacactaagaagcaatgccggagacttacgtgaattcttgatttttgtggcatggataggtggtcatctttatctcacttgttattctcagacatgcattaaggaaggatta

SEQ ID NO: 234183 - DNA, 301 bp, Homo sapiens
  misc_feature (161)..(161): n is a, c, g, or t
tctgcccagtgactgctatggtactttgtcaaggagctctctccgaggatgggagaaaagggttcttgcctggttgttttgcatcacctaccacttttctggccaactgatgattgtagggcattccttttatttagatttcctttatttttttcatgctnctccactcataatcaaagaagattaagtacttgctcaggtgttttagactcttgtctaaggatcttgcccaaggtccctgtattagtctgttttccccctctatatataaagaaatacttgagactgagtaatttataag

SEQ ID NO: 234184 - DNA, 174 bp, Homo sapiens
tgaaacactgcttccacccttcaccatctgtatttatgcagaataaagtccaatatcttcatgaaccctcagaactttctttccgcactggtctgtgtctctctgagcagctttagccacctgcactcccttacacagcctgtttcagcctgtcagaagattccctgttctagg

SEQ ID NO: 234185 - DNA, 357 bp, Homo sapiens
agtgtttcttgacctggggttcttggaaacccatatgggaatttacatatgtatttttgggtgtctgagaattttctttgagaaaatatatattatttcattttggtggcattttcagctatctacattagtgtccctcaaactttattgtgcatgcaaatcactgggttatacagcctgtttggaatcagcaggtcctaggagggcctgaggctctgcacttctttttttttaagacagagtttcactgtattgcctgggctgaagtggaggttgcagtgagctgagactgtgctactgcactccagccggggcaacaagagtgaaactccatctcaaaaaaaaaaattgttttct

SEQ ID NO: 234186 - DNA, 372 bp, Homo sapiens
cctgggcaacagagcgagattccgtcaaaaaaaaaaaagggaaaagaagaagaaagaaagaaataaacagaggccaattatctaaagaaaatatattataaatgaaggaataagtctgtaatatcattcaataacagactatcactcataaaaatccagtaactattcattatttcttctctagttatcatgattaccactttgagagcagagactatggcatagacaccttcctaatccctcccttgaaactcagggacaaagcatctcttactgtgctctgcaaagaacagggtatttgcatgaattattcttttgcagcaattgtggtctgaatgtttttatctctcccaaattcataggttgaaatct

SEQ ID NO: 234187 - DNA, 572 bp, Homo sapiens
catccacaggggttccctgctttagactgtgccgagagccagaggtcttgaattcaagtcccagcctcaccacactgcaagggtgttcttgagcaagtcaggaaggctccccagagtcaggcccttagcctctaaaaatgggaataataatgcctccctcaagagctggtgagacaatggaagctgtttgtaaactgtaaagtaccgtgcctgatttggttattagtgttttattgctgatgtacggtcgaggtccaggccacccgtggtagataaaagtgcatgtgggctggacgaagtggctcacgcctgtaatcccagcactttgggaggccgaggcaggtggatcacctgaggctgggagttcgagaccagcctgaccaacatggagaaaccccgtctctactaaaaatacaaaattagccaggcatggtggcacatgcctataatcccagctactcgggaggctgaggcaggagaatcgcttgaacctgggaggcagaggttgcggtgagccgagatcgcgccactgtcacccagccgagatcgcctgggtgacagagtgagactcc

SEQ ID NO: 234188 - DNA, 158 bp, Homo sapiens
agacagccatatagtggaagactgtctaagcagtcaattttctggaaaagcagatctgtatgtacttacgtggaacaatttccaaggcactgcactgtgttttccatttgccccaacacccagatcaattcccctcccctccctgctctgctctatgc

SEQ ID NO: 234189 - DNA, 431 bp, Homo sapiens
gtcctgacaaagagaagtgagaactctggatgatctcatgttgataattaaatactcagcatagatatatgtcatgtctccttattggcttatatgagttaaaaagttcaattctatcaccagaaagacagcaagtataaatctaccatattcctcaaaacctttggttaatgatattaataatgaccatagggaaaaaaaaggttaaaacaatgcagtggtaaattttcaatgttttaatttcataaatgtaaatcatagagttaattccacagacatgtattgaatatatgtaacactccaagtagaatgttaaatattgtctaatgtaaatgaataagacattactcctcagattacccacagtatgatagcatggacacactgaaaacagtacttttaaaatggtatttgagtaggtagctagtcag

SEQ ID NO: 234190 - DNA, 371 bp, Homo sapiens
atggcggcggcagctgtacagggcgagagaagcggtggtagcggaggctgtagtggggctggtggtgcttccaactgcgggacagggagtggccgtagcggcttgttggataagtggaagatagatgataagcctgtaaaaattgacaagtgggatggatcagctgtgaaaaactctttggatgattctgccaaaaaggtacttctggatacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgt

SEQ ID NO: 234191 - DNA, 474 bp, Homo sapiens
cttattttttatattcttttttcataatttctgaaaaatttaaccctttattttgtgagttactggtttttgtttttccttctgatcttaaatgctctgtgtgtatgaagggtattatgttgtcaagtaagtcacatatatatttttagttgtaggtagcttttttatataaactataaaagtaaaaatatatataaaagtacataaattacaaatgagatttatgatgcatataattgtagtttgttcatttgcattgctatatagtattccatcatgtgaagataccacaatttatatcaccattctgctgttgatgaatattatgatttccttttctgtttcaggcttctatgactaatgctgctatgaacatttttgaatgtgtcttttgataaacatatgtatgtctctatggtatatacctgaaaatggaattacttatagaatatacagatattcagatttactaga

SEQ ID NO: 234192 - DNA, 594 bp, Homo sapiens
aaagaagactggtttgattatgtttctttgtatggttacactctatttacaagaagaatctgaagtgatttacagtaaaaatacataatgacaaataaagacattaagtaatccatgtaagaagggtagagcagaaattattttttaaataattaggcaacagagagagctcctgtctcaaaacaaaaacaacaaacaaacaaaaaagccccaaaatgaaagggtctgggtgtgtattcacaggagcagcaagagagagagatctactaaataatactggtggaaaggaagagttgaaccctagagataagggtgagcaataccagctttaaacaaaacaggaaatgaactggggtgaagattgtttctttggccagacacagtggctcacacctataattccagcattttgggaggctgaagcatgaggactgcttgagcccaggagttcaagaccagcctgggcaacacaaggagacctcgtctctacaaggctgagatgggaggatcatctaagctcaggagattgaggctacagtgaaccatgattgcccaattatactccagcctggacaacagagtgagacactgtct

SEQ ID NO: 234193 - DNA, 352 bp, Homo sapiens
gagtacagttggtgaaccaaggttctaatcactgacatggggtaagtccattcccttttctctactaagtggggcgagtgctggcctgcccaataatgtactggttcttccaagggtagagagccacccagcctatgcctataatttaagatatgctgccagtgaactcagttaatgcagtatgtacattataggtctactttaagaaccacagtggcctgacacggatcacatacatgctggaattacttgattctctgttagctctgtgtctgtgttttccagtgtggttttgtgaccacactgggaaagatccacaaatgtcaatattaaaatgttcactttgacttta

SEQ ID NO: 234194 - DNA, 166 bp, Homo sapiens
caatggctaagaattttccaaaattaattatagatacaagactatagatctaagaatgttacagaacaagtaggataaattccaaaattctacacctaaagctatattcaaactgcacgaaaccaaaacgggaatcttctaagaagacagggaacatttacctgca

SEQ ID NO: 234195 - DNA, 342 bp, Homo sapiens
tcaaaaaaaaaaaaaagaaaaagaaagtggacatggtaagcttttctgggatggccatatggtccttctacatcacttcagcggggccacagggaattgcagaggtgggcccacgactgcagcagctgtggtggaacagcaccccatagcgtgaagaaagcccctgaccacaacattctccagtgagtccacacgcagggaggagcgcaacacccactcacataaagacacacacctggccgggcgcggtggctcacacctgtaatcccagcacttggggaggccaaggcaggtggatcacccgaggtcagggtggccaacatggcaaaactctgcctctac

SEQ ID NO: 234196 - DNA, 379 bp, Homo sapiens
gctggagtgcaatggcacaaggcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttattagctatttttcctctttgtatgttagttcgtctccatttttgttttgttgtggcaatataatcattataccattatatctctt

SEQ ID NO: 234197 - DNA, 476 bp, Homo sapiens
catgcctctctattttaactggctttttgtccctttccttgctcagcagtttttctgcaagtagctgataaatcaggaattcttaaattcttttaaagggtttttcctgaaagataagtttttttagagaagtagagtgggcctagggaataataccaaccttagatgtggaacctctaggggctggtcaaatgtatttggcacacttactctttactatgtcatcaacaagacttggatgtctttcctatttactgcctttgtcgttggagctacgattcacatctgttccagaggtcatggaaactcttcatctctcagcatttctagtgggtatccttggcaggcttaaagcagagtcaggagggtgagagctcagagagaggctaaggtgaaagcactttgtaaacttatagaggatggtattttgtacaaagcctggcacacagcagacattcagtaaaaatgcatagaat

SEQ ID NO: 234198 - DNA, 350 bp, Homo sapiens
ctaaaaaggttttctgtaaatagcatgcaaattagatgcctattaaaaattgtcccttttaatttagttgaattaattctacttttagggagctattgaataattaaataaacttaatatggaaagataactgaaaaatttaaaaattaaacactggaaacaagaatagtaactgtaaaaacaaattaatttactgacaacacccgagtattccttaactaaagccccagggttctggagaacgtggacaagcagctgaggagctgtcagcagaaaactgttatgcctaaaaatgtcagtaaatcttttccctattattaaagaggatgctctatttccctattattaaa

SEQ ID NO: 234199 - DNA, 273 bp, Homo sapiens
agtcaccaccctggccacagaggtgggcctggccttttcccaagcctaggatcaagattcacgcagacaggaaacacttccaataattgcctacacactgggctccccatgttgctctgactacagcccaagagctcaaataggccaaggcctgactatgaagatgagacaactgtctagaaaaaaaagacaacaactcttccgacaggccctgacccctgctctagactgagcacagccactgacaggtgaccttcagaatcctcacccaca

SEQ ID NO: 234200 - DNA, 155 bp, Homo sapiens
gggctgttggctggctcctgtgcaaggcacctgaagaacaggcaccagcctgcttattagttgaggtaactgagctgcttcagctctgagaagcatgtctaggtcacggagccggtgagggctgaggcggcagccgtgaacgccttgctctgaac

SEQ ID NO: 234201 - DNA, 475 bp, Homo sapiens
agattctcttgagcccagcagagcacagaggagatgaggagttcagttcagagcagagggctcagggcatgcagcccagcagagagtgcatgctcccaacttctaaactcacaggtctgaaggactcgcacagaagctccctccccaagtcacagggaagtgtgaggctcctggagctggacagcagcagcagggcagctgctcctccagtgcctatgttgacacatctgaggtgctcttggtaccaacctgaattcgagaactggaaagcaggagggttgggtcctagtccagttctgccatagctaactagctgtctggttttcttcaagtcactttgtttttctgaggctcgactgactttactggcttactcataaaatgtagcttaaaaataataaatgctatccttttgaacaccaatattctgttacctgaaatataaattcttctgaattaatcagtggctcaaaag

SEQ ID NO: 234202 - DNA, 319 bp, Homo sapiens
acctgcatgaatttatcctcacatttcctaggcttctaattgtttctatccaagtttgaaaaccagatacttttatcaagggaattatggacaaaaaaaaaaaaaaaagaagaaggttaccaaatctgtatttgtgggcagttaagaaattctattaagactgaattttgaaattagggtacaagtaatactacatctagggaagacttcaactttgcctacaattttacagcaaattacctatacaggattaaagcactgtgctgggaacggaacatcaatatatagaagatgagctccacggacatcactggcattg

SEQ ID NO: 234203 - DNA, 470 bp, Homo sapiens
cagtgacagccctgttccactgtaatgtggcagcatcttctttttgagttagaccttaaagatttaggtgtgctatagtcacatttaactgttcatttaaattttagtgctgccagagttgcaaaggaagaaaaatttgttagtttcttagatgaaaatggatggttttgactgggtacggtggcccacgcctgtaatctctgcactttgggaggcccaggcagggggatcacctgaggtcaggagtttgagaccagcctggctaacatgataaaatgtttagctctactaaaaatacaaaaaattagctgggagtggtggcacacgcctataatcctagctactcaggaggctgaggcaggagaatagcttcaacccgggaggcggaggctgcagtgaactgagattgcgccactgcactccagcctggtcaacaagagcatcaactccgtcacatacacaaaaaaaga

SEQ ID NO: 234204 - DNA, 468 bp, Homo sapiens
ctggctaagctctgttaggccttaggaagcttaatagagcttctctaattttgtagaagaagggcctttgactttttccctctctgcttcaggatgatctcatctgctactttggaagcatgagactttatttgttttgatggtactgaggttaggggtgagattgatttatttgtaattagtcctttctcctccttatccttccttttggataaaggtaaaaatataaaatcctcctgcctgctaaagtactgtttggccatcagagaaagggagcttcaggtagggcattccgcagtccctgtccccatcttagcaagttgaagatgctagtcaaaatttctctgggggcaggagagggcagaggatacttacgtatggattctggggttggtctttcagtttcaactaactcattctgtacctgaatgatactatttaataaaatttcgtggtatgagtttgaga

SEQ ID NO: 234205 - DNA, 560 bp, Homo sapiens
ggatttagaatagtccataaatttgagggttcgagaagattgactccaatgttggaagaagttctgctgtgggtaaaatgctatcagacagcatttcatactacagagaaacctggcatgaaaggaagagtcaatcaatgtgacaaacttcattgttgtcttattttaagaaattgcagccaggcatggcgactcatgcctgtaatctcagcctcccgagtagctgggattacaggcacctgccaccacgcccagctaatttttgtatttttagtagagacgggatttcaccatgttggccaggctggtctcgaactcctgacctcaagttatccgcctgccttggcctcccaaagtgttgggattataggcgtgagccaccgcacccagccctcatgtgaactattttaacagtgtcaactgttaaaataaaatgcatcttgtgtgatatacccgctgtctctgagctctgtgttgagtgctctgtgggtgcggcaggacacctgggccagtgcagcacgtccccgcaagctccccagcctacactccgctgcctaggt

SEQ ID NO: 234206 - DNA, 683 bp, Homo sapiens
cctgaagcacccgctttcctcacagacagcaaggggcagctctggaccctctccgtgggtgggcaagaagctaaggggctgtgagagcccagggaggcctctgcttctgaatcttgcagagcttggagaacgcagcaaattccagcgggagcctgtgtgcacaggtgaggaagctgagctggtgcggagcagtcacacagccacagccacagccgacgttccgaccccgcagcccttgcccttacatccccgagcgtcgggggctaggccggagacgtttgccccatcatcggaggaccggcccctccgcccatgcggcccacggcctgccagcctccgctggcgctttctgggtgctggccccacagaaggggtgggaggtgcggagtcggggcaccagcgcgcagcccgagatttcccagtttgctttcgctcaggaagtcatcagacaaacactcccatctcccaggcctagttcccactccttgctacattcacagccggagactgtaatggacttcacaggctcgcactgagcactcaggggcgcagagagcggcatttcccgagcatcttagaggccaggctctgtgcttggcgccaggacgagctgcacttccaaatccaaaccctgcttgctgcacgcgcccaaagccgcccaggctggcagcagctccgggcaa

SEQ ID NO: 234207 - DNA, 449 bp, Homo sapiens
atcccattactagctgttaccatttattgagtacctactgtatgccaagcgctgtagtaagtgctttatatatggcatcttattaatacacataagaaccctatgaatgtgctgggtggtattgttcccatttgataaggaaaagggacaaacagtgctgacttgtgactctccaaatccttctctttccccaggaattttgggtttgcttgttcaggttctggaaggtttttatactactgctaaggatgagtgaagaggtaaatttaaataatccaaaacaggctgaaatgatccacatgataaagagataatttagaggttagtggggccatgaggaagaaagggaaaagtacttgggagaggcaagggaagtatagttgtggaggtagaagagagagaaagaggttctttgtttgtgtgtttgtttttgtttcagtttttgttca

SEQ ID NO: 234208 - DNA, 272 bp, Homo sapiens
ggggcagcaggctatagttgattcctctgctctgggaaaagtataaaatatacaaaatactttacaattagacagaggtacaattgtcttccataactgaaaagtgaaaaaaagagaaacaagaaagtctgagtggatgttgagttaaaggaaaagaacttgaaaacccaggttattttagatcccaggtttgacaaaaggagagtaaaagttccgtgtgacattatgttacatcttttttcttcaccatcaactaggctagaggggcttga

SEQ ID NO: 234209 - DNA, 887 bp, Homo sapiens
tagacgtacacggtacggacgggtgactggtggctactgactggtggggatgatgaggctattgttttttgtgaattcttcgctaatggcccattatgcgcaaaaagccggttagcgggggcaggcctcctagggaaggaaggaaggaaggaaggaaggaaggaaggagaaaaagggaaggtaaaaaggaacaaagaaagaaggaaaaaaattgttttataaaataacacatttttctcaattacaagaacgtatactattacttttatgactagatttgtgtctagaactaggtaaggttattactgctttgtttttaaacctgacatctgggaaaccccatgtgctgtcactgttgcatgcagtctttccagctccaggccaacattgttaatatttggattttatgaatctttagcacttgcaagtgtttaatagtcactctcattctttggaggctgttgtttttttttcagttaaaaaagtattatatgcttactgcagataattagagaaaaagaaaagaattttttaaattaccatgtaaatggcgatttaaaatatataaacatatgtatttttaatctttaaattcatatatgtatatacatatgtgttttagactccttacaagtataaccatgctattgacagttaataaaaagtatttgttagtgaaattaatagatatggacaagattcttaatgattattaaagaaagatgaatacatataaaagatcgagatttttaagggtcgaattgcttttaattgcatgtatgtaaacttaggctagaaataacaatttaatattgtctactaatttaaacaacctctatgtagactttgcagacataaatataataaaatttcatttatttatgata

SEQ ID NO: 234210 - DNA, 367 bp, Homo sapiens
acttagcactgggatgagtatggaatagcttggaatgactttcaatttctagttaagaggagaagcttctcgggatggatttcggttgcccaagacgccttccccgacctcattctcaggagcctggctcgttcctgcggtgcgggggctcagatgcaagctcttttcagcgaaggcagtgctgcggacagaaacctcagtctcttacaggagcccccgtccgtcgcctaacgtccaccgaaaacccccctgcaataacgcccgtcacaggcgaggaaaaggccggcgtggccaaccacgaagcccccagccggcccaggccagagctcggccaggagggaggaggggccatcggaggcgcggccgc

SEQ ID NO: 234211 - DNA, 348 bp, Homo sapiens
ctgaaggaagttaaactactttcccaagttacataatcatgtgccagagctgaaacttgcagcggcagagcccagcgtaataaccttttccctcaccaccatttagtttagagcttcagaagtatttttccattgttcgataatcaaaatagtaacttaaatgataaaaatggcccattgttatctggcttttatcttttaaaaaaatctgtgaaaagggttactgaaatgatgtatacttttccaaaggtgtgaaaacaaagttatcagaggtgtagcaaaaatttgtagtaagtcaaaagcgttaaatgattgaatgtcttctttaaaaaaatcctgtcaaatccg

SEQ ID NO: 234212 - DNA, 454 bp, Homo sapiens
aataaaatattttcaagcataaaaatattacattagggtaatattttgaggaggaagtagaatggaaacagaagtttatgtaggaaaagaaatgatgcaaaatatctgtaagagaaaagtttgttcttgtgcttctgaaatatatgatgatggatagaaaattgctacagtatttaaaagataacataaaagtgatgtttggtcataaaaagtataactgatatataatatctgaaattacatgctatataatcatttaaatttaagataaaaattttaggtgtgaacttaaaaatgtgcatgcagtacgtaggttttcagtgttgtttaggtggcgcataagtgaaaagtgaagaccattagtcctcaagagagtaccatctccatccattccccaagagcttcccttctctcttctctatggtttctaccaattcctctggatagtaaaaaa

SEQ ID NO: 234213 - DNA, 484 bp, Homo sapiens
ctatcaaaagcaaaccctggtactgagtactttatatgatttatgctactttatcttggcgaaattcatggggatccttaacccccttgcataactgaaaaatccaaagtttagacataatgacttactcaaggtcacgcatagctaggaagggtcttggtgggacgtgttggtgtgtgaatgtggagcccatgccttcttatcatacctcatggatcagttggtccaggagaggacacactgctgccccccttgtctccctcctgctcctggagttgggaggccatcccactgccccaaacacgcacgcctgctgccatctttttatttaatgattttctttttcttcctaggtaaagcaaacatggcatttattcacaactttgatcctcagttatcacaagacactacaaaagtctaacactaggattgtggcgaactttaaaaatgagttgatggaaaagaaaaggcttcgtaaactgca

SEQ ID NO: 234214 - DNA, 399 bp, Homo sapiens
agaggagataaattaatagcatgggaatatattcatggcctggaccataatgtgttattcttcaagtatttgttgagctaaaagctacatgtttcaacctaaagtagatttgtggggacattctaaatgagtgcagacctacagaaatgtttgtctacctctgtatggttattccaagtctgaaaagataaccccaatagcagtaggacaaaataggttatcaatatgtcaggctggattatttatttaatctgagctttaataaaaccagaagctatttactttttgttcttatgatagtgttatatccacattataaaaagttcaattaaagaaaactatacagtaaaaaatgcatgcccgacctatcaaattcccatctccaaatttaataaaaac

SEQ ID NO: 234215 - DNA, 461 bp, Homo sapiens
aacatttcttggatattaaagtataataatgtatattgagtcaaatgaatgtctgggagtcatagattttgagcctaacaaattcagctaggtcattctgatgtaattataataatattattaatgaacaaacttacttttagtcaaatttatctagctgtttaatcagattttctattgaattaaatagcttctcccttctttgagccttttaacctctagttctttctaacctgcagtttcccaggtcccatgtcttcctacctaatgattttgtcctttattttcctagagtatgtcctgaaatatacagatagaatttgtggaagtttaaatttcttttattttcccttttaaaaaaattgactaattataactatgtgtatttatggagtacaatgtgctgttttgatacatgtatataatttggtatgattaaatcaagctacttaatatatcta

SEQ ID NO: 234216 - DNA, 465 bp, Homo sapiens
atgggccagcgggagacaccaaggccctaccaggagctgctctttgatcacgaggttcacgctgcatcttttcgggaaggttaaaaaataataaatgaccaccaggatcacagaaggaaagagctcgtgatgtccatggaattcacgcagatcacatccaggaatctttggaacaaaaaattcacaacaccatggcctcatacaaaaatgctgggctgcaggaaacctgaggcagagagctccatcatcacagtgaagtccccgccttcagcagatcccaccaacagccacagtgcttcccatcacctgaaaaaaactcatgtatcaaactattacacttcttcagaatattggaaaatggtgcatagttcatatgttctcatttgtttatcttgtgtccaaagtgtcttgtcattccaggccactctatttcttgtgtattaataaaaagtttgaggtataaaa

SEQ ID NO: 234217 - DNA, 656 bp, Homo sapiens
gaccccaaagtgcttcctaaagctaatggtggactattatattgaacttggcctaacccttcagtcttttgtgcacaggtctatcctcctgacacgggcaatggccaaggttgtcccagctcagaggatcagtgaactcctgtgactttgtttcctcctgagaaggacaggcacaccagcctttgacttggcctctagttcctggctgaacgtgaaagaggcacactggatgtgaaaacccactttccctcctctaagtattcctccttgaggcacaggagagcaggggatgcctttgtggattcagaaaagattggcaaaaatgaaaagtggtgccaactactgctgatggggatggggggaagtatatactctcatacactatgggaaacatctaatgatgtcaaaaattatacagacccttaacccactcccaagatatcatgccacaaaaggaaaataaccagatactaagaatacatgttaaaaaaagaaaaagaaagcaaacatcaataaataggaaaacagctttatagactatagttaattcaatctatgaagtatcattcaggcattaaaaaagaatgagccgggccatattgttgtcttagaagacattttgaaagctgttattaaatgacaatagtaagatgtag

SEQ ID NO: 234218 - DNA, 305 bp, Homo sapiens
ggactgaaacccttactctttctttaccacaggagtcatgtgggtgattctttcttcctctttctcctcctgttttttttccttttctttcctcaaagagaaaactaggaagagaataatgaggattgattaatggtcaggggaatacaattcacacagaagaaagaaatggagactaaatggttattggcagcataggaatctgatagaggagaattgcttgaatccgggaggcggaggttgcagtgagttgagataacaccactgcactccagcctgggcaaagagagcgaaggtccatctca

SEQ ID NO: 234219 - DNA, 506 bp, Homo sapiens
tgggatctcttggaagctggacttgatactataagtcctaggcttctaaggtcgaacacagatcaaacttagtggcatgtttggttaagagttagattagacaaaaccaatgaagttgttaaaagtttcagaaacaattgaaaatgaaattgatgcatgattttagctttgcaacaaattcaactttagaaatatccttaagcctaagattaatcaagattcaggaccttgaagaattttcaaagttagaactgtaatttgtgtagggacgtaaaatctttattttcaacaaacagcaaatgtttccgttaaacaaatgtgtattttatttgaaacagatgaaatcataacagtttggcttgctttacctaagttattgttccataatatcaaaaaaattacttaaaataagttcttctcttcatattccccgaagtttttgtccagttttctgtatagctttttggttcagccaaaaagagacatttcatttgcagcattaggga

SEQ ID NO: 234220 - DNA, 350 bp, Homo sapiens
cagagaactgctaatatcagtataaaactgcctgattcactgctgtgctcatgtttacttctgaaacattgtaactttctatgtataatgttcccttcatctatttttaaaattaacattttttattgacagatcctaattgtatatgtttatggggcccctcgtctttgaaagtctatgaaatggttataacacaacctgcttcagctcttcaataaactaaagctgttgttattagtaattatatttaattattatggtttagaactatggggttcattttattataatgattaattgataacaactaattaacatagaacttgtccttattgccaaccctagtttta

SEQ ID NO: 234221 - DNA, 596 bp, Homo sapiens
taaagatcattattgttactcagcaatgacattcctgccacacagcgcaggctctctacatttctatttacaatcttcatgttaatccccaagtaatatttagattgttgtgtaaaaccctaaattctgctccaaaagaagattgtgccaaatccatctatctgagtccttcccactgaactcctcatcttcttgcccagaggtagtccttcaatcatttcctccagaaatcttactaaacaaagaacagctgactgcatttgaatgctcaagacctaaattgaatggggaaggaaagagttacacaaaaaaacacaccagccaattggcttcaactcacttgaactatgagagcttctaaaaggtacctttcatgaataaggttggaaaaggactacactcagttaaattctttgaacaatcatgacaaaagccaaccctatatccagcagaagttgagtataaaagggtagagactgcactgaaaaattgaaaagtaaattattacatgcaaagcatgtacctttgcatgaaaacagaattttatgactgtaccatctctgtctattagccaataaagttttaaatgatatttt

SEQ ID NO: 234222 - DNA, 450 bp, Homo sapiens
tatgagatacttaaactaatggccaaatttgcccatctagagacacaggggaagaggagattagatgaaagatctttgtgtcatttgattaatctggaagtagactaatgtcatggctccttctatggcagattgataaaaacatgtcaccgctgggccagggagtaccagctgtaagcagcagccattttccagaaagaacacggcggtcacctcagacccacagcactgcatcttagaacactgcaatacagggagaaggcaaacaaggggaaaaacgcatgatgatgaagtacatcaatgtcgaatctttaaaagattcacttaaaaaggaaaaagcctttaaaaaaatcacaggagttttacaatgtgtctaagtttctaggtgaggcattacctcatgtttttgcaatttgttttgcttgcttaagggggcaatttagtaagtac

SEQ ID NO: 234223 - DNA, 364 bp, Homo sapiens
ccagatgaaggatgaaccccactcaggacaaaaaaggcaaaacacttgactcttttaaaacattagggaactctggccgggcacggtggctcacacctgtaatcccagcactttgggaggctgaggcgggtagatcacgaggtcaggagatcaagaccatcctcgttaacacggtgaaaccccgtctctactaaaaatacaaaaaaattagcaggacgtggtggtgggcgcctgtagtcccagccactcgggaggctgaggcaggagaatggcataaacccgggaggcagagcttgcagtgagccaagattgcgccactgcactccagcctgggcgacagagccagactccatctcaaaaaaaa

SEQ ID NO: 234224 - DNA, 428 bp, Homo sapiens
tctggcgcacacatgcttaggaagcagctgtgatcactctaactaccatcttccctcaatgtagatactattattatgtctgccttcaaatcaggagatggaagattagagaaataaagtagcaggaccaaagaacacagccaccaaggcatagaacaagcaggcctgactccaaggcccacggcctctttccctcctccctggagacttgggacctactttgcagaaggcagggctgagggaagccacttgcccaaggacatacaagtgtggtacggcagagacgagcaccctgtctcccattcccagcccactgccatgccctttactctgcagactccctggagggggtagagtttcacttcctattctctaaccatcaaggaaggtcaagggccatgtatctcttttagggagaaaaaaaaatg

SEQ ID NO: 234225 - DNA, 2683 bp, Homo sapiens
aacagaaatgctgttcagtgaataccaatgcactgaatatacaaaaaagcttagttacaaagtaatccttaatggaaatctatattgaaaaatgttgagtataaaagtcaaatatttgtaacatatatccaaggagtattccagagagcagacctatttatgaataattttaaaagtaagcagagaaagtactctgttttaaacactgtatacagtgtttgaatttgaatcattttccacttttatgttctttataatgtttagaaataaaacataggttcttattttacacttgcatccatggagcacaaatcctaccaacacaatcaggcaatgtaagttttccaattagaacaactcaactgctggaattgttaagtaattgaatgatgagtattttgtaagagttcagtaaatacttgaatgagtaattggatattggaaaaggcattaccaggtagttcaaccataactctcatagtattttctaaatctgcaaatatacatgattttcccccaaaatattatacattaagttatttcagaaaatggactagatgcctctccttaaaggtaaggtcataagcacctcttgaagttgagaataatttaaaatcattctgttaaaaatcacagtagtttttattaaaattactatttagtgtttttcgagtgaaaggcattgtgcagtgtactttgtctaccttatcttatatagtcttaccatagtcctacttgataattttgtaaaatatcgattttatcagtgagaaaactgtgagttagaagagatcacttgctaaaagttcagtagctcgtaaatggcagagctgggatttgggtccaagtatgcccaataccttagcaggcagccctgtccattgtatgacacaacttgtatatttcgcttatcaaagggatgctgggctgtttgttcactagttttcaggttggtactattttaaatggctgacttataataaagcattcagatttgagggttgtggcagactcttacatttagtgctgcttcctactgtcatgataataaagaaaatggaatagcttgtcagaattcatcactctttgttttcataacgcttgtttatttgcttcctttgttaaccttcttttcatattctacttgatgggttgattctactctatcataaccagcagtaaagccccaaaatattgcaactaaataatattacaacaaatttttgtccttttgatgaaaaacttattattttggaaaacaagcaacacaaagttttcatctctttcagagtttggatgataaaattattgaaaatatcaacctctgtggtgagtcagcacaaatataaagaactagctcagtcacataaataatgagagttgctgagttagagtatggttctgctgaaaatctagatgatggtacagtgggcacttaattgaaatgtcgtaatgagaagatagtgcctctttttggctaagcgtgtttggcttcccaacacatagcttgaaattgaacttaggagtggttcttagagttggaaagatgaatgccctgtactatttcaggtatatatgagaaactattattggaaagaagtgggaggaaaataagtctgacctggcaagccaaagtgctgacctggcctcttgtctagttactcacgctcaaaactgtctggactgtaattagaaatgcactgacaccacactgcaggaacaactgctacatcaaatagtgctttcttaggttggttcccaggagggatctggcaatccaaaagttaaaagcggagctgccaagacgaacagttgcttcactaatatcctgacatcagaagggctttcttcatttaattatagacataatgaattctgtgtgggttctaatccatgatggaaacacaactgatgagagcttaggaggtactgttgtttgggacctcgcaacacctggcccgtatatggaaacagctaggcttaagtgttactcagacattgctagattcagcagaatccacagccccgtccagcggagacaaggaaattaaagactcatgttttttcttctaagtaatggtgttcctctataattaagcatgcctgggctctccttagggaaatagctggcatggcagcatatgactatagttgttgtatggaagaaaccactatacagcttaagctctttaactttggtgaaaaattgatttattttccagcaaataatgtaattatttatttaaaattatacgtgatgctacaaatgttaaatgtttaatttactgaattgaaaacattctaaatataggaagttacatattgtatttcactactcaaaagcacagtgaaatgtgtaagagtatacatttatgaatgtctatttaaaaagttctgccaactttctaggaaataaggtaatcccagtgctttgggagtacaaatagagtcacttgagtccaagagtaccagaccaggcgggacaaaaaagcgagacctcatttctaaaaaaaaaaaaaaaaaaaaaaaaagccacatgtggtggccatacgtgtattgtagtcccagctagtcaggaggctgaggtgtgaagattgcttgatcccaggagttctaggaggcagtgggctattattgtgccactgcactccagcctgagcaaccgagcaagaccctatctctt

SEQ ID NO: 234226 - DNA, 125 bp, Homo sapiens
atacgtttcagtttgggcctaaacggaggtctccagaatcccacaccattgctgcttctgctaggtcacactatctaggtgagcttcgtaaagagaattcatgtagaattgctcaggaaaaaaca

SEQ ID NO: 234227 - DNA, 1011 bp, Homo sapiens
atgtaagatgtgtgacatcttatcctgtggcatgctgagcaccgacagcctctgaagcccacactcaaccaggacacacatgctccctgctcttggggttgacctggggtttatggagtcagtgtgcttgctcacaaacctctttatgccaattgcactggttatcagaattatgtaatttaatgaaatagtaccaaatatttcataaactaattaaatatgactacataaaggtcactgcttctttgaaagttcactattttggaaaagactcaaaattagtcactacagaagcatttctgtcaatgtaaatgtgttatgataactataaaaggcgagggggaatattataaaatctaagaggattctactcttcataagcatcttcagctccgctgacttcaaagaaactagactggaaatcagaccttgttattggagtgagttgtaaaagaaagtctacatggaattccaatgggtagatccttattcagagaactatttgtgcctcatcacaggtagaccggcatgttttgccacaatagctgcgagttcaaaatgttgtaaggtcttgtttatgtttatgtatttttttatgtattgttttcaaaaggattttctgctttaatcagcttttaccattaattgccttaggcctgattatgtcagatgagaggatttggccgtataaactaacagcaacacctaaaaaaggaaaagtttttcctttgtattaaaagccttttttaaaattccatttcctactattagcaagatctggaataggtttattagcactaaatattatactttggttatgtacagaaaatggaatgtgtgcaatcatgttgatgaagtaccttcccctattgtgacatattctttccctttccaaatggcagtgttagatgagatttcttatggataaagaaaacaatacccggaacaattttgagtcaaaatgacaatcggaaatatgacaaggagaaaataaacctttttcacatctgt

SEQ ID NO: 234228 - DNA, 561 bp, Homo sapiens
ggaggatggcagtgccaggcatgcataaagtgatcaaggaaggggacaaggggtccagtgggaacaggagctaaccaggggttcaaggtcagggcgtggggagggaggggcgctggtgacatgcatggttcccgggaccagcccgtcctgccatcccagaggcctctgcatcccacaggctgtgcaccctggaacgtggttgtggctttaggtgctgccaccagggggcgtggcagaactgtctttggggctgaccacgggcaggcggcccctcaccaagctgcttcctgttggtgccatcagagtctgggctatcctctcctgaagccctctctggtctccacatgccccacccctttgccctgtccctcttatttccttccagggtacctcctcacctcctgtccaggtcaccagagcttcacctgtggacatgccccattccctgataatcctttcttcattctccatttctccaccactcccagctcccccagcactcccagctgctccacactcagtccctgctccacactcagcccccagctcccccaccattcc

SEQ ID NO: 234229 - DNA, 570 bp, Homo sapiens
ggaggatggcagtgccaggcatgcataaagtgatcaaggaaggggacaaggggtccagtgggaacaggagctaaccaggggttcaaggtcagggcgtggggagggaggggcgctggtgacatgcatggttcccgggaccagcccgtcctgccatcccagaggcctctgcatcccacaggctgtgcaccctggaacgtggttgtggctttaggtgctgccaccagggggcgtggcagaactgtctttggggctgaccacgggcaggcggcccctcaccaagctgcttcctgttggtgccatcagagtctgggctatcctctcctgaagccctctctggtctccacatgccccacccctttgccctgtccctcttatttccttccagggtacctcctcacctcctgtccaggtcaccagagcttcacctgtggacatgccccattccctgataatcctttcttcattctccatttctccaccactcccacacccccaccactcccagctcctccacactcaacccccagcacccccaccactcccagctgctccacactcaacccccagctc

SEQ ID NO: 234230 - DNA, 281 bp, Homo sapiens
ggaggatggcagtgccaggcatgcataaagtgatcaaggaaggggacaaggggtccagtgggaacaggagctaaccaggggttcaaggtcagggcgtggggagggaggggcgctggtgacatgcatggttcccgggaccagcccgtcctgccatcccagaggcctctgcatcccatgggaactcctacgtgggaagcttgttaaagtacagattcctggaccttggcagcacgatctgtatgtgggcaggcctaagatcacattccaacctcactgagata

SEQ ID NO: 234231 - DNA, 432 bp, Homo sapiens
taaggtatgaatgtgtgaaactcagtctaacttgattttaagttcggagaagaaaaataccaggcaattggttcccaaatgtacactcaacattttttccctttttactgggtacatagttgctataccaatcaatattaataataaagattattgtgtggaaatggttcatgtaagacaaaaactctatacataatttataaaatgtctgtgttctaaggatttagaaagaagttttgcctttttgatatctacatacttcatttgtgcccctttttgtgctgtgaaggagaagagcaagttcgacgttcagaatttctttggggttccctctcttggctttgggccccccctccctgtctgcatacagggaagcttctttctttctttccccttcttttgtgcctattaaactgtccactacttaaaacc

SEQ ID NO: 234232 - DNA, 738 bp, Homo sapiens
tcatacctccctaaaagcctagccctagtttctggtacaatatttcttctttccatcttcggttttctaaaccacaagtttctaaaagcaccaaggaattttctacctgtttattccgtttggtttttgtttctgtttttttgtccaaggtaaggcccaagttgacactgagtattctctgtgaaactctgcaaggagcaacatgtgatttcacagaaataagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctg

SEQ ID NO: 234233 - DNA, 445 bp, Homo sapiens
tgctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccg

SEQ ID NO: 234234 - DNA, 302 bp, Homo sapiens
cacccaagttgtaattgaaaaatgtagcccattctggaaccaacaatgttaaaggactgattattagttacgaattctgctgctgtttctactggaatcacataagctttgaacagacttatggcaagaatcagcgttttaatttcatgtccatctcccactaaaaagcaagcatggtgagggcatgaaccgtatcttatctctcttcacatccccacctgagacactgcacacaaaatgatgaccaattcatgttcataagtcacatggaagggccataacaattaatgaatggagcctgg

SEQ ID NO: 234235 - DNA, 686 bp, Homo sapiens
aagacgattgtttctccgaattccttagactcacagtctatgttgttgatttatggaggcagtagtgaggccccgtaccccaatgcctcctaccttgagacctggacagaggattgccctgtgaaattcaaaccttaaatcagtaggtagcagcagagacaggcatggtgccttaaagataaagaatacagatggcctccctattcacggaggggcctgcaacctttatatagctctacatacatcccctcccgtgtgcagatgcttcttgacttaccatggggttacctcccaataaatgcatcataaagtcaaaaagttgtaatctgtctggatatatgtattggtctgttctcacattgcaataaagaaatacctgagactggataatttataaagaaaagaggtttaggctgggtgcggtggcttacaccctgaaatcccagcagtttgggaggctgagttgagcggatcacctgaggttaggagttcaagaccagcctggccaacatggcgaaaccccatcagtactaaaaatacaaaaattaaccgggcatggtggcactgcctgtcatctcagctactcaggaggctgaggcatgagaattgcttgaatctgggaggcggagattgcggctgcagtgagccgagattgcgccactgcattctagcttgggcaacagagt

SEQ ID NO: 234236 - DNA, 793 bp, Homo sapiens
ccacgcataagccaaggtgaacaggcagccgcaggaagggcgtccagatgggtgagtcgctgggaccctgtgcagactcccgaggggcggtggagcccacaggctcaagacccaccaggcgcttcctccccgctggtctacagtgcctgaaacgtgggcctccccgacgcgggcagtgggtctgttggagtggccagaagggtcctgttagggaacctgtggatggctcaggattttagaatactccgagcctggggtgcccagagagcggaccttcggaacccacatgagtgtctctgcttgtgactcccggcagctccttaatcctaaagaagccagatccgaatcttgccaaattgtagccaggagttctcgagcagccagagagcgatggatttccaccggcagaggaaagatccagctttaggagcagaatcacacctgccagctggccctagcaagctgtggtctctgggaggccagggacgagagcccactccctcctccgttcatggctcagggtcgtggccagagcctgcctgtgtagaggcgactccagcagcccccagccccgcccagctctgcccacacagctgcaaggccagcatcctgccctttgtcaagttcaccacagtcatgtcccaccccccattcgctgaaatcagccccaaattgcctggaaacccagaccccgcaccccctccccagctttccttcttcatggagtttctatttcagaacaaggaaacagatacccccaaaacaattaaagaaataaatctataattacaaa

SEQ ID NO: 234237 - DNA, 455 bp, Homo sapiens
gagtgtatgtttcacacactcatcaatggtgccaaaactagtagttgaaaatttgatggggaacagagggtttgcatactctcaaagtatctccctgcagaatatctattcatgagagaaaaaagtaactttattgcagaaaaaactggcagattccaatttacctaacccatgatcaatcatggaaaaaactcagcccacttgccttgcaatgtgatgtattggggactaaacaccacttatattcctgccaaaaatctacaaactgagtctaatcatgagaaggatcagatgaatccaattgacagaaaatgttctcaaaaaattagtattggctgggtgcagtggcttatgcctataatcccagcagtttgggagcctgagatgggaaaatcacttgggcccaggagttagagaccaacctaggcaacatagagaagccacttctctaccaa

SEQ ID NO: 234238 - DNA, 860 bp, Homo sapiens
atgcccagggttttcatgcatccttcccgtcattgcacatttgaagccagaacatttgcattttttaatgcttgctggattcaattttacattccaaggttaatccctctgctcctgagattagggaaatgccccttactccttgctcttttctttttattttgaccagagcctgcatgaaaagatgctcaccaaatggtaatcgagcatgtaaacgaatgaatgcataagataaatctggaggaaagtttgagaccagaagaacgtgtgaggacagcttgtatgggaataggctctgtgatgggaggcttctctgttgtcctgaatggcctggggagtgggatgggtgcgctgcaggctgctttaggactgagctcaagaaatcattttaaagtcaaactcgtaataatcactcttgagaataattaattagcaaggaatttgtgactgggaagctcagaagtctcaacagcaactctgatgggaggtcaatctttgttacactgaaacgccatggagcagttggcccatggagctgacccgtaaaactcacatgtgcccatgtaagttttctgtttttataccttccttgtcttcagcaaatcatgagaagcagcttgttgacaccccagtgtggcctcctgttggtgctcatgaccaccattgtgttattgaggcacccctgaacttccttccctaaacttggaagccttcctctttgagaagtagttaaaaagaaatactgggtgtggcacagtgactctaacctgtaatcccgattctttgggaggctgaggccggacaatcccttgagtccaggagtttgagacctgccttagcaacacaggaagaccccatct

SEQ ID NO: 234239 - DNA, 701 bp, Homo sapiens
agagacaattaataataatagtaactttagcaccccactttcagtaacaggtaggacaatattttatggtaacaaattaggtaatttagatgaaaggacaaattcctagagactatcagttactctgctggaagcagtagcctgaatagacctatagtgagtcaagacattgcgtttgtgttacagatctccccacaaagtcgctcaggctctgatggcttctctggcttctaccaagcacatgttattaatagacacttgttactaacacacaatcatcatccctctccttgcataattgtttccatgtgttaagctaccttgtgacatgtatttatgcacagggagaattgtaccctgtgctgagcttgtcaattagtacatcagcgtttctccacagtcttcattatcttcactgtctccattaggatcataagagtaggctttgtaatgattacttagtgactcttttttttttttttttgagacaggtctcactctgttgcccaggctggagtgcagtggcacgatctcggctcactgcaacctccgcctcccgggttcaagcgattctcctgcctcagcctcctgagtagctgggactataggcatgcgccaccatgcccggctaatttttgtatttatagtagagatggggtttcaccatattggccagtctggtctggaactcctgacacatg

SEQ ID NO: 234240 - DNA, 344 bp, Homo sapiens
caaaaggccccagccttgacccctgcctggtcctcgcttttgcttgcctgctctcccctgcagcagtgccctctcctgccctcctgggccccagctcacattcaccctgcctgcttcatggcttctccccgccaggaatgaccctcccttccaaatgggcttggggtggggggtacaatctcaaaggcagtttcctccatagagttcccaggtggaccactaagtctcctgctttggctgggggcaccctaaagggtgattaacttctctcagcctcagtttcctcatctgtgaaatgggaatatcagtgcataccttcctggctcatggggaataacagaaaa

SEQ ID NO: 234241 - DNA, 477 bp, Homo sapiens
aatttctatttagggaaatcctttttgccaaaattcttgacagttggtgaattgtgcttcctttaatttatttaacatcagttatttttcttgttttgcttgatacatgaattgagaataaactttaagaagacagaaagaacaaaatttattttctgtgacacacaaaggaaagccattctataattcttcaatgagattgcattggtcccaagttaccttctctgggttatcatacttggcggtctctgaacatctagatagatagtgcaaaccagtatacaaagctcaaggacaagaaaaaaaaaatgattcatgggacgagcagaatgatgttgagtctaagtctaaaaacaaccaaagcaaacaaacaggtgttaatgagttcatttgggcccaagtttgataaaggcctaagtacaaagacaaagaaaggttacacatattgaaagatatctaaaaatgataccaaggaag

SEQ ID NO: 234242 - DNA, 426 bp, Homo sapiens
tgcttgttaacttgatgcacatatctctctactttagaagaaagagcatccataattagactcctacttttttttcatgccctagatagttaaagcctatcatctttttaagaatacaggccgtctgctttctatacagtaactggcttttattaatgatgtgtgaattaggttttcttttagttggttttcattttaagtgttctaaaatgccctctccagccacttgagtatagtggtggacagctggggctctggacctacgtgggttgtattctggctcttcgagcttcttaactgggtgaccactggggcaaggtcctaaatagcctttctgagcctccagtttcccatctgtaaaagaggtaatactccactcttctgggagtgattgtgtgtcttaaataagaaagtatttgtttttta

SEQ ID NO: 234243 - DNA, 236 bp, Homo sapiens
tggggtggcgagcacatctttaggtggcagcaaggctatatctgattgacacagatctgaagtctctaacaccatattgctgttgtcctgaattttctaacttggagaaatttaaggatctcctgcattatctaggcagagcatatgttgaggttgttttgccagttgttatcagtgttgaagaactgctcctgtaagcaaactgttaaaagcattactaccccatatgcatctga

SEQ ID NO: 234244 - DNA, 488 bp, Homo sapiens
tgtattcctagatctcatctgttggtgaatattggtagcagtgatgaagggatgattcaacaacaaaagttctggagagaaaatagacatctccctcctcattcaacaccttcagtcctatggccataatcctcccagttagaaggcatttggggaaataaggaacataattagcatttacctatacagaatcacaactaagtgattgcttactactttctctctttttatgccttcctatttctttccctagtgggttcagcacgggaaaagtctggctttgtatcatcccagagtcatggagcagatttccatactgacctcaaagaccatctgatgaaaacatgatcccttttgttctatagggatatataaaaacattataaatcagcatcttatttgttcatttatatcttccatttctgtgatgtttgacagttgttttgtcgatggcaactaccatatgttaaaaatgagcttctggaatg

SEQ ID NO: 234245 - DNA, 361 bp, Homo sapiens
cagcctgggcctcccaggagcctggccacactctcccctgcagaaccctctcctctcctccaggcacctgcccctctgctgagcagcccaggcctctcccatcctcactgcctggctgaacccatgagcagcagatttttggacaccaagagctgtgtttccaagcatggcgctaaagaggatgggctggcccagaaccatcctgagaaccaggcccagagacagctcaagggacagaagcattcagggcccccacagcagcacatgaacgtgaacatcagtctcaggatataccccaattccggaaacacaaatgtgcgaaaatgtagcctctgactcaaaggaacatggtgcttccaga

SEQ ID NO: 234246 - DNA, 293 bp, Homo sapiens
gccccacacggtggtagaaaggatgcagagccctccccacctgtgtgtgcaggatcagaagcaagtccccagcatggccacagagctggcccatctccagggggatggccaagcctaggtgtgctggacactctcatctcatctttgtcactgttgcaggctcctgttcagaccctccatggtctgagccccctggaattgattggggacagatgatgccagtgttcattgagcagaagtactggttttgaattgttaacataaagaccatccctatttagaattaagccttt

SEQ ID NO: 234247 - DNA, 302 bp, Homo sapiens
gggcttgagaaaaaaagttctcttcctttgggttaaagtcttaaatgctgagcccgtagccagcaaccttaaagactactcgggtccagttcattctatctggaggagtcacttgggaattgaaaacacaggaaaactttttttctggtccatgaacaaacaagaacacttaactgaattagacacaaaactaagtatttatggttgtcatcttaacaggtttcaaacaggcttcattttaatttaacataatttcaaaattatagcaaaatagtcaataaaatacgaacgtgcttaaaaaa

SEQ ID NO: 234248 - DNA, 431 bp, Homo sapiens
atttaaagtggccccggctggcacagtctaggtggctggcagaggcacatgcggaccctgcctggagcctgccctagtgacgctgggtgggtcagtctccttgcaagatgtgagcagcatccctggcctctatccatgaggtgccagtagcatgcgcgggtacatacacgtgcatgcacacacagttatgacacctagaactgtctcaggatgtcacaatgtgtccctggaggcagaagtgtccctggttgagaatgagccccagaggaaacaaccacactaggcctcaggattttgtgttgatcaagttccaaggaaaatgaatatctcagtcggccgcggtggctcacgcctggaatcccagcacctgaggccaggagttcgaggccagcctggccaatgtagtgagagaccccccgcatatctacaaa

SEQ ID NO: 234249 - DNA, 466 bp, Homo sapiens
cataccttgtagatatggtgggttccgtgtcagaccatcacaataaagtaactattgcaataatgtgagtgatacattttttttggtttcccaattcatataaaagttatgtttatactacattgtagtctattaagtgtgcaataatattatgtcaaaaaagcaatatataggccgggcacggtggctcactcctgtaatcccagcactttgggaggctgaggcaggcagatcacaaggtcaggagatcgagaccatcctggctaacatggtgaaaccccgtttctactaaaaatacaaaaaaattagccgggcatggttgtgggcgcctgtagtcccatctacttgggaggctgaggcaggagaatggtgtgaacctgggaggcggagcttgcagtgagctgagatcacgccgctgcattccagcctgggtgacagagtgagactctgtctcaaaaaaaaaaaa

SEQ ID NO: 234250 - DNA, 487 bp, Homo sapiens
tttctcctcgaaggccgagactttttttttttaaatgtagaaaaccagtacaaatttacaaaacacactataaaatgctctcttatctctagtttgcttttttgtgtacaaactgttaacctgaacagttttccggtgcaaaaggtctcaccagaaactttaggaaagatgagtgtgactgcgggaagcagaagaaactaagctgagaaaacccggaaaaatactcggcgcagctgctgcggccttgggtcatctcacctccatctaccccgcgtgctcgctttcgcttggggtggaaagcggggttcaggggctcttttcagcggactgagaaatcgcagaggccgtggggaccccaagtcaggattcccctttcccgacatcaggggtaaagggagcgggggtcccttcgcttcactgtgccccagctctaccgagaggcaggcctctgggaaacgagccggggacctgggggcccgggcggccg

SEQ ID NO: 234251 - DNA, 196 bp, Homo sapiens
gtaaggattcaagcttgaggaaacactgggggccgggaggagggctattgtaaagcatttcttaattaatttcaagtcctccatttttttacagggaccccaagtcaggattcccctttcccgacatcaggggtaaagggagcgggggtcccttcgcttcactgtgccccagctctaccgagaggcaggcctctgg

SEQ ID NO: 234252 - DNA, 286 bp, Homo sapiens
tgccagactattgtctctgagttgtacctgttgaacctcaattgctctgttatttttttcgtgtctctattaaataaatttttcatttcctcttttcctactaggctgctagcagttactcttgttataggtatgcttgcctccagttagccagtctttttttttcctgatgtgctatttctaatatgatgctagttttgaagcttaaattactgtacttgtgaggactgaatgaaaaatagggtcaatagatcctggagggtttgttctaatcattaaaggaggc

SEQ ID NO: 234253 - DNA, 475 bp, Homo sapiens
tatctgctgtgaacttcctcggggctattgcaggagagcttcaggttcaggctggtgagtaggaggagcatagcagttggactgcctgggtattgaactgatttggctacacaagactattttgcatcctgggagtgtttctctacagaaatcctcagccttgtaaaatgggaaattccctcctatgaatttatgcaataggacttttttccctagtgacttgtaatcacattgtttcaatgacgtgaattcctacataaataggttttgtttctgtgataactcttactgatacatcattttcttttactacgctgactttgtaatagatagaaagtccttatatacctttgttgcctttctttttaaaacatctcttacctgtgtctattcatttactcatccaaattgcctttatcctgattttgtcccagacttgaaatgaagttgcaataggcttatatgttagtttggg

SEQ ID NO: 234254 - DNA, 166 bp, Homo sapiens
gatagcaaagttctccttttctcttcccagagcatctgtctgagtaaaggtcaacagaacacttatcatgggccatttccatcttctgggttttctggacatttcctgcggctcagaggcagacagtagcccagaaacaaagctctgacagagtcacccgaggccc

SEQ ID NO: 234255 - DNA, 296 bp, Homo sapiens
tgttccaaaccctctgtggcttccaatcttactgccttaaaatggcttataaaattatatgatgtaatctgaatcttctctgacttcatctcctacgattctcctcactcccatcatacttatttcctttctactctttgaacgcatgaaatatattcctgtctcagggcctctgcactcgttgttccctggaacattcttctctccagatatccacaggactcactccttcagttccctctggccttgactcaaataccagcttctcaattaggccttttctggctgcactatca

SEQ ID NO: 234256 - DNA, 665 bp, Homo sapiens
ctcatcctccaagaggctagcactgggtttttctcaggctagtccagtcataatatcatggcaatcacatagcagcaaaaagaaagcataaatgctcaggcatcatttcttcttgaatcgagtcagctaatatcctgttgcttaaagaaagtctatggccaagccaagagcaagcgtaggagggagctacaaagttatagggcaaacgatgtggctacatggaggctattaattggggtgctaatgaaaccaatctaccacagatggcatggatccactgcatatggaagccaccacctttcaggaagacctccccaactggacttttaaaatagcctttctctccagatgccctacctatcatctcatctgcctgttaagaatgggtacatctgggccgggtgcagtggctcacgcctgtaatcccagcattttgggaggccaaggcgggtggaccacctgaggtcaggagttcgagtccagcctggccaacatggtgaaaccttgtctctactaaaaatacaaaaattagctgggcatggtggcaggcacccataattccagctacttgggatgctgaggcaagaatcgcttgaacctgggaggcggagggtgcaatgagcctagatcgtgccattgtactccagtctgggcaacgagagcga

SEQ ID NO: 234257 - DNA, 593 bp, Homo sapiens
aatacaccctttttaaccctttataatctgtacacagttacccaagtgctggagtaatgtggattccagacatttaaattaaaaacatgtagaaataaaaacttgttcatcccagctggaagcttcatctgaatttataggctatccaagtgaaaagatatttttgggagtttataaaccaaacattaacattataatgtcttaactttttttgtatatcacatcacagattataggacactttgacatattatctcagttgatcctcacaggatccgggactgtggctcagaaaggttatgatttgcttaaagtcacacagcaagctgtattcaatacccactgcagtccatttatttacatatctgtctcccctactagattcagagctcatgacgcaaacaagaccacaatctacgccttccattcccagtccactgccgttagatgatgctggcttagaaaggagtcagggaaatgtgtcagcttcctctttcatggtcttggggaacagggaaaggggtgagtctcaccaaaaatagaaaacaagatttcaggaagctcttttaagtggtgccattgcaaaagtaaat

SEQ ID NO: 234258 - DNA, 509 bp, Homo sapiens
gttttgttttgagtcttttttgctcagctcatattgtcagatagagttgtcctgccccttgcctcaacttttgtggattaacagattgaaaacatcttctcatgactttaaaacttgttaaaaaatactttgttgctatataatctctctttgtatggctcagcaacaattcaataatttgggggaggacattttaggttgatttcaggttttgctactgtaaatgatgctgttgtgaaactctttgtgcttataaccttgttcacattttacattatttgcttagaccagattcctagaaatggggttactaagtgagagaatgactgttgttaagaattcctgtaccgtgaagcatcccgtcgtggcaatcacattcctaccggcctggctcagcacagcctgtgttgcctctatgggctgaattttaaaagacacaatttgctttctttttactatcaagaagttcatgtttattgtggaaaatttagtaaatggaaaatgtaaga

SEQ ID NO: 234259 - DNA, 1024 bp, Homo sapiens
cttggctgtgctgtgctgtcagtggcatggcggtgccttaggttcccagagcctctcgccctgggctccgtcttgtgggtgtcctgatggctgtgggctgggttctgggcgggttgctggtatggatacaggaactactgagtgaataggtgtctcagagccctaagggtctccagaaagccggggtgtctgtgtttttaaaagaaaacctatttatgttgctgtgggtctccgccgtccctgtgttatagtacataagaacctttattctcctgtggttcagagagcaccccgacatgtgcctgcagctgcatccccgtaccacagtgtgggtgcaagacgctgggtttgtcctttgtctggtgaagcctggctagaaggggtgggggtggtagcccctgccctctgcagtgtccgcatccactggtccctgagcagcatagctggccacaccctcatgacatgacaagactgtcactcagtcactattgggtctatgaagggcgtcaagtcagaggaaggtttttatttttaatcaaataccacatttagctctatgtcataaatattcagaaaactatttttttaaacaaggcagaccaaaaatgtctgctagctagttggtttctatacaaatacatattcgaatgtcttgctggatgaagaggccgctcagccggagcctcctgtttcatgcgcttctcttctgaggggcagtagaggagaaagggctgttgggaggggttcagcccgctccttggccaggggatcccagccaccttctctgcaccaggccctgccttgagggacctggacccccaggtggcttctggccaggtgtgggtgggtgggaggggccctgtctgtgctccgagtctccgtgcgtgcaatgatttctctacctcatctgtgtggcccgtcccagagggactgtggagaatgtatttatttaacagctttgtgtcacagaaccagaaacaaatggaaacattaaataaatgtattttaaattataaaaaaatct

SEQ ID NO: 234260 - DNA, 488 bp, Homo sapiens
catgctgctgccgcctgagcgacgtgtgtggggaagaacttggagtgccacccccagaatgtggcgtccacctcaccagaccgcacgggtgagccctggactgcaaggtgcatataacacaaggtttggacacacctggagagctcgggccaggcagggccacacctgtgagcctgagctcatccaacaccgcccggagctcggggaccttccccatcccagcacctcctcaccgctgtgcccgtctggccagtccctccaagcacccctcggatgaagttgcgccccacactgcagtggggctcactctccacagcgcctgctgcgttgcacggggtgtgacaggaaggaccctgctggggctggcggggccgtacccagagcctccctgtgcggtttctcctcctcctcctcctctccataagcaccgggaacaaaacagaaaaaagtctttgtatagtaataaagtctgcagttcacgcacccat

SEQ ID NO: 234261 - DNA, 386 bp, Homo sapiens
cacgcctgaaatcccagctacttggaaggctgaagcagaattgcttgaacccgggaggtggaggttgcagtgagctgagatcgtgccattgcactccagcctgagtgacagagcaagactgtctcaaaaaaacaaaaaaagaaagaaagaacgaggtagagggggcattagatcacgtgccactttgtttagatgctctcattttcataacagaaccttaaactaagttcctcctggttggtatacaaagcgtataaattaatcaacacctcaacatttctgcccttaggttttggcccgtgaaaatgaccttgaattctctaccaagtgatagttatcaagtgtgctgtaatgagaaatgttgttttggtaggactgtaaaagac

SEQ ID NO: 234262 - DNA, 414 bp, Homo sapiens
agggtgaggtggggggattgcttgagcccaggagtttgaggtcagcctgggcaatgtagcaagaccctatctcttttaaaaaaaaaaaggaatgatttgtttatactcttgcaaatggatgaatctcaaaataattacaccaagtgaaagaagcgagaaaatatagaatatataccatatgattccatttctggaaaatgcaaactaacctacagtgacaaaaagcagaatagcagttgcctagggactgggattgggggaggtcaggagagattacagtacgtaggaaaactttggaaggtgatgagtatgtttgtttcttgattgtggcaatggtttcacaggtgtatacatatgtcaaaacttatcaaacttagaacattttcttccatgaaattaaaaaaacataaaatt

SEQ ID NO: 234263 - DNA, 308 bp, Homo sapiens
agttgaagtccaatatttccttactgattttctgtctggatgacccatccattattgaaagtaggatttttgaagtcttctagtattattgtgttactatctattaatgtcttcagatctgttaatattttctctgtttatttaggtggtctgatgttgggtacatatatatatttacagatactgtatcctcttgtggaattggcccctttctcattatataattactttctctgactctttttacagtttttgatgtaaagtctgccctatctgataaaactttagcttcctctgctctcttttgg

SEQ ID NO: 234264 - DNA, 538 bp, Homo sapiens
aacatagataattcctatttctgacttgaacagttgagaatgttgacaaatgcattatttcatccaataatttcttggactggaaacaattatatcatcatgttaattgtctgttattaagaagggggttttctaggttgcttcccgcccccatttgttacttgtatgaatttttaaggcttatattgatgagattttcatgtaatggaggggagaaattttttcctttttaacatgttcatgtaaaaggaatttaggaaattattttaatcttgctgggagctaagacaaaacacaaaacaaaaacactgcagaacagtttatggtcccatggacaaatgttcagtctgaacacaagtactagagaagaccttggaaggctgaggtcagaatgggttaaagtagttgagttcatgggcaaagggggacttggcatgttttcacacagttaagtataaatgtataatatgaacagcactataaagacctgggggagatgggctttggggggtttgtttgttttcttagaacatgttac

SEQ ID NO: 234265 - DNA, 703 bp, Homo sapiens
atgtcatgcctgccacgtggtctgcactccagaagtacttgctattgctgttattgaaatgaaagatctcccttgcacatcttcccctgcccggccacattgtgcactttgaaaaggatatccttcacattcgttttccagaaaattgaggtcactgacttatttccttcttgaaccctctaccctccagtccccatggccatccccactccccccaatcccttgggttaagtcacagcagaggcatgtacagagcatccctcgcaaacatcagttgcctttctgtctgcagcaggcctgtttgattttggcttcttatctgatgtagggaagaagccgcactcctctgagccttgggtaggccagttgtgggctggcccgtaataatacaattatgaaggttaacaggaaaaagtggggtccaggagcaattccaggcagctggcaggcctgctgaattggaagcgccccaccaatgaaaactgcagcaagaagcaaattaaacctcctatctgccatctcactctcttttctcccctttcctgtttggacttgaaaggcgattggagccagggccctgacagttgacggaagtgctgcaaggagagagtatttatttacagtgagtcgtggtgatgcttgttcaggatgcggtttcttgcaggaagttctgtccccacccccgggtttgatcatttctcca

SEQ ID NO: 234266 - DNA, 386 bp, Homo sapiens
aaaaaatttttgattacctttctagtagtactaaaatgcaatggggtaaactgctggaaataattataaaaattcaaagttaagtcacaaatgattaattttacggcattaatatcaagagttcaagatttcaagattttgggagatacagtatttatattccttttttttttttttttttttaagagtctcactctgttacctaggctggagtgcagtggtgcgatctcagctcactgcagcctctgcctcccgggttcaagcgattcttgtgcctcagcctcctgacacagctgggattacaggtgtacaacaccatccccggccaatttctgtatttttagcagagatggggtttcgccatgttgcacatgctggtctcaaac

SEQ ID NO: 234267 - DNA, 813 bp, Homo sapiens
ccattctgattgttcacttgcacttcataagtgcctactgtgcacaaagcctgggcttagtctccatggggactatgaatactttcactgtgtggacttatccgagcttcccaatcatacctgctggagagatttctctccatttcttttcccatataaggaaactgacactcaaaattgacatcatttgccttctgctttacatctagtgaccaagtgtggattttaattcaggcccatctgatttcacaatctaggcctttctactgcacgtggcctgggcctaggcttaccacggtgtggagggtctggagcagaaaatgcttggtggtcctcctgagcagggaattccatcctgctgtcatcatccatgagtaggaagtttcaatagacttcctggaacagtgcaataggtactgtaggtactggacgaacctcctcctgccgaggacaggtaggagaggtaaatgtaatacacaaaagcaaaaacaaaaagcaactacctcaaaggcatcagagagctagcaaagtagaagagatttaccaggcaagatccaggagaacagaaatccagagaggttaccccaatcccatctcctctaggagtgtttgctgatttcaatagaggtgattgagagactgatcaagacttttgacagcctctctgggtccaggacacaaaaaaaactgatgttcagagccttccaaggggttgggaggagggcctcaggtaaatctcaccaactgggttaagacctcaaagagctgccctaggaataagggagagatggaagcagagcagcctcacaggga

SEQ ID NO: 234268 - DNA, 944 bp, Homo sapiens
caggcctctaagatagccattactccaaatttaagtttactttcccatatactgaatctcctacaataatggaacttaaaatgcacactggtgattggtaagcagttgtgaacagagagaggcaaagtcatattttattaatttcaagggcttagggtataatttgaattctttttcaaagtgtccggattgtttttcagctgcttttgaagaaatgaatctaactcatctcagaagtcttgtcaagtaaattcaatagatcaacgtatgtcgcagcctatggaatacttagtataaaaattgaagagaaaaccctcaggttgctataaaagtgctgctttattaaaattaccaaaatctcactatttctatctaaactgacatactacagtttctgtctaaatacattgctctgtattttattaatttgtatggcaataaatatgtgtcaggaacagttttaaaacttaatcctcaaatactgcttccttaaatctatttatttatttttatttatttattttgtttttgagatggagtttcgctcttgttgcccaggctggagtacaatgccgtgatcttggctcactgcaacctctgcctcccagattcaagtgattctcctgcctcagcctcccaagtagctgggattatgggtgcccactgccacacccggctaatttttgtatttttagtagagatggggtttcaccattttggccaggctggtctcgaactcctcaggtgatctgcccacctcgacctcccaaagtgctgggattgcaggcatgagccaccacacccagcccttaaatgtatttttgtgtgagtgtatgataaaaatcttggatctggaacaaacccaaagattactctttttagttacctttttaaataaactctttatttatctttttaataaactctttttagttatcttttgt

SEQ ID NO: 234269 - DNA, 439 bp, Homo sapiens
gagatgacatttgggaggggtgagtgactcagactctcagggtctctgacgacgtccagatcagtcacttccttgctacacatgccatggactgtgaatgagaggagtcccacgtccaggtccaacccaggctcctccatgtacctcagtccaaggctgaccccagaagcccttcaatttcaagtctaagaatgagggtgccctgataaatggcacacccaagaagggcactcaggcagtttggtggggctaggagccagtgaaggctgtgaaaggggtacagtggcccagcctgtcctaacagaagcatgaagatcaggatgagggtggggtggtgccgctctattcggtgctggcaacatctgttccttcagtgagtaggtctctgaacacttttttttttgagactctgtcaaagaaaaaacaaaaataaagaaag

SEQ ID NO: 234270 - DNA, 369 bp, Homo sapiens
catttccccataaactagaggattaatttagaaacatgaagaaccttgtcagcctttggccaattccttttgtttgtggggaaacaaaaacaaattggataggaaaaaaaaaacccagaaagaaaaaaaaaaaagaaaaaacagatttgactgttgttttgtttttacatacagatgttatatgaccatgcctgtaaaattatatgtttggaaaggacatatttaggctctaagaaatttacacaagatgaggtcttttaaataaactatttcctggatggtggagtttttaaaaacttaagtgctgctgatgatattataattaagccacccctcctacctctcttcccttttttgcaccattccctg

SEQ ID NO: 234271 - DNA, 511 bp, Homo sapiens
cagctttgaatttgatttatattgcacatatataataatgtacaccctgtcagcctttagatttacttttactggcttcctgggtttccaaatgtgcttttgttacttttgctggtctttagggtgaggcctgcttggtggtgtgatgaataagggcatttcctgcattctttgtctaccagtatattatcgcccctctatctatatgtattatattatacaaacaaatggttgaggatgagtacacttcttgcaaagccagtatcaattaaatcctatctgcacttcgtttaaattcaaaagtaattcacagagtgactgcctcagtcaatttcatcctctcagaagagaatgaagcctgaaataagatcatcatcatatattgaagatttttctaacacatgggaaaagtcacttcttcaaaaggcttcataaagtctggaaaatgaaagtctattatttaaaaattccatgctagcctttaaaaagaacccaaaatttagaaaaaaaa

SEQ ID NO: 234272 - DNA, 412 bp, Homo sapiens
ttgcccctgaccagtaggctcaaggatggctcagccctatctcccgggctccagggacacggctgactttggccaagtctgcagagcccaagaagatgctggcattcttagatctactcacaaaagaaagtgttgtaattctcgtcatcagggacatgagcgccctggactactggaagaaaattgagcatcagtttcttgagcttgagaggtgttctgtgaagacagagggaagggcaggaaagcaacagagaaaacctgggaaaggccttctatctgctgcttcttttagagtaagggtgagggagggctcccatcccctccctagaccagggtgtccctgtgatttttaaattcactatctagctgtccctatcccccctcccaaaacacaattgtgatagtgaattta

SEQ ID NO: 234273 - DNA, 393 bp, Homo sapiens
acagtgtcagagttggttgctgcagagagcacatatatttcaaattgctgctctgcatgctacgaatcacaataacatagttactgtttgtcagtatgtgtgtgtgtgtgggcaccacacatattgccctggcatcttatttatttctctcattaccagtgcatacttacctatcatgttaaaacaagaaaaggagaaaagtggactttatatgtaacactttagaggcatagtggaatgtatattattattaacaaattagatagcaaagcattatatttgttatgctagaagactatggctgtgctaaaagaatataatatatgtcaacattgccagactgggcacttctcacaatattcccaaccaacaggaataaaactaaaggtcaga

SEQ ID NO: 234274 - DNA, 1632 bp, Homo sapiens
  misc_feature (426)..(426): n is a, c, g, or t
gagtgaccacaggtgtccccgtcgtgctcacctgcaccggctgcgaggagcagggagctcctcaaagagctcaggaacggacaggacatggacacagtggtctttgaagacgtggttgtggatttcacgctggaggagtgggccttgctgaatcctgctcagagaaaactctacagagatgtcatgctggagaccttcaagcacctggcctcagtagataatgaggctcagcttaaagccagtgggtctatttctcagcaggatacttctggagaaaaattatccctcaaacagaaaatagaaaagttcacaagaaagaatatatgggcctcccttttaggaaaaaattgggaagaacatagcgttaaagacaagcacaacaccaaggagagacatttgagcagaaatccaagggtggagagaccntgtaaaagcagtaaaggtaataaacgtggaagaaccttcagaaagactcgaaattgtaatcgtcatctgcgcaagaattgttgtactagtgtaagacggtacgaatgcagtcagtgtggaaaactcttcacccattcctcatccctgataaggcacaaaagagctcactctggacaaaaattatataaatgtaaggaatgtgggaaagccttcagtcgcccttcctacctacagacgcatgagaaaactcacagtggagagaaaccctatgcctgtcaatcttgcgggaagacatttcttcgttcccactctctcactgaacatgtaaggactcacactggagagaaaccctacgaatgtgggcagtgtgggaaaggcttcagttgtcccaaatcctttcgcgcacatgtgatgatgcacgccggagggagaccgtatgagtgcaagcactgtgggaaagccttcaggtgtcagaaatcctttcgagtccatatgatcatgcacgccggagggagaccgtatgagtgcaagcagtgtgggaaagcctactgctgggcaacatcctttcaacgacacgtgagaattcacaacggggagaaaccctataagtgtggaaaatgcgggaaagcattcggttggccctcatccttacacaaacacgcgagaacgcatgctaaaaagaaacctgtgagtgggggcagcgtgggaaagtcttccgcgaggcctcgcccctccacagatgtcaaatcacaaactagagagaaagtctataaatgtgaaacgtgtgggaaaacgtatggttggtcctcatctttacacaaacatgagagaaagcacactggggagaaacctgtaaatgcagccagtgtgggaaaaccttcaggcgggctttgctcttccaaaaatgtaagaacgcagattggacagaagcccagtaaatgcgaaaaatgtgggaaagctttcagttgtcccaaagcctttcaaggtcatgtgagaagtcacacaggaaagaaatcctgtacatctaagtaatgggggaaaacctgtgcaaattaattcacatacatggttcagaaaattcacagcaggagggccgggcgcggtggctcacgcctgtaatcccagcactttgggaggccgaggcaggcggatcacgaggtcaggagatcaagaccatcctggctatggtgaaaccccgtctctact

SEQ ID NO: 234275 - DNA, 466 bp, Homo sapiens
tcgcaagctcttcattaaaggcatcagaacacgttctaacaagaaattttcagcttagagtggttgttctgccattctgccactctccatgttaaggccattccagggagggtagattctatgattaaggcgattaaggtaatcagccaggctgactcaaacactcaatctagctgctgccagtggacctgctggtaatcaccagaagagtatgcgttggaggagaatttctctctacaagtactcttgtgtttgttaaagttgaaactaagttggacaaagaactgtgcttgaaagtttccagctctataaattgtaacttccataaaatgtatccctgactaacagtcccctgaccacataccaggggttatgcttctggagtctgtacccctttctaataaactgctctggacacaatgaaccctgaattaattgttgtaacaggttaatggataaggtaaca

SEQ ID NO: 234276 - DNA, 661 bp, Homo sapiens
ggtgggaagtcagcagtaattaatgtttcatattctctgcagtgcctagaagaatgccttacaaacacaaaggaaaaacatcctgtaagaaaaaaaaaaaaaaaaagaccttcaaaattagctggacttggattcagatccacccctgtcacctctagctgtgtgaccttgaagacttaacttctctaactctcagtttcctgattggcagaatagagcttaacatacagaagacaatgtatataaagggtctctcaccaagcctaaccaacaggaggtgctcaacaaatgtttatacattagtatgtattccacaatgaagtgcagtgtttcaaccctgttcctacaccttttcctactaatgctgtttgtaccaagaaatcatctaaaaaattagatctctgtcaaattcataaaaaacaaaactgatttaagacaatgaaacaatggctaaaacaacatagaataaaatgcattaactaaaaagtggcagaaaactcacatctccttgacaaaaatttgatctgcagaatttgagctgggaaatttgggcctggtagaaataaataccacaaagcaaaagagaaaactaccatacaactataaaagttattagtaaaattaacatgtagcaaacaatgaacaatgaattctaatttac

SEQ ID NO: 234277 - DNA, 500 bp, Homo sapiens
aatgaggtctagaaaactcaaaggctactgacagcagaggggatagggcgtatgtgggtaagagcagatattcccacccccttgggcaccccattaatatgggtgaaagccgctttgacacccatggaaagcaccctgtcgtagtcaccagactcagggatacaaggacggatgaaagaaagagggatgcctcactttctcgtcctcatataccctggatattcactaggaagagaagggaaactgggatgagtcgctcccctctttctagatgagtagccattcatcttcagtctgtacccctttggaatgcaccctgcaaccctgggactcctttgaaaaaaacgtcccctgaaaagaaaagctttatagagggattaagtatatatggggggggactatgttttacaataattggttgatggttcaggaaacaaaaaaaaaactgttactgtttcaacaatgagcaatctgtaaaataaacacatttttgcatgaaa

SEQ ID NO: 234278 - DNA, 513 bp, Homo sapiens
cagagccctgtggctcccaggagcctgtgagggctgtcaacccacctggccccttccttatatgggtgtggaagctgaggcctggagggagacagcattttccaggggcacaaatgaggcgtggaagggcccaggccagcacctgagtgtccagactcctggctggtgttctttccagaactctccgctgaggggcctcgcttcctcctcctgtgaattagtaacagggcctgcccatgtgtctccaagggctcctatgaaaatggcaaaatgtgacaggaacatgggctttggagtcatagagccctgggtcccacgctgtaagtccgtgccaaccagcagcactttctgtgatgacggaaagcgcctctagctgcattgtcccatgtggtgccaccagccaccatgagatgtggccagcgcagttgaggaactggatttcatattttattattaatattttattattaaatattaataaatttaataaaataataattattttattaactt

SEQ ID NO: 234279 - DNA, 729 bp, Homo sapiens
gtaagtggatataagactgtaaaggaagtagaactgacataatttggtgtctggattgatggtgctgccaaccactcataaggatggctgggaaagagcacctttgagggtgaaaggacttggattgagatgccccagtgatattcaagcccagatgtcctctgaagtatctggaagttctcctcttgggatgagagaatatggcttttcttctttgcattgaatatgtaccactgtcagtggtttatggctcttctaaggggtgtcccatgtaatttgttccgattatgggagatgggtatggactcaagataaacaaaatcaggcactacctttgaagcctttatagttattttgagggttatattagtattttacaattacattttatcaaataccagcttgtagttcaggtaacgagtattatacatgttcagacaaggcttggtggctcatacctgtaatcccagcactttgggagcccaaggcggatggatcacttgaactcaccagttcgagaccatcctgggcaacgtggtgaaaccccgtctctactaaaagtacaaaaattaggtgggcgtggtggtgcacacctgtggttccagctacttgggaggcggaggtgggaggatggcttgagccggggaggcagaggttgcagtgagctgagagatagtgccactgcactccagcctaggagatagagtcagaccttgtctccaaaaaaaa

SEQ ID NO: 234280 - DNA, 294 bp, Homo sapiens
gtatttatgttagtggggggttggaagctgggtgttaaaacagcttattatggagactgaaagataagtaaaatatctttgatattctaaaacaaacctttcaaactgattatagaaagatatgtagcattttatactgggggaagtaacattcctgtgttaagagtccaaattaaacactttttatcttaactcaaatatcatctaatcatctataatactgtgaaagagaatagtaacaaattcaagctatgctttacagctcatatagggctttcacaattcatcccttca

SEQ ID NO: 234281 - DNA, 443 bp, Homo sapiens
aatgctgtttcctctgataataccttctcccggatatctgcatgccctgctccatcatttccttctgacccaaaggcacattatcagtgaagtccctcccaaccactcttcaagatggtactgtctcacttgcccttagtcctccttgcccattagtaagaaatgaatgcataccaatcagatgtctgtgcagtaggtctggagggaagatacagtgtctccgctgaaggaaacctatcaaatctgaaatcctgcaccgtctgacaggcgttaatgcattgtaggaaaggaagcaaaataatctctttaaaaggataccccataagcctcacttatttagcttgattgaaggataaatgttgcttatctttcatatgtttttgctatttcttttctcttattttagaattaagtactgggtatatataaaaggttacttatga

SEQ ID NO: 234282 - DNA, 447 bp, Homo sapiens
agaagatggttctatgggcattgcctggttctttctcttgcagctgtcggaggaaggggagatcgtagatttgctgctgatgaaaatactcagtttcctgggcattaagtctaagagagaggagcctggaagcagcagggagcagcctgggtctctgtcccagactcgccactctcgaccagcacaagctttgcccaaggactaagctgttcgtccacacgccaccatctaccagtggggacgcccagggcctcgggcgtacgcttaccagcgactctatagtctctctaggtcatagctttcatgtccattgaagaattaccaagcccagcaagtaaaaaaaattacaataacagagatatatgtaaaattgccaatactatgagagcttctttgttcaaatgtatttcctcttattataaataaaacaaatattacatggagttt

SEQ ID NO: 234283 - DNA, 913 bp, Homo sapiens
cccaaagtgctgggattacaggcgtgagccaccgcgcccgaccgagaattttctccgttcagagcttcacttgctatagagagcctcaagtcactggttctcagtgtgcatctattggccatcagagggtcctttagggatgacccatctgtgcttaatttactaatgacagtatagttgctgctatttattgagtgcctgccatgtgcaagatgctgtaaggtacagtgtagtttgttttgttttgttttgtttttgtagagatggaggtcttgttgtcttgaccaggttggtctcaaactcctgacttcatatgatcctccctcctggacctcccaaagttctgggattacaggtgtgagccaccagactcggccagtgtagtatttttaatcttcacaataatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctccatggcctttcagggagaacactgtgggtatcatgctgggtggcctggagggtccaagtaacaggaatctagaaggatggaccagatgtgaacaaaagaaagcctgagtaggacacaaaacagagaagtggggctgtaacatctctaagatattacagcttgctacttccactctctttgcaaatgtggtgaaacccaggctggagtcata

SEQ ID NO: 234284 - DNA, 379 bp, Homo sapiens
caagctggacaacaagagcgaaactccatgtcaaaaaaaaaaaaaaaatttatttttatctccatctggaaacttgtctgactggtctttgcttctgaagacatcaggttattaaaaagtcttggcgttccttccttgatgactgcccaaatgactaactaagtttgaggcaaattctttttctttattttttcactattttagttcactgcacagatgtatgaggcaaattcttgttacataactttgtcatataattccagagaatcaacagacatcagtcattaaagtgtttttttttttttcattacaaaggaccaccatatttattaaaatttattaaatagaataaagcaagactttattctagacttttagt

SEQ ID NO: 234285 - DNA, 436 bp, Homo sapiens
ttgctgtatttttatgtaaaagatgttctctctgaaaattatatgattctataattttgatgttgaaatgacagtgacgatcctaagaatcacaaagccgtgcagttggggaggtataagggattcaaggattgcagtaggttggtatggatatcaaaacaccagttactccctgaattcacacagtatctttggcatttggagcaatttgtacttgatcttagccaaaaggccaagaggcgatttttagagcagtttgatgggaactagaacttaacctattgcaacatttgccaaaattttgctatttgttaagtggagattttacttacacctggtctcctggtacacaataatatctaatattcttttcattgttgtcttctttttcttcattttgttgttgttattcctcacttatcctccctgcccctag

SEQ ID NO: 234286 - DNA, 644 bp, Homo sapiens
ggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 234287 - DNA, 399 bp, Homo sapiens
actttgtcctgagtttacttagcatatagaaaggagttacatacacaatgaacattcgaggactgaattttagttgaagtaactgagatgagtaaacaaaaaatgccagaagctcactgcctcctccacccccaccacacctgatgcagtccagaggcaaatttctttgttaatccacttatttgtgttatttttatgtatttatacttatagtacgtagcatatctaagctcatgtctgtcttaggaattggaattttagcaggcagagagatcatcaccttaactctgtggtgttcaatcttttagcttccctgggccacatcacaagaagaaaaattgtcttgggccatacataaaatacaccaacactaatgatagctgatgagctaaaaaaaaa

SEQ ID NO: 234288 - DNA, 358 bp, Homo sapiens
atctgtttttgtgtttcagcctcaggaagagacagcatctgttctgcagagcctactctctagtctgacagctttgacttttagatgatctccctcagtagtccttcattgaaaataagaaaagtcattcatttgtgtgaatttgagcgggggatctgaatcgcatctccaggagcattttgagctgctccgtagggcaagttgcagctgtggttgggagagcagacatttctcccatgttactgcacagctgatgacacaggcaacttcttaccaccaaggataatgtagagggggtacaccctctgttaaccatgaaatgctgcacaaatgtgcaaagggacccaaagaatggcgc

SEQ ID NO: 234289 - DNA, 549 bp, Homo sapiens
ttctcaaggaacacgggtggcctagcctgtgttcaggctctccagcctcatcctccacctgttcagtgcttctgcaaccccacacccaattctagccccagctctacctcccacacacgacatgggacagtaccttcccctctctgcaccacagttcctcaggaggcctaagaacctagagattcaccctgaagacgagaccacataacctggattggaatcctggctctggagtcggttagttctgggaccatctaagttgattaaccctctgtgtgagtaaaatcgggtaaaacatctgctccaagggctgttacattaaataagatgatgagggtaaagctcttggctccacacctagcacattgttagcactctataaataaattacactcagtgcaattctcaggggagttcgtagttaagtttagcatctgcttttcttcctctttatgcatcttgaacgcctgtcccctggttctggtagagtgccaactcttgtcacccccctctttatttcctcatttacactaccttcttctgcaatta

SEQ ID NO: 234290 - DNA, 3156 bp, Homo sapiens
tgaagatatgtgtcatatttctttcaatggataattttaagtgatattaaattatgtcaatagtttgaatagcaatagcaaccattgagctaaaattatgcaacaaatagttgcttgttaacctaagatatttcaacatttttgaaagattagtaataaaacatgccatatttaaaaagccttaatgtgaatcttctctccactgtagttcaggggacactcaggatgctagagtaatgctataaaaaaagccactcagacaggtgcagtggctcacacatgtaatcccacctactcagaagactgaggccggaggatcacttgaagccaggagctcaagaacagcctgggcaaaatagcaataccctcctctctaaatatatataaatatatatatatagataattagttgggcatggtaatgtgccggtagccccagctactcgggaggctgaggtggaaagatggcccaggaatttgaggctacagtaaactatctcactgcactccagcctgagcgacagaatgagactccatcttttaaaaaaaaaggcactgaaatgaccccatcaaatccaaccagctatgccaggctctatttccatcctatttctgaggagtttttgtccttgctgggtttcctttggcttcatacccagattctgcttgccctatataacatggatggtctgtctgtcctttgttcagtacctgctcaagatgccacttgcccagagctagagcccacgaggcaaggggcatctcttctctcactggtcaaaggtaggtggttggaagtggatattctggattcatctctccaggcccttacttctaggaaaacaaacaaacaaaaacaagcagtttctctaaattaatatgttaatataattctaaaaattagcacagaaaaattacccatttaatttataatggttttttaagacatttggaaggaaatatttctttcataatactcaaacacttaaaggttgaacattataaagaagcatcagtattatcagagatttttcaagattctgttaaattctaaacatcatctagaaagttcttgtcttatatctaatacctaaccttaatgtcccctcctttgttaaaacttttcttgactctctctcttcccgtgcctgtacaaagacatgcatgtgcatgggaacacacacacacatacacaaacacacacacacactagtaatcacagcctcccttttgccagcatgtatataacataatttttagcattttcccacattaaagaaataattgaaagcttatatatttattccccaaagtagatatctaattatttaaaagaaaggcttatatttaatgcatctatgttttcagggcttgaataaaagtctgtttagcaaggttttctttgatggaattatttgattcatactggaatctctggttcatttttctgtttacagaagtaagttcagattgtagtatattgcacagattgtccaggtaaacctggttaagactttcaggggaacttatttttgctgctattgtgatgtggaaatgctgttactacttcagtaacactgatataatgtatgtacttattaacaagaaatgtgtagatagtagctccagtacttgaagcatcattaaatttgaatgaattttctatttgtaaatatactctgtcataaataccattgaatatatttcactatgtaataaattttaaaatcaaggaagtaataaatcataacatttaattttaagattaagaatattggcaaagatttgtttatttttacctgtctttattcaaatgttctaatatacattagttccaagttctctattacttctaaatagaatatacatgatcaaaagagtatgcctctttctaaatgagaaaaactttatattataaatccagtgatacggatactatccatcattttgttttgtatggcctaatgtatatcagtaaactaaatagacttaaatgtggctggattttgactgggaatatgggaagaacaaagcaggtgagatcatgtatgtgactaaatatagcgttgatgcttaacgatggcctctgagcatgttagtgtaacttatattttgcagccaaaaactgtatgtatcaagctccaaccatctataataaagtttatggttcagttctaagattgctaaccaagtgatttttttttcagagacgttaaagaaaaagtaccttcaaccaataaattcttaaacatttcatcaaatagttattgaacagcactgtgctaggcacgtgggatgtgaaaatcaaagaacacatgaccctacccatagcaactcagtgataacaatgataaaggactatgctagattccacatcgtacctggagtgggggcagaagtggtacataatccagttagggggtgaagtggaaaatccagggcaagtttcgtggaggaagtgatgcctgaaatgtatctcaaataagttagcagagctaaagaaaaaaaaaaaaaaagaaaaaaagagtagaagttaaagggaataaatggaaccgggtgtagaagggtattcagaacagaagaaattatataagcaaagacaaagaagcaagaaatagtatgcatgtttgggttcaggagaagatggtttgactagaaagtttaacattagaaataaaattattcctttacaaaaaaagaaatacttaaaagaatatgttggttttcaaaacagatatagtgatttttgcttagttgcttatacatcttgaaaccaaaactggagttcagctatttattgtgttcattttagcataagcattacaaagtccttctctagttaatcaggttcacactttgcaactaagaaaatagaagtgggccaggcacggtggctcacgcctgtaatcctagcactttgggaggccgaggcaggcggatcatgaggtcggaagatcgagaccatcctggctaacacctcatctctactaaaaatacaaaaaattagccgggcatggtggcaggcgcctatagtcccagctactcaggaggccgaggcaggagaattgcttgaacctgggaggcagaggttgcagtgagccgagatcgtgccactgcgctccagcctgggtggcagagagagactctgtctcaaac

SEQ ID NO: 234291 - DNA, 520 bp, Homo sapiens
atctagaaaatgctcctttaagccttttttgacgaggaggaggggtgcagacacttgcctgcggcaaagtgaacctggaaggagcggggcgtgtgtaggacagagcccaggagaacgggcagccgggtggccgggccaggaagcagggcctttctggccctttccgcagagggctggataattgcctctcctttctaaaaggagccgttttctgggccgggagcggtggccctcgcccataggctcacgctcgtaattccagcaatttgggaggcccaggcaggcggatcatctgaggtcaggagttcgagaccagcctggccaacatggtgaaaccccgtctgtactaaaaaaaatacaaaaattagctgggcgtggtggcgtgcgcctgtgatcccagctactcaggaggttgaggcaggagaatcgcttgaacttgggaggtggaggttgcagtgagccgagatcgcgccaccgcactccagcctgggcaacaagagtgaaactccgtcttaattta

SEQ ID NO: 234292 - DNA, 2355 bp, Homo sapiens
  misc_feature (774)..(774): n is a, c, g, or t
  misc_feature (1026)..(1026): n is a, c, g, or t
ccacacccagtcctaaatgcagaattattaacagcacaataacaaaaaaagatcttagagtcatatttgaccatgagttaaataagaacctttaaaaaaaagttcatatgaccttggcaagtataaatagaaatgtgacatgtaagaactgggagataatccatcagcaatactggatgttggaaaggaacacaatatgagaataccatgtctaattttgttctatgtgtatttagaaatactcaaaagctagacaagggaaaagaaaaagaatgattagatgtgttgattttaaaacactgaggaaacatcttaaataatttgtatttaggaaaatatatggctcatttaaagatttatcatgaaaattatttgaaatcatatgtgtaatgcaattgaaaagaaaaaataattaaaggaagtttcacaaagctgtaggatctatcatattggtaacagacttgatttatactatactagctattaaatttttctataaattatcatttgtgtatgaagattttttttttgacaaagctactaaactagcaattagagaagtctagatagagtatactgttgagttttttcctcaaactttatcagccttagagaagctaagatgctagataatggtaaattggcaaggtaggcacaatcgggtgatgtgcatagagaggaaggagaagatggggcatgagctcccagaattcagatttggttgccaagtaagtagaaaaagactaatgaacccagagacaagaaggagtaagncagcacactataaaaccagtgcagatcgaaagacaatttcagtaacaaggaaagtgttggagaggtagaatcctaagaggatgtgcccagagagggacatttctgaattaggtcttggatataaaatagtttcaatccaagagtggccgcatgtctggatgacagagatgtaggtgagtaatgaggaaactgagagtagaaaggcagttcatcatgtaaggtgttaaagtgttgcggagaaacggttcttanaggttgagccaccacacccggcctatattgttttgaaagcatactctatatatagttacgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaaaaaggaagtgtaatgtcagacacacaagaaaagcaaatcagtgttgtaagcttaaagtacaatctcaaaggtcattaccaacagcagggttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattattcttaataaggaaaattgtattatcac

SEQ ID NO: 234293 - DNA, 470 bp, Homo sapiens
gaggcctcgaactggatgagagagagtgcagggaagagccgcacaggggacggatctcccggaagctccgaggttttccataaaggcttaacaggaagcagctcggtgcttgctgatgactctgagcaaaggtgctcgattaccaggaaaagtctcctatgtggatagagatattctctggcggtttcataagagttaactctcaaattgctgctttattcttttatggctacactgtaaccactttaatagaatcaaatcataccattacactccatgactaaaatatttatcaagtatacggaaattgaaccgaaaaaaaaccctatgacttatacagattattttcttcttttatcataaatagaacatatacgtgaagaaacacaaaacacatatgtacagtctagtggaaacgacctgcgccaacatctgtgtagcggactccaaggccaaggctgtgacatcgc

SEQ ID NO: 234294 - DNA, 447 bp, Homo sapiens
tgcactgccacctcagtgaacccagggcctgcaggaggtgacaaacctctccattcttccacaggttccatgaccgacctcagattgaacgttgggatgagcaataaatatgtaattgcataaaataccagataaggccagcacagtggctcacgcctgtaataccagcactttgagaggccgagacaggaggatccctggaggccaggagtttgagaccagcttgggcaacatcatgcgaccccttctctacaaaaacttaagaagttagccaggtgtggtggctcatagtccttgtggtaggctcttcgcctatagtcctagacactcgggaggctgtgatgggagggctggttgagcccaggagttcaaggttacagtgagctatgatggccccaaggcattccagcctaggtggcagtgtcacagaccaagaccctgtctcta

SEQ ID NO: 234295 - DNA, 1263 bp, Homo sapiens
cccactgaggagccatcattatatcctgtacttcgttgtaatagaagaatgcaaaaggaatgaccactcctggaacacccctccccattggggaggaggtccagcctgtctcagagaatctgaagaaattttactgacctcttattccactgggatcatgaaaatgagggctatgtatcaaggccaggttgaagaagtaagctgataaaggtggtgtcatatgtcagtggtacccctggtgctgattgtgggttgcttgtatcagatttcattggtatgagttgccaaactggaaatgaaaggcattagtaaacatgcattcccaccgtatctgacaatttaacagtattgtggaagcactggccaatgtaattagcaagggagagaaatgaagtatacaatttggaaagtgggaggtcaaatgattttcagatgatgtgtattaaacaaaagagaatcaactgagaaaccatcagagataaggtaattcagtaagtggttgattacaaagtaaacataaaaaacagctttcctataggaaatatcaattaaaaattaactagaagtggtagaaaatcccatttgcaatcattgcttaacacacctatgatagaccttaacagaaataggtaggatgtatatgatggacatggtatagccctgccaagggacatgtagagacacttggagaaagcggaacatacagatggtccccaatttaccagggtttgactttacggtggtggagaagtcatatgcattcagtagaaactattgaaaaaggaaaataaatctcaggacccccaaaccactaagccaaatggaactcactaataaatcttgggaccccaaatatcactaggccacaaggaaattccttgtgaacaaagaacagacagaactcaaagtcctctctttgctcaccatgagacaaatgcttatctgattgcttcctttgccatattgtttcactaagagactaaggcctaagtgactattcctgtaaattgtgttttcagtggaaggcttatcagaaactcaaaagaatgcaacgtttgtctctcatctacctatgacctggatgcccccatccccactttgggtcatcccacctttccagatcgaaccaatgtacaccttacatatatttgttgatgtctcatgtctccctacaatgtatagaaccaccatcaggacctcctgaggctgtgtcacagacacattcttaaccttggcaaaataaactttctgaattgactgaga

SEQ ID NO: 234296 - DNA, 315 bp, Homo sapiens
gcagagtgttgactggtggtgctgcgggttgctgattctcaagagggtgatgtaagctgtgagaatttgatggctggttggcagcctggctttttccctcctggttcccatccatgaaatgaaaaaacactggaatgtaaaaggaaacaaatagtgaaacattgtatttcacaggcacagatgcacacatatcaattatactgttatgctgttccagcataatcgccttcctcatcttcctctgtctcagacatattcaaatttggtcaccacacctgggtgtctgaatgtcttgtccttctaaaggtaactaga

SEQ ID NO: 234297 - DNA, 509 bp, Homo sapiens
caaaaaaaagttgaataccattttatatttgacaatgctctctgtatgattttagtataccaaataagtcaaatacgtctcttttggacttcaggggacctaatacttaaaagttaatgaggtcaaaaatatacttaagtcagaatttgattttggaatgtttgtcaaatatctaacgtttaacacttgatatcacaaaatagaattctaggtcattgtaagtcatttatttagccaaaataataatttaaaatttcaaaaaggcaaaaatctttacttgttaatagagaggagtctcaacttgttaagaccaatacagatagcatgaagccaactgaaactgtcttttctctctcccctgtatttaaatgacaaataaattttttttatttctcaatgttatgaaaatcttatttaaaagagaaagccaaattttaattttgcattagtgtattcttaatgttatactcaatttttaatattttgtaaataaatctgtccaattttaa

SEQ ID NO: 234298 - DNA, 478 bp, Homo sapiens
attggtctcctggaactgtggtaaaggtagctactcaaagatttaatttaagattttctaagtcaaaccaaatgccactactactaaaatataggaactaaagaaaaggagcagcaatatggtaggataaagaataaaaaatgtagagttagcagatttgagatcaagtcctagctctgtaccagaagtagctgtgagatcctaggcaagtcatttagcttctgtgacttgccagtttcctcctcaatacaacagggataatagggccaccctaaagagacatactatttgtagaaatgatttgtaaacttcaagtccaatccagatgcttgtagtggtgatgatgaagatgatggtcaagatataaacattacagaagtcaattattagagagatttaaatttagactctcaatttttttcctacctactcagttcacaaaaactatatatgtaagagtatcgttcttacatgggtt

SEQ ID NO: 234299 - DNA, 522 bp, Homo sapiens
  misc_feature (71)..(71): n is a, c, g, or t
  misc_feature (77)..(77): n is a, c, g, or t
  misc_feature (85)..(85): n is a, c, g, or t
  misc_feature (93)..(93): n is a, c, g, or t
  misc_feature (230)..(230): n is a, c, g, or t
  misc_feature (258)..(258): n is a, c, g, or t
  misc_feature (276)..(276): n is a, c, g, or t
  misc_feature (356)..(356): n is a, c, g, or t
  misc_feature (510)..(510): n is a, c, g, or t
tgactttaaaaggtgaaaacactttttatatacaaccatatttctacaaagctgttatcttctatgatgcntctacnttacccangccactgnaaataaacatgatcttgtcagtcctgaaagtactgaatggattgtgtgactccttggaggaacatgggcagttgttttcttggcattttaagagtgatctgcagtggtcttaagtataatttaccatttgtcttctncccttgtgaatctggttgcacacaattnggaaaccagaggaggtgncctgatattggcatggatacacccaaataaaactttgcaagttgatactaccctttgaggacattgtggagcctacactntcagactcacacaagaccattttataagaatattatatgacatttagttgttatttacagttcagaagtcattttcatcatcatcttacaaaaagattgcctttattttgcagatgaagaattaaggttcttctaggcaaaccttgaacgcagncaaaacaattga

SEQ ID NO: 234300 - DNA, 265 bp, Homo sapiens
cacagttaacctatgttaaccacctcgactgcccttccagtttcctccacactcagccatttgcatatgcacacacatctagcacccggtcaccatgccatctaccactgtggggaccctctcaccagtttattctcatgagagtaaacacactttctgtatctcaatgttttcactgacaatactttccaatattctggaaattttgtagttattgtctttagcattcatgaaatacctgcataacaatgactgtcgttgaccc

SEQ ID NO: 234301 - DNA, 440 bp, Homo sapiens
ggtagacgggcagaaagggatttcaagcatcaccagaggcaccttttccttttgtcttgctatttccaatggcatggctctgtttctcttgaaaccgggtgtgttggaggaacatgggctagggtgtaggactgtggtcagcaacagggcccacatgcaatgcaagttgtgtgcagaaaacctagcattttctaaaatattttagttaaacagtcacttgggttttttttttgtttttttttggaaccattaaatgttatttctttgttgaacagtttccaaaatcgtgacattcatatgacctcctgcatggaaaatgaggtgtaaatagggagtaacccatgcagaatgcttggcacacaggaagtccagctgtcgtcttttcttttttttgttcttatttcttacggcaccagcagcttgtttataacattaaaaga

SEQ ID NO: 234302 - DNA, 787 bp, Homo sapiens
gagagttagaaaagaaacgtttgcgggaagaggaaaaaagaagaagaagagaagaagaaagatgcaaaaaaaaagagacagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgattaagagcacagggatgtggagagatctcaagaacagaatctgaagcacaaagataccatgtggatgacggcaggaggcacagagctcaccacgagcctgaacggctttccagaaggagtgaggatgagcagagatggaggcgaagacaagagagctcattgagaattcgagaagagaagcgagaagaacggaggaggagagagttagaaaagaaacgtttgcgggaagaggaaaaaagaagaagaagagaagaagaaagatgcaaaaaaaaagagacagataa

SEQ ID NO: 234303 - DNA, 733 bp, Homo sapiens
gagagttagaaaagaaacgtttgcgggaagaggaaaaaagaagaagaagagaagaagaaagatgcaaaaaaaaagagacagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtcggcagtgattaagagcacagggatgtggagagatctcaagaacagaatctgaagcacaaagataccatgtggatgacggcaggaggcacagagctcaccacgagcctgaacggctttccagaaggagtgaggatgagcagagatggaggcgaagacaagagagctcattgagaattcgagaagagaagcgagaagaacggaggaggagagagttagaaaagaaacgtttgcgggaagaggaaaaaagaagaagaagagaagaagaaagatgcaaaaaaaaagagacagataa

SEQ ID NO: 234304 - DNA, 2039 bp, Homo sapiens
attataagagtttgtaactgatgataattactgataggttaggtgctgcacaagtggtccacattgcacatgaatccccaaatacttatgtaatctacactgtagttgaatagcagcactattgtgttaccttcttttataacaaagtaattttcaagtggaaatgcaatacttttaaaaccatatagtagaccttctagggtgaactaggtctccatttgttggctgattagggttgtaactactaggtatgagattcttttggtggggaaaaaattagatattatagggtggtaagagaaggcaacaataccttaaataggtttccaggcttcctattttccttggcttggctgctggtctgtcaggcatgtacatgacaagtacttgccctgttgactaagggaatgtcacagtctctttgagactgcgaaggtggaactgagcagacctttccaccttccacccttggccatcgatccttggtaaaaagccaagtgtctgcttattcatgaatacactccttgtgatgattgttggcactaagtgtatattctgtaccagctgctgtttattgattgctgtcttagtagctcaggtatgctacgtgttttagttgactttattttccagttcagctgtaaattttaagatgcaaagctgtttttatttgcattatgatcaagggcattaataatttactttagaaatagaaataatattgtaattatattctaaatgatataaaatacattataaacaatttttgctcttcactctttttggtttcttaaaagatctgatgttgttcatggatggatgttttgtccttttgcattctaaagtctttaggtggctcttttggatatgattcttcttgcaataaattgccaagaaccagggtttcatttctgtacagagcactttttaaaacttttcctttttcctagttactaaactggcattttaacctctttttctccttttagctttgaatctgtctttcttaaacttgtcttttactctttttcttctcatatgtattaataactatagtcagtgttttatatttagtttttagtactcagtgggaggtcatgtaactaattgtcataccagggataaaactaataaggtgctcattttttgtaagtaaaaggaaccactgaagataaaatacggttatagagaagaataatgagttctcatatgattatttacctttttaaattgaccctgaatctgtatgtggaccattgcaaataaacaagtatacattgtatgttgagaaagtactgtgtatcaacatgttttttgtgttcatgcaggtatatatttggttataaagtcagttttataatagtttagaaattgttttatatataaacagattatatataaatgtggactagacagggagggattaatatgaatttctatactagttttcctttacctatatatttataatgacataaagctcagcttatgcagttatacaattttaatttttagattgtaaaaaatttgtcacattttgaatatatatattttgtaaaagctacattgaaagaaattaaaattctgagattttcctaaatcaaatgtaaaaacatacaatctatccattaggattttctatataaacttgatatttctgaatggtcttttactcatttatgctgaaagtactgttttatttctataaacaaattaaaaaacaaactacctggttgtgaaaattttattttaaggtatttagcatttagaattcttgccttccatggggtaaaattttatatattcttttactttttaggactcacatagaaacactctttaagtataggttgtgatgaatattggtgatgtaattgcagagatgacagtgcaaggcaaaggaaatgataagctgggtatggtggcatgtacctgtagtctgagctgtttgggaggctgaggcagggggattatcacttgagtccaggagttcaggttcagcctgggcagtgtggtgagaccccatctcaaaaaaaaaa

SEQ ID NO: 234305 - DNA, 1139 bp, Homo sapiens
tcagagacttatttaaggtacacatgtgattgtacccaataaggaagtatattggctttatataattgttatgatcacttgttcaatgagtaactatagaattttactttttaagagtatgatcatagcatctacttgtaggtttgttgagtatgtttgacaagcccaagatagatgctcatgttagacccattaagaagttggtgtagtgatggttatggaaagcagtaagatagaatttaggttctgttctccttactggagaaatgactagcttacttgtcttcactctctcttgtttctctcaaaactttgtgaaccacctcagctgactataaatttttgtactagtatctccataattttaaaaaagttgttcacaagtttgagtgtagtacttcatctttgctttttaatgcacttccaaaaaatgtaaatctgttctcgcatattaggaacattttgatttgttgtttatttttagctttgctttttataagtaatttatacagaaggtacaccatattcaaaagaagaaaaatgggctgtgaatttttgctgatgtactactctcttcaaagggaattgcctatgttcaggcatagaaatgcaggcagtctgacatttaggtatgccatacagagtattgatatttttaatttgctacttttaacattttgagatttgtcacagtttgttctgtgggtgggtaaaagtaatggtaattttaattacagttgtcgtgcctcattagccattgctaaaacctgccttaccaaatcacttattttcttgatgcagtgttaaatctagcttctatgtccaggttatacattaatgagaacattcacccatctctcaaatgggttattatagtattttctcctgaaatagatgatgcataaaaaaaagtaaaaaagcttcaatagggataatgagagccagataacatagcatggtatatgagttattcctcccgtttttcttacctgtctgcactaagaagggcacccattaaataccataattattagttgtgctgcctctgaagtagagcaccagaatgtgagagtaatacaatgagaccacacccagattctatccataacatactgttcctggtcttattaattttttta

SEQ ID NO: 234306 - DNA, 471 bp, Homo sapiens
ccacccaggctttgggcgttcgctgctcgctttcgagccctccgcagccaggcgtcctggggttggggccaggagaatggggagggccccatccaggcgctccacctctcctccaccttccgccaggcccctcccgcaatccgagatgaaacgctggctgtgtttggagggaggagggagtccctgcctctctttccaagtccgtctggttcctttgcgctgccgtctaggctccaataaggacagaatttcttaacctggtatctgatcaatggacgggccccaggaagcctgtgagtgcctccgcccatttgtggtttcacctgcagttttctgagtgccactatggggaaggggcaccaacttttgtcagattctcaagaggatccgtgacttccctgttacctctgtgtgacgataccacttgctgtcaggtgggtcctttttgtccgagatagacagtgttcttac

SEQ ID NO: 234307 - DNA, 423 bp, Homo sapiens
agttcctggtacaccacatttttttctgaccttccctttgttccagggaatgtgttctgtttttctgtccttgcttactaaagaggcagcattgcacagactctgttagcagactgcctgtagccagtctggctccacttctactagttgtgtgttcgttgacaaatgaagtaaccttatgcagctcaatttcctcgtctgtaaagtgggagtaacaatacaagcccattattccttacctacactcctcgaagttagatgtttcagaatttagaatttttgggactttaaaaaggtaatatgatgcgcatgcctttttatgtaacactcccagaggaatgtggaaacaagtgggataaaaagcctgtctccgtacaggttagaaattcccaccaggtgaatttcagcaccatgcttaagaaa

SEQ ID NO: 234308 - DNA, 491 bp, Homo sapiens
caagtgacattttgcaatatatggagacattttttgttatcactgcttggaggggagtggaatgtgttactactgatataacaggtaaaggccaggactgttgctggccatcctgaaatgcacagcctgtaaataatctcagtgctttgggaagctgaggtgggaggatcacttgagcccaggagtttgaggctacagtgagccatgattgcaccactgcactatagccagggtgacagagcaagaccatgtctcaaaaaagaaaaaaaaaattatggtgtgtgaaacctgccatttaaaaaatactggtaatttttaggctgggcacaatgcctcatgcctgtaatcccaacactttgggaggtagaggctggaagattgcttgagtccaggagttcaagactgcctgtgtaatataatgggaaccctgtgtctaaaaaaaaaaataagtaaaaataaaatactggtaatttttaatacttaggaaaaaa

SEQ ID NO: 234309 - DNA, 439 bp, Homo sapiens
tcagccttggctgattgatattctgggatgaataattctttgttgtggcaagtggccatcctgaaatgcacagcctgtaaataatctcagtgctttgggaagctgaggtgggaggatcacttgagcccaggagtttgaggctacagtgagccatgattgcaccactgcactatagccagggtgacagagcaagaccatgtctcaaaaaagaaaaaaaaaattatggtgtgtgaaacctgccatttaaaaaatactggtaatttttaggctgggcacaatgcctcatgcctgtaatcccaacactttgggaggtagaggctggaagattgcttgagtccaggagttcaagactgcctgtgtaatataatgggaaccctgtgtctaaaaaaaaaaataagtaaaaataaaatactggtaatttttaatacttaggaaaaaa

SEQ ID NO: 234310 - DNA, 390 bp, Homo sapiens
tgtccccattgggcgagacctacctagacaaaggccttaacataccgacaaaggccttaaggggcctgggaggaagtcgtacaaaataaatgtcttctggagatgatttttggaaatggagttattagacagcccctggaagcgatacatccacgtttgttcagtgggttagatgacatggagctggaagacctgagaaggaagagaagaaggttctatgacagactggtcatatttagaagacactttcatattctatccatagttttgtatgcattttattcctcactaccttatatatagttgacaatgctaagcttttttgaaatgtctgtttttttagatgttctgaagtgcctgatatatgttaaaattaaaggtaataaaaac

SEQ ID NO: 234311 - DNA, 466 bp, Homo sapiens
gctcctgagttcaatcgatcttcctgccttggtctcccaaagtgctgggcctacaggcgtgagccaccatccccagcccaatttttgtatattttgtagagacacagtcttgctatgttgtccaggctggtctcaaactcctgggctcaagggatcttcttgccttggcctcccggagcacttaattacaggaatgactgcatgtgctgttgtgcctatactttctggagatacgttgttaggaatttatgtagttggccgggcacggtggctcacgcctgtaatcccagcactctgggatgccgaggcaggtggatcacctgaggtcaggagttcgagaccagcctggtcaacatggtgaaaccctgtctctactaataatactaaaatcagaggttgcttgcagtgagccaagatcataccattgcactgcagcctgggcaacagagcgagactctgtctcaaa

SEQ ID NO: 234312 - DNA, 462 bp, Homo sapiens
ttctgtttaatataggaatttatagctataattttttctctgagcattgttttacccacatcccattgattttggtgtttgtctttattttcattcatctcatcagaaagtatattagaatatattttctcatttcccttttgatttattatttgacccattagttatttagtagtatgttttcatttccacatatgtgtgaatttataagatttctttctgttattgatgcctaattccattcccttgtggtcagacaatatactttttatgattcagtccttttctatatattgaggcttattttatggcctagtatgtggtatatcctggtggaggatgtttcatgtacactgagaaaaatgtatattcttctcttgttggagtattttctaaaagtctagttggtttatagtgttatgcaaatgcattttcgataatgtcattccccttctttttttc

SEQ ID NO: 234313 - DNA, 560 bp, Homo sapiens
tttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttggcagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctccagccagttcagcacgtttacctaggacagctggatctgggggctcatccagaaagagctttattggaagagagaaaggaaatattttggtcttttaagttgaatgatacagtaaaccacttgattcaataaa

SEQ ID NO: 234314 - DNA, 461 bp, Homo sapiens
gggatttttaggctatgttttaccaactttgcttttcattttgagcaaaaaaggaatcccactggataattttgagccaggagaatacatgatctaactttcatttttaaaagagtaccctacctgctgtactaagaatagattgtaaagaaacagggcagggagatccatctaaataggcagtgaataggacctgggtattataagagggtattcaaaaccacatggagattaaagttctggatatgagggatgatgatctgggacacttggatgtcttatagttactcatatgaacggggaaaaatgggtcatgagattagtcttgatcgtctcatctcaaaatatttgaaaaataagctcaaagttaatttaatcatattgagtaaaatccatatggttaaatagaaaatttttactgtactaatgacaaaataagaaagactaatttgtggctgggc

SEQ ID NO: 234315 - DNA, 267 bp, Homo sapiens
agcctgggagtttgaggctacaatgagccatgattggacaactgaactccatcctgagtgacagggcaaggtcctgttcctaaagaaaaaaaggacattggaatcagggtcccctccatcctaaggtggctacaaggcatctctctctgcaaatgagtaaacatcatcctccaactcctcacagagtgaagcagcaggaaaactccctcacctcatttctgtgctacttgggaggcctggacacccaataaccagcaccttgctgat

SEQ ID NO: 234316 - DNA, 509 bp, Homo sapiens
aatagtaaatgatcaaatgctttggagtctgttgctctgtagcccattccctgaatacttccctggccatttttctcatgaaggcaccaggccatattctcatctcctgtgctgtttgcccttttgctaattttttacgtgctggaggcccccacctttgcctgtaccatggctctgtgcttatgaaggacacagcatactaatacttcaaccaacagctgtgcttcctcagtgaagctcaaaacagaaccaacttacttccttatttatagaattagccaatcttctgtgtattttcaccattgtaacatattttcttaccagactttatgctccatgaatacaagaaggtttttagtaatcttagtatttccagaaattataatcgtttcaggtatgttgtgcagacttgataattttttgcctctaaatgaattcacagaagtagcactaaacacataaacagatgttcatgtatattaaatgttctgtggttttaaagactatta

SEQ ID NO: 234317 - DNA, 532 bp, Homo sapiens
ttttgaagtgggaattcattcctaggaaggaaacctgaggcacaaatattgaatctgaagaccgaattattttcttaaattatttggcaataagattttgttctagaggaaggtgaagcaagacggctgaatagaagatttttttctaatgagatgtatttcttatatccttggtatacatgattgctaaaaagaaagaaatttatgatgtcatttgttactaatgtatctaataatatacatcagtggttggcaaacttcttttgtaaaaagccaaatggtaaatatttgcaactttgtcaatcctgtcaataactatcctgtcaataccatctatgtcacaactgctcaactgtgctgttgtagcacaaaactagccataaagaatgagtaagtgaatggacatggctgtgttctaaaaaaactacttgcaaaaacaaataatgggtcagatttgttctgcagattcagtttgccaaccctggtatataccataaattaaatggaaagagctttcagttctggatgcttt

SEQ ID NO: 234318 - DNA, 471 bp, Homo sapiens
catttccttcaaaggaacatgaatcagcttcacccacagtgtctgcatgtctctgtccatagcaaacgtttttattaccttaaaatatagatttttaccttaactagccaagacctaggaccctttttccaagctcttttagatgaagtaataaatgcaaatattagagatgtgtatatgtgtataaatatatggagaaaagatgttgcctagttgtacaaattagctttaataaaactcctgatttaaattatttaattgtgagaagggcgattctaactcaacacgccaacgaaataaaagccttatccctctgctccgccaaaatatcccatttagagcctgcgtgtgtgtgtacacacacgtgtgcactcatccccacctgaccatatcaaattattatttaaactagatatttttactttgttgcatagtagtaatggtttctggaatgaaaaaataaaaaacagg

SEQ ID NO: 234319 - DNA, 700 bp, Homo sapiens
cattatgtcgaatacagagtatagagggagtacaaagttgaataaggaaaattacgcctttccctcaaaaagcatataagtaatttaaaagtacaatagtaagaaatagaccggttcttctattcctagcattcattggctctagaatgaatagtgtttatctgaactcaagaataaaattggaagtaatttaccctttacaaagataagatggagtttaacctaggttttctttttaaaaaaaaaaatcacaacacagtacaatctgagtaatgattttgttcctctagttatgtactctcttcacatacacataaaccaaaaaggcatcttaagcattcaacaaggaatattgacgagtgtctaccatgtgccaactactggtccgtgcgctggggatacagtagtgaaaagttttttggagctttacattccataaaacttttagcccaccccttgggataaaaagtcaaaaaagattttatcttttttggaacaaacttagaagatcaagcaataaaacataattacctttgataacgaattttaaatgtcattgaagaaaggtgcttaattttgaagatacgttgaagaatcttgtctctttcagttttgtttcctgtggcgtgttgcaaaaatggatgttaaaacttttccgtagaacagaaatttcaaatggattaaaaagaaacatttaaaa

SEQ ID NO: 234320 - DNA, 556 bp, Homo sapiens
tgcagagccggccccgctgccccccatttgtgccccttccaagctacggaggctccgggtggctgttggggtggggaacagaaaagccagccaggctcacagatcagacaagccagatctgtcccagggtatatggggaaactgaggcctggagaggagcagcttgcccaggatacttgctggggctccctccactggcccaggctgctgtgggtccatctcagatggtcgttcacttgggacatatttatgtttgtggcccatcaaccagtggagggatgtcagccacgtggtcctggctgtaacagggcggtagtgctggacccctgggtggggtcccaccatgggcgccccagttttctccttgaagtatgaggaatttgcttagttctgctctgtgagtcagtctcctgacccagcatccggcgtgtattcagcggatgggcggggtggtggaagagcaaaccctgccccctccgccccctccaccctcactccctccatccctgcccttcacggaggctgattggtattaaactattcaaacccaaaagga

SEQ ID NO: 234321 - DNA, 388 bp, Homo sapiens
ttttcatgggctctttcagaatgactggtctacagtgagccggagaaaggggtgcagatgggtctgaaaacagcagggccagcggactacgcaggcctcagcagcttcatctgtgggtggggctcacgtttactctacccacccattctgggattagtagctacccagggctttgctgctctggggtgctggtgtctcgcattaggccttctcttgcatgatctctgctgatatccactggccatgcagcctcgagcaggtggggacagacttggtctactccagggcaggtgcccaaagtcacacggcaaaagggcgtggcgggaggtggtaaaaagctgggagcaacagtccatctagcacaaatacacatttgctgcaaaaagcc

SEQ ID NO: 234322 - DNA, 297 bp, Homo sapiens
ttcaaagttacgttattaagtgaaaaagcaaggttaatatcaaagtgttgtgttatcttttgcataataaaaataaaaatctatttgtatttgatttgcataaacaaaatctggaaggataaataagagactactaatgaaaatggttaagtggggagtccgatgtgcaggatgtgggaactggatgggtagggaatgagataagatcaagacttggcaacatcattttggactaaaatgttgagctatgtcaacatattatctttttataaaattaaatgaaataaaagaaaaaac

SEQ ID NO: 234323 - DNA, 412 bp, Homo sapiens
cccagtaatgggatagctaggtcaaatggtatttctagttctagatccttgagggatcgccgcattgtcttccacaatggctgaactagtttacagtcccaccaacagtgtaaaaggcatcttattttcattccagaaaagagtaaaataagtcaccccttactccatgccaagcaacgttacacatgctttccatatatttacttagtactttaaatgttctcatgagatacatagcattgctgtcccctttgacagatgaggattggatgcagagaagaaggcttcttagcttgccaaagccatgtgcctgatgagtggcagggccagactcgaaggggggtgggtccattcccagggcaggtgctcttcattctcctacctggcttttgtcacaggacagcaatgtgga

SEQ ID NO: 234324 - DNA, 750 bp, Homo sapiens
agcgtattataagatgattaaatatgcatagtacaagtatgttatggaaggctgtgttaactgatatagtgggaccacaatagtatgtgtaagtgagatttggaaaatttgatatgccagcaaggacaaagaagtgttgaatttgcaagtttatgcacataattctgagaatccaggcagctatttctccttttgaattgttctcttggctaggggataagggtgagacacaatacacatttgaatgtgtcactgtgtaagttaccactgcaatatcttctgtatgttgaaaaactggtacttatatgtactaatactatctaccatgaaaaaaacaattaaaaatttaaaatatcatgtaaattaaataaagttcaaataccactagccagaaaaaaatattttatattatagtctggggtcagaagaggaaaaccttatgtaaagtatcaaaattaatttttatttcaatttaaatgcaccatcatataacatagtttcataactgaaattacatttgtcagaatttgatcttttcattgttaaagaattgagggaaaattgatggttataatattgatatgcaatgtaaataaactttttttgattgttataggaatgaattgctcaactaattggccaatgtcaaccacatatctgtttccatggaaactgcagcaatattacttcaaatagtttcatttgtgaatgtgataaacaattttcagataaaaaatgtatacatacata

SEQ ID NO: 234325 - DNA, 514 bp, Homo sapiens
agtggaacactccttagcagatgcaaaagaactaaaatcataacaaagtgtctttcagatcgtggcacaatgaaattagaaatcaagattaagaaattaactcaaaaccacacaactattatatatagtaattcaacaaccttctcctgaatggctcttgagtaaaaaatgaaattaaggcacaaatcaagaagttctttgaagctaatgagatcaaagagacaccataccagaatctctgggatgcacttaaggcagtgttaagaggaaattttataacattaaatgcccacatcaaaaatctagaaagacctcaagttagcaacctaatatcacaaaaaaagaactagagaacctacagcaaacgaaccccaaagctagcagaatacaagaaatagccaagatcagaggtgaactgaaggaaaaagagacaaaactatattcaaaagatcaatgaatccaggagttgttttttttttaaattactaaaatagaccagtaactagctaacaaa

SEQ ID NO: 234326 - DNA, 191 bp, Homo sapiens
catgtgtttcgtgcagcattgtcttgggttcaagccagcagcttcctccaatgctcaaagacagacttcaaccaagaactagaaaaactggccgggttgggcttattgagacatgtttatccacaaaagtgctgccttcccaaaggattttcaagagtgatttttgagcttacctccttggactcttccct

SEQ ID NO: 234327 - DNA, 1571 bp, Homo sapiens
  misc_feature (547)..(547): n is a, c, g, or t
gataaatgccccatatatataaaagtgaaaacaatactgtaccaatgaggaagagagttttgtaaaagcaagcaggctggctgtcattaaaagttatcttaaataacttgtcgcagcccactcccaccagtcctgaaaatagttcattcaagtggtaaaataagacaaggcagaggacgatgtctctaacttccctgatgtgagatctaaagccccattcctaactcttggttttagaattgaggaaagtggaataaatgcatttggaaaggatctgttttcttcccaggtttcctgcctgggttgaaaataaggtttcaggggatggaagcaactttgaggaacataaagaggtattggggttcatcaattcatctttgtttcaagatggttcccccccaccctccacaatgcaagttaattaggagataatttagctaccttgtgaattagttttaagataagtatctttttaagctttgtcactttaattgccccactgattgataagaagtagttatttctaattgacacttttttgatgtcnattggaagcatttatttggaactttttgggggtggaaggaaagttaattaattttatcagtctacccccaaaaggactctgcctaattttgttgaagaagacaaaggaagtgaaggaaaccaaataaaaaatcaatctcatggaattttaattattaagggacactttggtttaaattagagggcatctactaatataatacgtcaaaacgttctatttatggcctcaaatctctaatttattgagatgcattttataggtattcattttcctatggatacactcaacggccctttatatgcttccttcattttggagcaggttcctctgctgtgtaaataatttttgtgaaaagtaaaatctgtcaaacttggtatgcccagaaaaaatgaaatcatttttgtaagagccaattgtaagaaagatttactaatagtcatccttgttctgtaattattgatggagttgggtataaaggtgaaactttacttacagtgacttgccttttcatacctaaaccttggagtaaacagtttaatcattcacatcctccagaacattttgctgtgagagagaaaggagtgaaagaataaggagaaaaagaaagacactgaaaggaggcaatgggggtggaaaggaaagaaagggagaaggtagctggagagaataaaatgaaagcattcatttcagaaatgaagatagccaggtgcatggaacctttgccattcaatataagaaaattgaaatcctgctttcaaaatacatttttgttaacaccaaatctctaccacagtctctaagcaacccctaaccaccaagggatacccccagttttctaccccttaaaaaaaaagaggagaattttaggaagctggctgatccggatcttggatatctggctgtcaaagtctttatttggggtccatgaaaaggaagtaagaaaacgcacattgtgctctgggatttataaagagattcgagtgttgtttatgtttattttattattaaagcccctgtgatcttc

SEQ ID NO: 234328 - DNA, 408 bp, Homo sapiens
ggatgaatgtatttccttcctggggtgggggttcagtaggcaaaaagtagggtatttatatcatcaaatgatatgcagttgttagaaataacagaccaaatatacaaaaactatatggacgagacttagaaaacatagttggaatcaaaaaggaagcagaaacacagtttcacttaggtaaattagaaagatacagacaaaggtttttaaggatacaagaagcatgaaccataaaattaaaaattgataaactttaccaaaattaaaaatattggccaagcacattggctcctagtgctttggggggccaagtgggaggatcacttgagcccaggattttgaggctgtagtgggctataattgcactattgtactctaacctggtagacagagtgagaaccagtctca

SEQ ID NO: 234329 - DNA, 195 bp, Homo sapiens
gcatcctgtaagttgtggggcctctgggcagagtggacttcaggttactcggggagctccttgttcctaaatgcagccagaggaccccgtcaggagcagacctcacgcagcaggcgtgggaggctgagggatcaggctaattcccgccgtgacgctgggagagccaggaagggaggaggggtcctgtggcgcctg

SEQ ID NO: 234330 - DNA, 353 bp, Homo sapiens
cttgttttgcaggctggggttgttttggagtcctcaaatgggccatggttttgcttggctggctgacctgcctaagaagacgtttagtctttagaagagtttggtgaaaatcaaggtggttgcagagttaggtggtctcatgccaccttctcaatgggaaaaatgccacagagtgcctttttcccgaaagaatgagactttcttgctctgatgaaacttgtaggactatgagttattttactccttgagttggaaaaggaacctgtgggctgaattcagcccatcccattagcaccacacaatgttttattttaaaaaattgctaacattaaaattttgatagattttgcttt

SEQ ID NO: 234331 - DNA, 213 bp, Homo sapiens
ctgaggctgggtaagatggctcgctgccgtctgtgtttactcagagctccaagctcctgagcacagagattgtcatttctgctgtttttaagtagtctttggtgtaaatgatgttttgttgtgttgatttgtttggaaaagcttgaacaggatcttgagttgggatgcccttctgtgactgatacatacagagagagtgtattccccccaccc

SEQ ID NO: 234332 - DNA, 444 bp, Homo sapiens
tcagatgcggagataaagggagatggtgtggccctcctgcctgggggtgctgagcaggttgctggaggcggtgatctcactctgaaggagacagacacagaaatgtgtgtacagttgatggtgagcatctgagttgcgtcttgttagtgaggccaggagtgcctgtgtaagctggaacagattaggtatatgatttgtgaaacggagtttcatcctagatcttcatctagtcaaaggactgtttcctgattaggcattagcttagtggttgctagtctgtgttgacctttgaaaggcatgactaggctaactctgaagtttctgcttcacaccatttacaatttaaaattacctagagccttgtgggccattggaagagactgaatgtttcactctgaaatgggagtccttggagggttttgagcagaggagagacattcaggt

SEQ ID NO: 234333 - DNA, 321 bp, Homo sapiens
agtagagatggggttttgccatgttggccaggctgatctcgaactcctggcctcaaatgatctacctgcctcggcctcccaaagtactgggattacaggtgtgagccaccgcacccggactgttcagtttttattttgtattttgttttaaaattatttttaaacttgttgatatggcagaaagttttaaagatacaaaggagtttagattatgaaaagaaagttctttcctactattggcccccagccctcagtttccatcataggggtaactactgttcccatttttctgtgtctttccaggaccttctgtgtcaatac

SEQ ID NO: 234334 - DNA, 213 bp, Homo sapiens
ctcatgtgttctgccatgtgaaaataagagaacaacaacaacaaaaaacatgtttccagactgcctgttagctagtattctatgtggcaattcgtttctacaaattgggtgcgcttatataagatttatgtggtggaaatgaatcacagcccaattttctgtgattattctttttctagcagttaagcttgtgatgatataaagttttgcatc

SEQ ID NO: 234335 - DNA, 1177 bp, Homo sapiens
  misc_feature (891)..(891): n is a, c, g, or t
  misc_feature (976)..(976): n is a, c, g, or t
  misc_feature (1002)..(1002): n is a, c, g, or t
  misc_feature (1011)..(1011): n is a, c, g, or t
  misc_feature (1015)..(1015): n is a, c, g, or t
  misc_feature (1020)..(1020): n is a, c, g, or t
  misc_feature (1036)..(1036): n is a, c, g, or t
  misc_feature (1038)..(1038): n is a, c, g, or t
  misc_feature (1049)..(1049): n is a, c, g, or t
  misc_feature (1052)..(1053): n is a, c, g, or t
  misc_feature (1061)..(1061): n is a, c, g, or t
  misc_feature (1074)..(1074): n is a, c, g, or t
  misc_feature (1086)..(1087): n is a, c, g, or t
  misc_feature (1095)..(1095): n is a, c, g, or t
  misc_feature (1098)..(1098): n is a, c, g, or t
  misc_feature (1106)..(1106): n is a, c, g, or t
  misc_feature (1118)..(1118): n is a, c, g, or t
  misc_feature (1129)..(1129): n is a, c, g, or t
  misc_feature (1131)..(1131): n is a, c, g, or t
  misc_feature (1134)..(1134): n is a, c, g, or t
  misc_feature (1136)..(1137): n is a, c, g, or t
  misc_feature (1143)..(1143): n is a, c, g, or t
  misc_feature (1156)..(1156): n is a, c, g, or t
  misc_feature (1158)..(1158): n is a, c, g, or t
  misc_feature (1167)..(1167): n is a, c, g, or t
  misc_feature (1170)..(1170): n is a, c, g, or t
ccttatttttttaatgcagtaatagatatttgaataatagctttactgagatataattcacataccatgcaattcacccatttcagtggtttgtaggatactcagacttgtacgaccatcactacaccagttttagaggctttaatcaccccaaaataaaccctgaaccccttagtcattgtctctaaattcccccacccctcaccccctggaaatcactaatgtccattgtgtctctatggatttgcctatcctgaatatttcatatacggtaaacggaatcaggtaatatgtgatcttttatcactggcatctttcactgagaataatgttttcaaggctcacacacgatgttgaatgcatcagaactttgtttctttttatgggtgaataatattccattgtatgcatagaccacactctgtttctccattcattaatggatgcatgctaggattaccttcacttgctagctcttaggaatagtgctgctgtgaacatttgtgcatgggtttttgtgtggacttacgtttcatttatcttgggcacatacctagagcggaattgctgagtaactcagtgtttaacattttgaggaacagccagactgttttccaaagcagctgtatcatttcacattcccaccagcagcatatgagggttctgatttctccacgttagttagtgtgaagtgatacctcactgtggctttggcttccatttttctgatggctaatgaggttgagcatctttttatgtgcttatttgtaaatagaaatagtttttgtaaatataagtatttgtatttgtaaatatttataatatttgtaaatataaatatttttaagttaaaaatccttgaatttacaataaggtaaatatcaataaagntaacctttggccgggcacagtggctcacacctgtaatcccagcactttgggaggccgaggtgggcggatcacctgaggtcagganttcgagaccagcctgaccaacatggngaaaccccntctntactnaaaatacaaaattagncnggcatggtggnggnngcctgtantcccagctactcnggaggctgaggnnggagaatngcntgaacccnggaggcagaggntgcagtgaccnanatngnnccactncactccagcctgngngacagagcnagnctgtctc

SEQ ID NO: 234336 - DNA, 578 bp, Homo sapiens
gaggctcaagggcataccttttttatcctcaaaggcttaaagacaactgatggcagctggagagggttaagggagatggaggaaatcttcattcaagtttgtcttgctcagtgatcttttaatgtgtctttccagtcttggggtggttgtgtggtctttcagtacagattcaggtggcaggcggttggtggtttggtttaaatcagaggtatgttaaaatattcaggatggtgagggtgtctgtgaaaactaagagaggaagtggcttaaagagctaggctgtcagctgggtgcagtggctcacacctgtcatcctggtgctttgggaggctgaggcaggaggatcacttgaggccaggagtttgagaccatcctgggaaacgtagcaagaccttgtctctacaaaaaattaaaaagaaaaaattagctggacatggtggtgtgcgcttgtggtcccagttactcagtaggctgaggtgggaggatcacttgagcccaggagtttgagattacaatgagttatgatcatgccactgaattccagctttggtgacagagtgagaccctgtctctctcta

SEQ ID NO: 234337 - DNA, 619 bp, Homo sapiens
atttacatcagacacaaacatgtcaatagtttacttttgtccaattaaaaattggaagaaataagaattttaagttaatcatagagatgtaggtcaaattttcttagaattattattctgtggttaataggtatcccataaaaacggtaagagctatgtttgggaacttacagtggcatagtaaaggttctgccaagtcatgggggaacagacttgtttaacttcaacttttaacagattcatttgaccaaccccctctcctcaactcttcttttttcatgaagagtgcctttccacatgtggcactaccggacagtaagtgtttattgagcacctactatgttgctaggcaaactaggtgctggaaatataactgtgagcacattcatcaaaaatttttccccttgcgatgcttaacaacagttatgaaaacctttgtttagatgatctgatcttatgtaagatactttaataacaacataatttttattcaaaaatgtaatctgaagagcttcataagtgaataaacctacaatttctgattgacaatgtttatttacttctcttccacttttttgggggtttgtttcatttttgttgtttagattgttaaaaactg

SEQ ID NO: 234338 - DNA, 716 bp, Homo sapiens
atttacatcagacacaaacatgtcaatagtttacttttgtccaattaaaaattggaagaaataagaattttaagttaatcatagagatgtaggtcaaattttcttagaattattattctgtggttaataggtatcccataaaaacggtaagagctatgtttgggaacttacagtggcatagtaaaggttctgccaagtcatgggggaacagacttgtttaacttcaacttttaacagattcatttgaccaaccccctctcctcaactcttcttttttcatgaagagtgcctttccacatgtggcactaccggacagtaagtgtttattgagcacctactatgttgctaggcaaactaggtgctggaaatataactgtgagcacattcatcaaaaatttttccccttgcgatgcttaacaacagttatgaaaacctttgtttagatgatctgatcttatgtaagatactttaataacaacataatttttattcaaaaatgtaatctggaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctggccgacagagcgagactccgtctcaaaaaaaa

SEQ ID NO: 234339 - DNA, 401 bp, Homo sapiens
caacctgaccagtgtttagcgagagatacccaatgaaatgtgatacaacttgagacgcggtgctcctctcatggagggacctgatagaggcatttccctgcgggactgagccccgctagccaattgcacgtagatgtgttttatgtctaggaacccatatttctctttgaagttttgctttcaatgttgaaatcaattgccccaactttgcaagtggcaggctgtttacatattgggatatttacatattcatacttaacacatctgagagattgctagatcattggccaatcccctagccctagcagaggtgtggtcactcctttaatcggcctgactgatgagaattgtagcttgttctttgaaagaaaactgtgacctcctttccacttatttgtgaa

SEQ ID NO: 234340 - DNA, 1632 bp, Homo sapiens
  misc_feature (949)..(949): n is a, c, g, or t
tcatcaatggatgaatggattttttaaaatgtgatacatacatatatatatacatacatacatatatatatatgcacaatggaataatattcagccataaaaaataatgaaatcttgtcatttgcaacaacatgaataaacctagagacactatgttaagtgaaataaactgagcataggacaaataccacattatctcattcatatgaggaattttaaaaaattgatgtcatagaagtagggagtagaatactggttgccagaggttggagaaagcagagcggcaggggagatagagataaacggttggtcaacaggtacaaagtaagctacacttagataggaggaacaagttctgttgttctattgcacagtaggacgactatagttagtgataatgtatatttcaaaatagctagaagagaggatttttaatgttttcaccacaatgaaatgataatgtttgaggtgaggaatttgctaattaccctgatttgatcattacacaatgtatacatgcattgaaacagtatactccttaagtacatatgattgttatgtcaattaaaaacaaaataaaactaaagaagaaattgctaagggagtaaattccaaatgttctcaccacaaaaataagtatttgaggtgatggatatgacaattagctggattccattattccacattgtattcataaatcataacatcctgtaccccataaatatatacaattataatttgtcaatttacaatttaaaataaaaattaaaaaagaattgatgtttctgtaaataaattagttaattcaaaacatttttaaaattttttctagtcatttaaatatgttaaatgttactgaaattaaaaatttaaatagagttggaagttgaggaagtttaggaaataaaaaacataaagagataaaagacaggagaaactattaacaaanagaagaggagattaagtctaagaggctcactttgtaactaatagaagatttagagaaggccacagagagaactgaggggaggaaactaccaaaaattaattgaagaaaatctcccagaatggaagaatattagtcttcagattgaaagtaccaacagagtccatgcgaaaagttgagaaaatgcccacaccaagttaccttgttgtgaaatcttggaacgctagagataaagagaatctttttttaagtttgtggagaaaaaggagagagaagcatggaagtgggtgaagggagatgaagaaaacagtacacattgaaagaagaggaaaagaagacgatcacagtgacgtcaggctttttaacattatcattgcaagctagaagaaatgagaaaatgccttcaaaattctggaaagtaatattcaatccaaaccaacatgcagtgaatgacatcccctagagcttttcggttttggttcgcatttttaaaacactttgaataaaaatgaccccctagggttttgcagtgcataatctttacaaccatatgcggcaactctactcaattcagtcaaatttgcagtcacatttgaagacagaatacagacatagaaggactcaaaatgtacacatccattcttttctcaggaaggatatgctctagaaaagtgaacagataatcc

SEQ ID NO: 234341 - DNA, 559 bp, Homo sapiens
taggacttttcatagcacagaaaagtctcatgatgtctctcagcccaatattggtttttaaattgagatgataatattttccttgaaagttaaaaaggagattaaattaggaagtatgtgtaacagcacagcatggtaactgaaacagtgggtactaaacgaattggatctttttccgaaacacaagtgtacaaagctgaacaggtaataaatatgctttaccatcattgtttataatgatgaaaatttttccaatacctaaatgacggataacaggggattggccacagaagtgatgtacatgcatagcatggaatatggcagcagccactggcaatcatgacattcactgacttgaacgaacattcacaccttattttattaaaaaaagagagcaaaatctattagcccggcgtggtggtgggtgcctgtagtcccagctactcgggagggtgaggcaggagaatggcgtgtacccaggagatggagcttgcagtgagctgagatcgcgtcactgcactccagcctgggcaacagagtgagactccatcaaaataaa

SEQ ID NO: 234342 - DNA, 392 bp, Homo sapiens
gcaacaagagcgaaactccatctcaaaaaaagaaaaaagaaatataaggtgttcaccatgattctgatttttaaaaattcttttgaaaatatgggtattaatctagaagaaagactgaaaagcacatcaatttataatttttattgtttttaagtttttatattatataatcgaaatgtttaagttcttttggttacaacattcatttttatttattttaggttttcaacaaatacttttggtctttactacagcgtctataaagcagagaagtcattgtcatatttagactgcttaccctagttttgtagagaatacagttctttctcagagagatgtttttaatacaatagctttattcttcaaaggctgagtgtagttgctgcggaagt

SEQ ID NO: 234343 - DNA, 139 bp, Homo sapiens
tctctctttctttctttctttctttctttttctttctttctttttctttctatttctttctttctttctgtctttttttctctctgtttctctctctctttctttcttgctttctttttccttccttccttccttcctt

SEQ ID NO: 234344 - DNA, 516 bp, Homo sapiens
tatccataaaggttatttttatttcctttccaatttaagagtatatttaacattccatcgtagacaatgcggtagtcatgaagtatgtgtgagagaagaaagatggaaggtaatctataatgaaaatcaacacttaaaaggaaaaaggtcttcttccctggcaccctttagtcatttgcaacattttacaagacaatgtaggtaaggaaaaggctaatctgtaatcggagaaacaaaggttacacctgctgactttacaactgtctgcttatgagatttagttcacattccctttaagctcaaaatattttaaagttccagcagcttaaattttgaattacttattttcacagctgacatattagctacaacaaagcaaacaacataaacagtattaggtccctgtttttgaattggctttgaagtttacttacatcatctaatacctctattgtagagcaaatttaggtttcatggggtccagagattacacagttttaggattctcttatgaaa

SEQ ID NO: 234345 - DNA, 389 bp, Homo sapiens
tgttttccaggcttttttcagctaactgtgtcagcttctttagctgggcccaggtcggcggccccactttcttggtggatggcaacttcatctgttcttctgatatcactattttgttcaccctgcgagtcgatgatgttcgattgcgggttctctgtctctgcggaggtgccttcccttgcacctctgatgggttcattgtagaacttcaaatgtctagtgggtaaccaaacaggaagctgattttctgctgttggaacacaagcaaaacctcacccccatgttatcaccttacctatttcccatgttttatttttgttgtctttccaccaaatcagttttccctcatgtgggctgttctttttaccagtaaaatgttgttctgcaga

SEQ ID NO: 234346 - DNA, 419 bp, Homo sapiens
gcgtcactcatctgacttctagaagtttcctggcagatttagttttgaaaggtcacttttttttcctgattgtaatagtaataataatataatgactcatgtttattgaaagcttattctttgccagacacagtcctagtattttatatatactgacacatttaatctcacaacaacccttatgaattaggggctattgatattttcattttacaaagaaggaaattaagacaaaggtgatttcaaactggcttaaatcacacaactattgagtaatgtacatttacagaaaatttgaacactgtggaaaaatacaaaattaaataaaaaatcacccatcatttcatcattaatttcttttgtatatatgtttagccatcattttattttaaaataaaaactctaacatactctacata

SEQ ID NO: 234347 - DNA, 427 bp, Homo sapiens
aaaccccgtctctactaaaatacaaaaaattagccgggggtggcggtgtgcaccttgtagtcccagctactcaggaggctgaggcaggagaattgcttgaacccaggaggcagaggttgcagtgagctgagatcgcgtcactgcactccagcctgggtggcagagcaagactccgtctcaaaaaaaaaaaaaatacgaaaaacaaaaaacataatctggattgcagggctgatcgttgctaatggagtgttatggctgttcagatgacagagggagaaaatgtactttgtaaactgttagttcaatgaggttatgattgcacaacaatgtgaacatacttaatgccactgaactttattgccattgataacttttaaatggtaaattttgtgtattattttgtcacaataaaaagtttgaaaatcga

SEQ ID NO: 234348 - DNA, 329 bp, Homo sapiens
ctcactagccaaactgacattcacttagctcccaagctctctcaattcagacaccctgcctgctgtattctcccccagctcttgcatacctgactcttaatcaccttttagatttcagttttaaaatcatcccctcagtgaggtcttccttgacttacaaatctacagtagagtattccctctcacacatcctgtttatatcctttgtaacacaaaccacaacctgtaattatgtcaacatgtgtttttttctcttaaataaaagtgccaagaacaaagggtccgtagccatcttgcttgtcactgtgttcccacagcccactactgtg

SEQ ID NO: 234349 - DNA, 504 bp, Homo sapiens
tcagtatataagctctcacctctaactatgtgaaggagtttcttcctccacttccctgtcaaagttgcatatttctctttgactattttaagcgacaggatgcttgagaccaggtaactcgtttctttttacctctaaatgtagaaagttcttccattcagtgaaacgaagtcagccaccctaccctttgatctgaggactctttgtccctttggttctctcctgcagctgtgcattttcagctttcatattcctcatagacaccagctccgggacacccatcctgggtgcctgtcttcttgcgtcaggaccacaggcaaaactagccacacctaattgaatacgttattccaggtggtatttgcctagggcgtatacacagcattcatatttcttgtgatcaggatagtcacattaattcagtttctgttagttcatcccctttcagaagctgtttgctcttggctcattaaacctgtgagcaaccgaatccctcaaatatca

SEQ ID NO: 234350 - DNA, 332 bp, Homo sapiens
atcacttgaagcacatgctgataacccataaacagtgcaaatggtcaggcaccatggcttaaatgcctgcaatctcaactgtttgggaggccaaggcaagaggatttcttgaggccaggagtttccaggcaagcctagggaacatagcaagactgcctctacagaaaaataaaaaaatgtttgctgggcgtggtggtgcacacctgtggtcccagctacttgggaggccgaggtgggagggttgcttgagcttgagaggtcaaagctgcagtgagccatgatcatgccattgtactccagactgggtgacagagtgagaccctgtctctttt

SEQ ID NO: 234351 - DNA, 445 bp, Homo sapiens
ctctttagaaatggaaaagtcctggaaatatcatgctgcgtgtagttgtgattatggagacactccaggaaaagcagacatctctactgggaatagtcaggtgcagaagttcagaggtcttagaaattatataggcattgtatcctttaaaaggccttgctgttttgagtacctgggagttatactactgctaaaataaattacataaagtacagggcttggtggacttgatgggacttcataacagaggcattctgtctgtgatccacagagagctctgtctgctgtgtattattcatataaaccaattgtaaagttgaaaaatcaggggacaggcgtggtggctcatacctttagtcccagaactttgggaggccaaggtgggaggattgcttgagcccagaagttcaagagcaatctgggcaacatagtgagactttgtctc

SEQ ID NO: 234352 - DNA, 306 bp, Homo sapiens
gagttcaaagttaggaaatgatctgagctacaagcaaaatcctataaatacgatgggaaactgtgaactaatttggctcccattttcaatggtagtgtctacattttctcctttcttttatgtactttagacagtttatcggaaagtcgcccatgtcaaatttgtaattaagtgagataagacaaaaatggtatcttttatttttgaatctctagaagcctagcagttcctggaacaaatgtttaatgtttaaatgtgttaaaaacttttcaggtcacaaactctgtaaccagtatgagactactg

SEQ ID NO: 234353 - DNA, 351 bp, Homo sapiens
ccctgaattttttttagtccgtgagataagatatttatttaatgtgtttatttggagcctgaaataaacctcacactgggagcctgggtggaatacaggaagggaaggcaaggaaaagtcacagagagctcagacagccagcacctgtgaaacgcatggtatgaggtttccaaaccagtgacaagtgtggttttcaattagccgggcgtggtggtatgtgcctgtaatcctagctactcaggaggctgaggcacgagaatcgcttcaacctgggaggtggagattgtagtgagcagagattgcgccactgcactccagcctgggcaacagagcgagactccatctcaaaaa

SEQ ID NO: 234354 - DNA, 385 bp, Homo sapiens
ctttgtcatgtatattaattcaaaatatcttttcccacattgtgacttgttattcaatcttataatatatatttttgttttaatttttatttaatagggttttagatttttagaaaaattgtgaagagattacagataattaccatagacctacacccaattcctcctgttattaacatcttgcattaatatgtattctgatattattgtatggatgattcacaaatgtcaattaaaacaaactgcttgatagtgctgttcaaataaactatattcttgttgattatctgtctgcttgatatatcaattaccaaaagaagtatgttaatgttttaaactataatagtgaatctgcctatttcttatttccattttacctcatgaa

SEQ ID NO: 234355 - DNA, 549 bp, Homo sapiens
acaaaattcaagcacttattttccttgcacaattcagggcctgctgtcttctttgaaaactcagtggcgcccctactgtgggcagcacaaatgtagcaagatcaggtttggagaggagcatccctgtactctccagggaagagtgtccagtgtctggaggcaaatcactgtgactgttttttgtccccctgccctttcctgggacacttccccagggcagcttttccatgtgtgaagagccctgcagtagcaggcacttggctggctcttttctgtggtgggcacagattggatgggagtaacctgtcctgaaccagctcctagagcagacccccagctccgggtaggcacaggtgcccagacatgagggtctgcatatgagggtgatgttgtgtgggtccagctttccaggggaagcagaattggggcccaagttcataaagaatcccacccccacaccagtgcccagggtggggatgcaggccaaggggctgaccacgggtgctgggagagttcttccatgctgaattttcagcctttgtttggata

SEQ ID NO: 234356 - DNA, 563 bp, Homo sapiens
tcagcctcccacatagctggaattaccggcatgtgccaccaggcccagctaatgttttgtacttttagtagagatggcgtttcaccatgttggcaaggctggtctcaaactcctgacctcaagtgatctcccgccttagcctcccaaagtgctggcattacaggcgtgagccactgcgcccagccctaatatgtgctgattgtataaaacctggatagccttaaaatatattacatatatggatattatttatattatgtcaatatattaacatgttttaatatatacacatatataaagatatttgtggtagccttacatacatactttacactccgttaattaaagggaaagagttttaaaatattttaaagtggactttcagaatcctggtgcaacactgtattagtagatacaaccttaagaatcgatgacaaattctgataatacttttgacttcaaagtaaaaatgatgcttttaaaaatggatgtatccatgctaggaattttcctttgacagagtatatcatgctcagaatttactctaataaagaaatgtcaga

SEQ ID NO: 234357 - DNA, 110 bp, Homo sapiens
gctctccccactgccccagcacactgtaaactcccagggcccacccggctctcaactgtggttttgagggcagtttcaacaatgctcccagtgcgggtttgtggccaggc

SEQ ID NO: 234358 - DNA, 465 bp, Homo sapiens
ccagaaataaccaaaaggcattcaagagagcctagtagctcatttggaaaggaaagctagattcagagatgacacaaaacagcccaaaaatgtggctgctgaatcaaaaacaaaaattcggatgaaataaaaacttttttgctaatgtgcttactctggtagacacataaataaaaagttcttctactggccacgtgtggtggctcacgcctataatcctagcactttgggaggccaagacgggcggatcacctgaggtcgggaatttgaccaacatggagaaaccccatctctactgaaaatacaaaattagccgggcgtggtggcaggtgcctgtaatcccagctacttgggaggctgaggcaggagaatcgcttgaacccgggaggcagaggttgcagtgagtcgagatggtgccattgcactccagcctggacaacaagagcgaaactgtctccaaaaaaa

SEQ ID NO: 234359 - DNA, 352 bp, Homo sapiens
cctcttgcttctcacctccttccccttcaaaaataaccagttttgaaataattaaatcaagtatatactaatcagcaactagtcatcttggaggagttattagaaaataattcctttcatacttggctgagtcactctattttctagtcatacattgagtcactatcttctttaagccatcttgaatgaatgcttctgtgtgttggtggcagctgccacttaaagatgcatttcttctggccatcccctttttcacagtaactgtgtaaaggctagtatccctcagtcgaaggagccattggaatgggattaagggcacagcagaggcttaggggtagtggacaagaacaag

SEQ ID NO: 234360 - DNA, 821 bp, Homo sapiens
ctgaattgttgaatgaatcaccctctttctcctcagcatttacaaatacctgaaacacgtgtctatatcctccccatcatctctgtaactcatacttgtcttttcagtctcagagtagaaatgaagtgttccctgacgcctctttccccatgcccacccaaacatgagcaagacctcttctgtcagttcccacaaaattcttaatgtacccgatttcagcacttagcccactgcattataatggctcatctactagcttatctgagtctcccactgggctctgcaaaaagcttctgcctacctctttccatgctatagtcctgtcagagaacacaatgctcagtaaataacgttctgttgagatggatccctaaagtgttaaatatttaaagtctttattaatttgaaggacctctgaagagaaaacgaactgtaaaaatcaaaataatcttaatttttaaaaacagacataagctaaaggagacccaaatatgaaatacttttataaaacaaacaacaatatctatacatgataaacagggacatgaaaagatggttgcaggagcattagtggtgattattataggatgggaagctaggatgggttcacagaaaaaaaaaatccccagtttactctgtatgtcagggtaaattccaagtggatcaaacaattacatatgaaatatgaaaccattcaagcctagaataagctaggaatcgggggaaaattttctgattcaacatccagaagcaatgatgaaaaccttgatgatttgattatgttaaaaaattttttgcatggaaaaaaaccttgagcaaaa

SEQ ID NO: 234361 - DNA, 401 bp, Homo sapiens
  misc_feature (72)..(72): n is a, c, g, or t
agggagaacagcagcagccagagagcctggaaagcgtgcatattttgtaaagggagttcaccgataaaagcntaattctccagacttggaatatgagaataaggacttaactaacattgagtattgagtgcatgctcttttgcaggctccactgtaatagctcttgtcctcttcttataagagtcacctaagaagctgacccaggaaagtagccctttgacagcatcacagcacgagacacaggtaacagcatagagtttaactctctagaatcctaatgttttttgcaatagatgtcatgcaggtttccagacaagttttgagaaaaaatatgtgttgaaccctttaaaagtttctattctttccagtattctcttcacctgcagatacattcccaacca

SEQ ID NO: 234362 - DNA, 870 bp, Homo sapiens
gcaccgagagtctgctttgtgaattgtatcaatgatgccactgacctccctgattctgcaggccgtcatcatttttcatttttaatcaccattgctattactgtgatcggcagcaagtgaggcagaagaaaagcatttctttgtcaacttcctagagatgctttgcaatggcttactggaccagggattttgttttttaaggcaaaggtaatgaaggcctagaggaagaaagtggctcattcaaagaaaccccaaaattagggagagtcccaaagctcactgctcagcccagtccaaactccagaccaccaacctagactaagccccctcaaggcaaaatgtatctagagttaagacaggccatccactgagactacacaggggagagaatccccaggcaccaggaaggctcccaggattaccgaggggttaaacccagaacctcctgctggatgctggagccaaagagagtttctattactgtgggaggcccaaatgctctgccaactgccacacccagcaacactacccagctatctcccacacgtccgcacagcccgaccacttcagctgcccattctgcccccaaccctgtgctggttactaaccccacacagaaaagccagaaggagaagaatgcaaaaaagagaacaatcgtttgggagattctgaatggagacgtctgaggattccccggcggaataaggaaaatggtgttcgtgggaaggaaggaggatgggggaaggctggagggagggtctgtgccccttgctgtcaggaagttttcctttatatttagccttctcttttcatgtattttttgaggccctcgactaaaaaattaaatttaattttaaaaaataacaatga

SEQ ID NO: 234363 - DNA, 660 bp, Homo sapiens
  misc_feature (116)..(116): n is a, c, g, or t
  misc_feature (174)..(174): n is a, c, g, or t
  misc_feature (179)..(179): n is a, c, g, or t
  misc_feature (186)..(186): n is a, c, g, or t
aaaactgggtttatgaaccaattatcaagttcttaaaggagtcttgggccttcactaaccagacaggactggtagatttaaaaaggttgtgaccaaattcaccaatcaaaacccanaagggtaccaagcaaacctcatagcaagatgcactgagagaaaattaaactatggganaaccnccttaantgagatggactctcgctctatggcccaggctagagtgcagtggcgcgatctcggctcagtgcaacctctacctcacaggttcaagcaattctcctgcctcagaaaataaaagacaggaaaaaaagagaaatggagaaacagaaaaaaataaaaaataaaaaaaaataaaagagggcatggagaaacagaccaggaggagggccatccgaaaagaaggaaacccagagagagaacagggccagaagacaggagacccaaatcgaggcaatctacagagacacattccctcttacaaaatggagaaataagtcaggcccagtggctcacacttataatcccagctctttggaaggccgaggcaggcggatcatttgaggtcaggagttcgagaccagcctggccaacgtggtgaaaccccatctccacaaaaaagtacaaaaattagccagacatggtagcacatgtctgtaatcc

SEQ ID NO: 234364 - DNA, 683 bp, Homo sapiens
  misc_feature (13)..(13): n is a, c, g, or t
aaaaaaataatanattattaaaatttaatttaaattaatatgtgtagaagttaaaatctaggatagctaactggtaagctggtcacctggaagcaacgcatcagttagccactgaaaaggggtaatatttattgacatactttggaaaagactggatgagttgctctgcgacttcccactctaacatatgtttctctgagtttctacaacttcagctaaatgttttaaggaagaaaagaacaacagaatatgtgataattttgattgattgatgctccctcctatagcagcatacaaattttagagtgggagaaaaatctattacgatttcaatgaaatgagctattttatcttgtccctatgtggtaccatcaacattttagacagatgaacaccaaaccattgactgaattgctgcatagtggatttgccttgattataaagacagttgaatgaccagggtacctctggcaattttggcaatcaataagtaacatgaatcaactatgtagtggtcagactggctacccagtgctcaatcaaaacagaaaataacagagataagttaatccttaggttgcaggactataccatgataccagcataaaactcaaatggacattcatgatgaaaaaatgttaatgctatcattatacaataaactgctaaaagtatttttatta

SEQ ID NO: 234365 - DNA, 496 bp, Homo sapiens
aaataaagtgtgaccaaaggattttatgtcagccaaactgtccttcaaaattaaagctctagagaaatagttttaaatagctaagaactcaatgaacactgtgtttccaggcccaaacccactacaaaagaatcttcctcaagccaagagaccactgggaaatttgacataaacaaaaataacaaatctgttgagcacagactaaaagagaaagtgagggtaaggatggaggtgggctgtgaaacagcttcttatcgggaagcatgctgttctgcaaaagtaaaaatacagcaaataaatcagaggtagatgaatcagaaaaaaaggaatgtagaataagctcatagactgaagcatgaaaaataggtgggagaaaagaatcccaccagacaagccaaaataaagaggtcagaggaagaaacaagggactaagggtgcaatgagaggtgttatttataacagtagccagcagaacaaaacacagaccttcctaaat

SEQ ID NO: 234366 - DNA, 631 bp, Homo sapiens
aagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttatt

SEQ ID NO: 234367 - DNA, 1358 bp, Homo sapiens
  misc_feature (873)..(873): n is a, c, g, or t
aagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttattcaaaaaaaaaaaaaaaaaaaaaaaaaaaaatgtgtgtgtggggcgcgcccggggccccgcggagagaagagtttttagagaaccatttgcggtggggggcgggggccccaagagaaggtatagagggaacaagtggggccaaagaggtgtgtttcccaagagagaagaactcgggggccagagtgacacagaggggcgggggaattctctctcacaccaatatataaaaacacgccgcgggngggggacacaacggagagagggttctctgtgaaaacaaatctccagagagagggagagttctcgggagaggccaaatccgaggggagactctatttcacaacgggggagagcccagagagggaaccctggaaataatcaaaatagccccccgagccgtgggggtgaaacgctaaacagagaagaaaaaataaacaaagagaaaaaaaaacagaaaacgacggagaaagaaaaaaaaagagaaaagaaaaatcaaatataacaaaaaaagaagacaaaaaaaagaagaacacaaagaacaagaacgaggcacagacagcagacgagaccagagaaaagcgaacatacacaaacagcagaagaaagaaagaaaggaaaaaagggcggaaacgcaaaaaaaaaaaaggaaagcacaagcgaacacacgacaaggaaagagaaggaagaacgaaagcgagcagaggagcgaaagggagacggaggaaaa

SEQ ID NO: 234368 - DNA, 456 bp, Homo sapiens
agaagttctgcgtgtgtttccttcagcattcagccaagcaccttacagctccatcttagccttcacttcctgcttcagcagaggctcaaggttggccagaggtgagagccagggtcttcttggatatttcctgggcacacacacagcactgggtgtccacacagccctaaacatttgtatggctttctatattcccaggaatattgttagaactttttaaagcgcccactctctccaaggacatcccattcctctgctttttcttttatgttttttggttagcacattgtctatcccacttgttatccactacctcagtcagctgtgaggttcaataattgaccctactctcaaggctgcttttatttgtgctggatgagctctaagtcagctcaaataaaaacagccttgcaagtagtgtgaccagagaggtcaaataatgacaattctccgaga

SEQ ID NO: 234369 - DNA, 424 bp, Homo sapiens
tctcgacctcctgacctcaagtgatccacccacctcggcctcccacagtgttgggattgcaggcatgagccaccttgcccgttggtctttaacttttcttaccatacagagattgggggtgattgggctacttttttattagtgatttctgactcaattgcattgtggtctgaaaacatgagtctatatgaggttgttgaaacctgctctctggcctgatacggtcagattttgtaaatgatgtatgtgtgcttgaagaaaatgtctgttccctaattgctgggtttaaggttctaactatatgcattagggctgggcatggtggctcacacctgtaatcccagcactttgggaggctgaggcaggtgaattacctgaggtcaggagttcaaggccagcctggccaacatggcgaaacccagtc

SEQ ID NO: 234370 - DNA, 166 bp, Homo sapiens
gacgatgggacagaatttttgaaatcaaggctgtccgaggaaacccaggacatatggttgccataaccaatcattactgtgcacacagggggcatggtttgatccacaaacaaccaaagccaggattcaggcagacaatttatatcaacgcttgactgcatatgtg

SEQ ID NO: 234371 - DNA, 992 bp, Homo sapiens
gcagggagaagggctatagcaggagccaatggtccctcagttgagggggtatgacatcgcgcccaccccaccgagagctctggggtctggcttgagacccagggccagtactgacacatattcggagtgaagtcttgggcaagttattttgccttctacattctaagtgctctcatttctcaaatgggtacaacccaaatagatctggggaccctaccagtctactatcaaccctgtgttgcactcaacaagacatagccattaatcaaaaataatatgagagtaatttgtctttacttgtttatatccaagagtgttaaggatttttaacccacagcaacacttcttaatgtctctttagtagcagggagtggctagggccccttgcatgttaatacattttgtcccagtcttatgggatttgtaatcgcggccttacctccttcttgcagggctgttatgagatttaagtgaagccctagggttacagggctgtcctgtaaggcactgtcccgatgaaagatgaaaggggctagtgttattatctgatgacattttttttttaaaggcagggtcttgctctatcacccaggctggagtacagtagtgcaatcatgtcttactgcagcctcaacctcctgggctcaagtgatccccccacctcagcctcccaagtagctggtactacaggcacacaccaccaagcccagctcatattttttattttttgtagagatggtagctcactatgttgttcaggctaatcttgaactcttggcctcaagctgtcctcctgcttcagcctcccaaagcactgggattgcatgagcccagcctttgatgtcgtctcttattcctcaaagattctgcacagtctgtgattttgttacatttccacaacaaccgtgtgcagagggtatgatgttttgctagatgggcagagatgtttaaaataataaaatattgacacccagcatgggctaggacgcaga

SEQ ID NO: 234372 - DNA, 464 bp, Homo sapiens
agccacaaggtcaaggtgacataacaatgcaaccttatgaccatcttaaattgtccaaacaagagatatcacatatattgtttcacctagtacatttaaatgcaaagtggtcaatgcatttgaggttggtgagttctgcaggggcagacatgaagcatttttgaagtctctgaagttccctaaaattactcatcagtatgcaaagaatgacttaaaacattgagctgtgaagcagcaatgacaaggatcattcctgatagaaaaagtccatattagacaaataatgtgtagacatgtctcccatatgctggctagaggaaccattaggggcgctacaaaaggcagatatttttctaccatgaacaatgtaacagacaagaatcatgagtccatgtcaagccttaaacaaaactccttcttggattaaatgacctaatggattcccagaataaaaacgaaacagg

SEQ ID NO: 234373 - DNA, 791 bp, Homo sapiens
gatacttctcctgaaatgtgacagatattacattaatcagtagagaaagagtgaactcattaataaatgacactgggtcatacctggttaaatggaaaaaaattcattccataacacataattcacagaaagtactcaacagattaaaaatctaaaaatgaagagtagaacttcaaaagaaaatataggagaacatatttatgactttgacataggaaggtttgttaacacatagagtaaaccagaaaggaagagattaagttttaaaacttctgttcaagaaaagacaccatagttataagggaagcacaaatgaatgaagttggaaccatgtaccatatccgaaaattaactcaaaatggatcaaagacaatgtaagatctaaagctataaaactcttggaagaaaacaggtctgaatcttcaatttggcaaaggatgcttagataatgccaaaagcacaagctataaaagaaaaagtagataatttggacttcttcaaaattaaaaactgtgtttcaaaggacaccatcaagaaagcaaaagacagcctacagaaagggaaaaaatatttgcaaatgatatttctgataagagtagtattcagtgtatataacaaaaagataacccaatttaaaaatgggcaaaggatttgaatagatatttctccaatgaagatatataaatggccaacatggtacattaaaaaatgctcaacatcattagaaattagagaaatgcaaatcaaaacctctatgaagcctgagcaacatagtgagaccctgtctttac

SEQ ID NO: 234374 - DNA, 239 bp, Homo sapiens
aatcatttactaatatatctcattttattccaacactgctgcttgcatttctttccaagcatagagaagaaatccaaatacaaagtactacacataatacagtgcaacaaaaatgaggtaggggcgtcccactcattaaacaattgctgacttgaaaatgtcccaattttataaaatgtatcaagagaccgacactttgcattgtattttattcctctatgtcagttaacaattaatta

SEQ ID NO: 234375 - DNA, 377 bp, Homo sapiens
ctttcaagttatgacagtcattcacgactgtcaaatataatggcattttagacatcatccaggaatcgttaacaggttccaagtgccttggcacaaagagtttacaaaaacattctgagctttgttaagaagacacttctgacccaccttcaataggattcactttttgtgttatctttctatcaatggtaatagaaaagccgatatccttagttgtctggtacctgaaaaacaggatatatccacaaaagcacttgagtttgctctccttcctcaagcaaaacttgccaaattttaaaatggtgaaatgagaagaagaagaaatttggttttgagttgaattttccctatcttaattacagaaggtaagtattctg

SEQ ID NO: 234376 - DNA, 479 bp, Homo sapiens
tttgttctctgtctttgctgtggcctctgcctggaatccacgctttagttggagcttgtcaggccttttctcatcctttaaggctcagtgcgagggcagcctcatcctcggagcccttcctgaagccccagagagccccagccccttcctcttggcaccgtctcagtctctgaggtttttggttttctcctgctggctctgtcctgtcagcctcacagtgagctccggaggggagctcacagtcacccaccccgaaccccaggactgtgtcttacctttccttccccctccctgcccactggatgctgggagctgctcactgcatgcatggataactgaagctatttgtactcttaaagggaggaggtgcaggccaggcacagtggctcatgcctataatcctagcactttgagaaaccttgcttgagctccagagtttgagaccagtctggacaacagagtggaaccctgtctctaca

SEQ ID NO: 234377 - DNA, 506 bp, Homo sapiens
ccattatcagtatttctcggttcttttggggacaatggtgctcacctctaagttttactgctcagtgtacatctctcactttctaagcaaatctcttcattaggctcttactacaattcatggagaaaggaataagagctagcacagaggaggtgctcagtaattatttattgattaaatgaatgaatgactagattcctgctaagccccctcctatttcagagagcaagtgtaagaaacttccattgcctctctaaggactgtccttgtcagaagctaccctaaaattgtaggcctttcctctctccacccagcactccaagtcataatttgctttccaggatggtgtgtctctgctgtagcctgggatagaatggggcggcagaggtccccctttaccccgctttgtgcattgcatgctctcaaagtctggcacattaagctatacagatatatgcaaatttatatactgaagtcctggtataaattatagctctgtaagaata

SEQ ID NO: 234378 - DNA, 420 bp, Homo sapiens
gttacagaataaatattgacagttcttagttgaaaatgacatctgaggctgggcttggtggctcacgcctataatcccagcactttgggaggccaaggcgggtggatcacaaggtcaggagatggagatcatcctggctaacacaatgaaaaatctgaaaaatacaaaatttttcagaaattctgaaaaatacaaaaaattagccagacatggtggcacgtgcctgtagtccaagctactcgggaggctgagacaggagaatcccttaaactcgggaggtggaggttgcagtgagccgagaccacaccactgcactcaggcctgggcaagagagcaagactctgcctccaaaacaaacaaacaaacaaacaaacaaaaaacccaccaaaccaggactttttgaactcagctctgaaccaa

SEQ ID NO: 234379 - DNA, 335 bp, Homo sapiens
tggtcaagacagagtatgttgctcaagtatgcccagtatgttgcctaggctggtcctgaactcttgacctcaagtgatccttccatctcagccacctaaagagttgggattacaagcatgagccactgcccccagctatatgcactcatattcgactattactcttctttcaaccttctgtcattttttccttccttgagagaacctcacaccaattaatttcattcctctgtgctccttacatcaccaacataccacaccttgctctatacctgaatcaccactctgtattctatgttatagcaaaatcccctttctgtctttatgtccttggg

SEQ ID NO: 234380 - DNA, 442 bp, Homo sapiens
  misc_feature (335)..(335): n is a, c, g, or t
  misc_feature (398)..(398): n is a, c, g, or t
  misc_feature (404)..(404): n is a, c, g, or t
tgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttgttgaaagtaaagatggaactcaatgtggagaaacatctanccagattcaagatagtattgtgaccaagaacactcttcctggagtaggtccttgtgaaagcantatganaggagaaatcgtcatgggtcattcatcccttaattgtt

SEQ ID NO: 234381 - DNA, 232 bp, Homo sapiens
tttatgaaaagataacctgtcttctaacctgcttggatggctggtagtcaaatgtgaacgaacacctaccgtgtgcctggccatgttctatgttctaggctgcagcaatcaacaagatggccatacaacacccacccggtgaagttcaagtccagtagctgttagcttaagaaagagtattcccttatcccactacaccttaaaatgtatttgctgtcctgcagcgttggct

SEQ ID NO: 234382 - DNA, 370 bp, Homo sapiens
caattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgcca

SEQ ID NO: 234383 - DNA, 439 bp, Homo sapiens
ttaaaatgaacaagtgtatgatttggtgtaaaatgaaaaatcagcccaaattgcaagccaagccgccggtggttatgaatggctgctgtgactccgccccaaggttccccaggacttctggatttatgtacttctcttccagtggggcacacagtggagagagtttgagacaacactgctgagagaattgccacatgggcgctggctgcacagacccaaacctcacagagtgaaaggggactttcctcacagagtgaaagtcgcagctttcccgagcccagggaagccccccagagaggggctgtagtgggggctgggcagttctaggagcctccactgccctgggccacccctccgccgccagagccacgacccctgcagccgcctgtggcaggtcgtcattggtgccctggtggagcagccctaggaagggcggccg

SEQ ID NO: 234384 - DNA, 366 bp, Homo sapiens
ggaggcagaggttgcagggagctgagatcatgtcattgcactccagcctgggtgacaagagcaaatctccgtctcaaaaaaaaaaaaattccagggtaatctgagatcttggtatttagagacatttggttgggatgaggggtcttggtagatttgattctgttatcatttggaaccttccaaagtagaggatgacgcatttgtttttgagctactttctagaaaccagaatttactgtcagagaatataggattttcggttttaaaactttgaacttaaaatgattgcaacagtattttagtgatattctaaaaaatatttaaaaataaagttccgttgagccgtcggatcctcgtgagcagcca

SEQ ID NO: 234385 - DNA, 334 bp, Homo sapiens
ggaggcagaggttgcagggagctgagatcatgtcattgcactccagcctgggtgacaagagcaaatctccgtctcaaaaaaaaaaaaattccagggtaatctgagatcttggtatttagagacatttggttgggatgaggggtcttggtagatttgattctgttatcatttggaaccttccaaagtagaggatgacgcatttgtttttgagctactttctagaaaccagaatttactgtcagagaatataggattttcggttttaaaactttgaacttaaaatgattgcactccagcctgggtgacaagagcaagtctccgtctcaaaaaaaaa

SEQ ID NO: 234386 - DNA, 445 bp, Homo sapiens
caaataccaatgtaagaacacaggaaacatgaaaagcaaggaactatgacacctccaaaacaacacaataattttccagcaacatatcccaatcaaaaagaaatttacaaaatcctgggaaaagaattcaaaatattgacactaaagaagcaaaatattgaggctgggtgtggtgcctcatgtctgtaatcccagcactttgggaggcagaggcaggaggataacctgaggtcaagagtttgaggccagcctggccaacatggtgaaaccctatctctactaaaaataaaaaaacttagctggttgtggtggcatgtgcctgtaatcccagctactcaaatgtctgaggcaggagaattgcttgaacccgggaggtggagaatgcagtgagccaagatcgtgccattgcactccagcatgggcaacaagagcaaaactctgtcta

SEQ ID NO: 234387 - DNA, 466 bp, Homo sapiens
gaccagccaccacttggggttgtctctgcaacccacgctccgcgccgccctgacccggtaccggcccgcgcggcggtataggcgggcgctgggtgctggtcgctgggcgcggaggctttctttgccaagggcagcgcgccccctgctgtccgagcggaagaactgcgcagcacgcgaggccgcagacgccctctggtcagggccctgcagaatggcttgggctgggactcgtcctgcgcccttgggcgaggccatttgtccctgggtcgggaggagcttaaccgtggggctcggctgtatccgcgaatggcaggggcacaggacagcggggactgtgacggaacacatgccgttattccatgcattgtgccgtgctgtgagtgcataaccaaaaaataccaactcagtccatggctaaagtaaggacatgcaataaaaatttaagcctgataagaaaaaaagtgag

SEQ ID NO: 234388 - DNA, 862 bp, Homo sapiens
ggtagataaaggtgaaaatatcacctcaatttttggtaaagctgcttgtagaacatagattaggtcggtggccaagcaaacaagaatgcatgctccttcaagcaagcagttagcaagaatgagaaaggaactcaatcgaatatgtccaatttcttcttccaagtttattggatctgataatgaggataagtgtcttaagtcagcttcttcctaaagtaggccctgagacaggatctgagttccagtggtttctttgggaggtgatttccagagcaccagtaatggagtagggaaatgaaacagggaagaaaggaatttatttaagccaatataaagtatattaatgagcaactggagctcagtcatcctgggaaccctaggaattgtgcagaacatgcctctgagttgaaaaaactggagtagccattcactaactgctatcagtcatggctaagggctcctcctaggaatgtcaactccctggaaattactaactctctagcttactctatgcccaggctgatcaagcttctggggccagagaatgcactctggcaggcagaaattgcaaataattgccataaagaattgtccatgtgcacaggagcaggcagtgccaagtggttaccagtggagtatagatggtgatacatttgtcatgggacctgaaacaacccagtggattttctaagataaactaaaactaactaaactaaacttggagcagttttcctactacttccttttctctgcaaggaattctcagcagggcctttccaacataagcatgggaggtctttttgtacaaataaaaaagattatttttccttatttcttatatttttctgtttgtaaggcaaaa

SEQ ID NO: 234389 - DNA, 463 bp, Homo sapiens
tctttgtggagtgactgcgacccctagacccacgggcctaacgactggcactcacagtgcagtagccgtggtggcatctctacacaccccatcttcctcttcaagttatatccttctggtcttttgtccctttcactgattttccataattgtattgttttattattggtagacaatactgagcagaatttttctcagggaaaccacctagctttgttgaacttttcttctctttctaaacttttcaagtggtcaaactctggctcatcgttctgaaaggtcctgtaaacatggtattcccttctgcttaagatgggattttgttcatctgctcctgttgaaggattatgactctgccacctgtatctccagttcctactaattctccagaatgaataagttctactggggaagaaaaaagctaatgaaatagttatggtcaatagttatagaaaaattaaaa

SEQ ID NO: 234390 - DNA, 467 bp, Homo sapiens
agagttgaaagcgtccagtatttttcaaaccaggatcgctggcatcccttggagaggagcttgagggcaacagtgaagcctcttcctttcaacaaactgctctgctcttatttatttagatttgaagaaagggtgttcccatttttaaataaaagtttgaaaactacaaactcttatgtaaaaaagaaaagctaagcataggctgggcatagtggctcacaccagaactttgagaggccaaggcaggagtatggtttgaggccatacttgggcaacatagaaagactccatctctaaataaaaagttttttaaattagctgggcatactggcacacacctgtagtcctagatacttgagaggctgcggcaggaggatggcttgaggtccaggagctatgatcatgccattgcactccagcctgggcaacagagcaagactgtctcaaatgtctctaatttaccaaaa

SEQ ID NO: 234391 - DNA, 439 bp, Homo sapiens
ataatgttaatgcatgtagataaaatgaggattcatgcattgttctgttgttacctcagtgagcccttcctatctgcagatgggatgcagaactggtgaataaagaggaccaacttaaggggctggggaatccaaggattttactatctgtgagagttttggaaccagtcttccacagatacccagggatgactgcccctgcacgcaaggtgggtctacagttgtgcgctctctcctttcaagatttctcattttgttcctatcaggctagccctgacatcttgaatgtgactgtttactctctctctgggcctcattttctttatttgtaaaatgaagaatttgggagaagatctcttctaattttaacacagtatgattcgactggtgtccttactgtataggataactgaagttaataaagtctttgcatcacaaa

SEQ ID NO: 234392 - DNA, 465 bp, Homo sapiens
tctttatccagtctgtcattggtggccatttgggttgattccatgtctttgctattgtgaatagtgctaccttaccttttaaaaaagtaaactcaatttttcaaatgtttgtgaacattacatgatatgtcatatatatctgtcctagagataatcttacctgcagaattggtctagtaacataatatctcgacaacaccccactttcattttaagggataatctataatcatgaattctcagtccttatgagagcgatctcatgcagatgatggtattctgaatgagcacaagtgtatacaaaagaccaacagggaataaaattatactcatatgaaaacggcttttatctaaattacaaaaattggattataaaataaagatggtggtcttagttttctaacactaaatattcccttttgtaatctcattggctcttgcgcagtgaaataaaaatttgaaact

SEQ ID NO: 234393 - DNA, 362 bp, Homo sapiens
ccaggtggaaatacatttcttactccatttttattaatttattaattatattaattaatgtaatcttattaaatttatttaatttatcaaattgtattaaacgaatgtatttaatcttttattattaaattaactagaattaactctatttaattctattattcccacttcctttattagctagaattcttctctaaagaaaaactgtcccacaccagctatttggctactttgagatatagtttgtgcagaaaaagcagtgtaaatatttaattttttccattttatttaccagttttcagagaagtactactacaaaggtgaccaataaaaggatttttggttttgtgtcattatgaact

SEQ ID NO: 234394 - DNA, 401 bp, Homo sapiens
ctcatttgcatgattgaagttggcttatactatcatgactatgttccaatgaataagaaggaaaaagccaggaatagagaatgagacatttccttttcaaaatatgacttagggctgggtgctgtggctcacgcctataatcccagcactttaggaggctgaggtgggcggatcacctgagatcaagagttcgagaccagcctggccaacatgatgaaaacccatctctactaaagatataaaaattagcctgacatggtggcatgtgcctgtgatcccagctactcaggaggctgaggtaggagaatcacttgaatccgagaggcggaggttacagtgagccgagattgcgccactgtgctccatcctgggtgggtgacaaagcgagactccatctccaa

SEQ ID NO: 234395 - DNA, 470 bp, Homo sapiens
ggtcatggggacagctccgggctgaggaattgatccagcacccctgcccccagtggtggagacgtcaagcccttcccatgggtgtcctggccctgtcttctctcctcagttttctcatctgtaaggtgggagtagcctggctgataggccgttatgagaatttacagagctaacacatgcaaagtccttagaacagaaacaaccacagtaaatagtggctacaattttaccccactcctcggttagtcctgtcaacccagaacccccgtggggcaggccctggtctcacagatgcccccaggacaaggcaggttctcaccactgctggtgccggactcccaccccttctcccctctttacatccgtctgcttaactccttcccagctactgtggatctcctagttccacaagacagaagggaagttttcaaaagaaagttgaccgtaaataaaacaaattatttaaagtg

SEQ ID NO: 234396 - DNA, 483 bp, Homo sapiens
agcgcctttataatgttttattctcccaagttcttctcaaaaaagtcaacatccaccaagtatcagctgagatttgaacttcaaccctgggctgaactcagtggcaggactctccattcccaacaagggacaaatggagaaataaatggtgagagggaggagcttgattctgcccatgctaattggacacctgttgtgtgctaggaagacacacagaggtcaatccaaattccagctccagccagagcaggacagccatggtgtagaaggcctagcccagaggagggagccttagcaagcggagcacccctccatggagtattgacactctgttatttcagttatactgaaaactaatagaaggtatgagatattgcactcaaccattatgagcaagaaaatccattcaatcttctttaatttggttaaaactaacctttactaaaaggcagcaaagaataatgcttgtctgtgagaatttaa

SEQ ID NO: 234397 - DNA, 391 bp, Homo sapiens
gtggtgcctcctttggcctgcctatggctgcccatggatcaatcagcaggcatttcctccaccccataaaagcctcgggctcaggcagagcaagagagaggatggagggacaggaagaccagttgcagagagaagctgccctctctgctaatagcaggagacgatgggacaaccagctgcacagaggaactaccctctctgctgagagcttcagagacctgcagagacttcgggactacagtgcagagaggagcaaggagcacccgctccagggcctcctctctgctgagagcagtagatgttgggaagacctgcctacggagaggagctacccactgtgggtctcctctgagctgttctaaaatttagtaaagctcatcttcatcttgtc

SEQ ID NO: 234398 - DNA, 379 bp, Homo sapiens
cctctagaagatgactccaacctagaagacccatcagagaaggtgaatgcatagcccggatgtactcagccattaagtgcgggctaggggctgcactcagcctgtctgagttcacagctcttgctctttccctcacagtgtgtttttttggggggatgggggtggcagtgataactgaaaaagtgtcatgctgtctgggtactcattacatgcattcttagtctaatgtctaaagttggaatctttacccctcccttctgttccacaacacttctgcaaaagaatgactggaatttaacgttaactaagggaaaaaatattttacccatgtccctggaggtagattttctttcttttttttcccaaagccctaccaaaa

SEQ ID NO: 234399 - DNA, 696 bp, Homo sapiens
attttcatatttcatatagcagtttgatcaatttacagatttattttacataattagtaaatgagaaattcaattgctgatatataactattttttcataatgtaaaaaagaagctaaaattctgaattataaataaaaaacaaatattttgaagacatctggtccacatctgtctgaaataagataatttaaaacagtgtaattaaatgcaagaaatactgaaatattcacaccttaggatgttaaaaaaaactcatttcattttgatgtgatttgtttaattgtagagtttttaaaaatgttagtgtcctttagcctctcattctatcatttacaaagaagactgacaagctaaacaaaaaaaaataatccatgtgttccaaagcctctactaaatgaaagaattatctttattactattcttttatatgggcataactccactcctaagttaatactcagcggacatagacccagacctacctccttttgatgtatttataattctccattcaattacttaaaatgagagattagtgagagggtctctaatctccctaaattgtgcgttccttgtgggcacaaaggagctcagtaaatgtgagaggaaggtattcagacctatggaaatgaaaagcatctttggtacattctcatgatcattggagagtcagcctttgaagattggtcttttc

SEQ ID NO: 234400 - DNA, 304 bp, Homo sapiens
tcgggaatgccacattccagggggccgtgcccctgctggacccctcaccatcaacatgagcgagtgtgcaggccggggccatcctgggccctgccagggagcgaaccggagctggcaccaggccctcatgacccagtgtttccccagcgtttaaaacgcggaccttagtgacttccctgtggtgtgtgtccttaggagtgaacacacataccatgttctctaaccatatcggaagctaaaaatcggtaacagatatcggcaaaatctctaaatatttggaaattaaataatataccgctaaata

SEQ ID NO: 234401 - DNA, 321 bp, Homo sapiens
tacccagaaggatcctgaagctcacagaggttatgtagcctgcctaaggttacccagctagcaactggcaaagctaggagttgctgcagaatagcaagcctatcactcacaatggccagaaatcagaacaaatgatcattacaaacaacccatgtagacagttttctatcgtaaggcagtgatttttgagtccatagatgggccagtaggaagtctacactgaaatcagcattgtgcctgatactgagaggaataaagttgataggaaggagcaatcagaaagctttggctgaaaagaatgatttaaaccactggagaaaa

SEQ ID NO: 234402 - DNA, 442 bp, Homo sapiens
agcatgtccttttgtacattttgaattttatactctatgaatatattacttcatttttttaagcaatggaattgaaaaaaaatttaagcattaaatagacccctagaaagaaagagtcaagtgtttcctcctctgtaagtcttctctaccttgatgctcatctccactgagctaccatcatgccctccacacagctcggtggcagcgtttatcactttatattgttaagtatctgcaaacaagcaagcagtcctaccatcctcacagcccagaggctccttgagggaagagactttgtctaactcaatttggaatctccagccccttgcacggtgccagtacagaggaagggctcatagagatttgttgaattcgtgaacaaatagagtttctgtgcagaagggaagcaaaataaatgtaagtattcacatttatttcacag

SEQ ID NO: 234403 - DNA, 283 bp, Homo sapiens
ccagtaacccatagcaaaaaatggactcagttgatcctgtgacccccttcaagaaccgattcaacacaagaagacagtttcaacagccctatgatttcatccctgacccagccaatcaccattccccattctctagcctcctgatgggcaggaggctagagaggttcaaagtttttcatccttgaaagactgtagcctccaaattctcaggaaggcagatttgagaattatctcttatacttgcttggccaccctgcaattattaaactctttttctgctgca

SEQ ID NO: 234404 - DNA, 291 bp, Homo sapiens
ctggaaatgatttaaaggcccatctgcaagagagtataaattctcatagcccttgcagcaagtgcaggaaaaatggcacaagacaacatgcattgaaacaagaaggggttcagaatctggtgagtgggggaaaaaggaggttataaagcattgcatggtacaatcccgttttatgggagaaatgcgattttccattaaggataaggctgtgagctccatgaggccaaggatgtctcctgtgtctgacgtgcttctcctacccagtggaggttagagatgcagtatatgtat

SEQ ID NO: 234405 - DNA, 372 bp, Homo sapiens
aggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggagaaagagagggagggagggaaa

SEQ ID NO: 234406 - DNA, 477 bp, Homo sapiens
gtttttaagattggatgagttatttcctgttcttttcctcttattgctggtttgataggcagtgtcctggggcagctgtcagatgcttcttacagggaagtcccctgcatctccttttgccatgcccttaatctcccagagattcagtcacacgccgggtaccgtgttcctgtcgttgtggggacgtagtcagtagagaattcaagttcagttttctggattaaaaaaaagaatctccagaaccactttgtggatgctgcatggtgacttgatgtgtagccagagacagtgtttctcaaagtgtgctgagtttccaactaaggatccgtgagataattttagatcatgtggagatgacagttttaaagttatatttattttagtgtgtagtagaaagaaaccaaatcaaatctgtgatttcatagatattattgcttagggccagactacatttcagtgggatataagtcagttcga

SEQ ID NO: 234407 - DNA, 884 bp, Homo sapiens
  misc_feature (43)..(43): n is a, c, g, or t
  misc_feature (49)..(49): n is a, c, g, or t
  misc_feature (52)..(52): n is a, c, g, or t
  misc_feature (58)..(58): n is a, c, g, or t
  misc_feature (73)..(74): n is a, c, g, or t
  misc_feature (78)..(79): n is a, c, g, or t
  misc_feature (82)..(82): n is a, c, g, or t
  misc_feature (84)..(84): n is a, c, g, or t
  misc_feature (94)..(94): n is a, c, g, or t
  misc_feature (110)..(110): n is a, c, g, or t
  misc_feature (115)..(115): n is a, c, g, or t
  misc_feature (140)..(140): n is a, c, g, or t
gtgatgaaaaacaaaaactgtggacagttgccaagtccccagntctcanggntgggtngggtctccccacagnnagcnnggntnagacacactntccattgccgaagcgngaggnacccttgtcatcatcccacagagtntgcctggtcattgcttttaaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttac

SEQ ID NO: 234408 - DNA, 839 bp, Homo sapiens
tgttgaaggaaaaaacaaagccgttgaccagttgccaaagtcacccaggtttcaaggggtggggtggggttctccccacaaacagcctggttcagccacactttccattcccgaaggggaagggacccttgtcatcatcccacagagtttgccttgtcattgcttctgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttac

SEQ ID NO: 234409 - DNA, 833 bp, Homo sapiens
  misc_feature (59)..(59): n is a, c, g, or t
  misc_feature (64)..(64): n is a, c, g, or t
  misc_feature (89)..(89): n is a, c, g, or t
tgtggatgaaaaaacaagaccggtgaacaggtcccaagtcaccaccattgccgaagcgngaggnacccttgtcatcatcccacagagtntgcctggtcattgcttttaaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttac

SEQ ID NO: 234410 - DNA, 831 bp, Homo sapiens
  misc_feature (43)..(43): n is a, c, g, or t
  misc_feature (49)..(49): n is a, c, g, or t
  misc_feature (52)..(52): n is a, c, g, or t
  misc_feature (58)..(58): n is a, c, g, or t
  misc_feature (73)..(74): n is a, c, g, or t
  misc_feature (78)..(79): n is a, c, g, or t
  misc_feature (82)..(82): n is a, c, g, or t
  misc_feature (84)..(84): n is a, c, g, or t
  misc_feature (94)..(94): n is a, c, g, or t
  misc_feature (110)..(110): n is a, c, g, or t
  misc_feature (115)..(115): n is a, c, g, or t
  misc_feature (140)..(140): n is a, c, g, or t
gtgatgaaaaacaaaaactgtggacagttgccaagtccccagntctcanggntgggtngggtctccccacagnnagcnnggntnagacacactntccattgccgaagcgngaggnacccttgtcatcatcccacagagtntgcctggtcattgcttttaaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaagagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttac

SEQ ID NO: 234411 - DNA, 400 bp, Homo sapiens
ccttatttatagttatggctcatatttaagaaaaaatgataatacatagtttgatctcttgcctaatactttgagtgataatgacttactgtaagccataccttttctcaaaagatgaggatttggcatcatttagaaaaactgtcttctggataataggcatttcttgttaaattctaaaaatactttgaatcttaaaagcatcaactaaattaatgaataaacctttcaagaccactgtaagggaagccccatatttagatatataagttgtatttcattcttaagaaagaaaattctttatagattggtgttgaaaatgtaaatgaaacatttttttaaatttttgcttatgagacttgaaatttgaatgttcaaaaataaactgtgtaactcttta

SEQ ID NO: 234412 - DNA, 662 bp, Homo sapiens
gagaaaaaaaaatgtatttccaattggatagggctgaaaccagaattttggacgagagttaagaagcatttcaaattgtcatgagaaaataaataattacataaatgcatttcacgtatatcagtgacaattaaaaaaacagtcaaactagccagtaattgttcttcgtattaaaattgcattcgttatccatccttctgcaacatgactccaagaatttacatttattatttaaatatatatcttaaaaatacttttgtaaaaatacacagttatcccttgaataaatgccttaggtcttaggaaagtatataccttgtaacagttttgatctaaagatgctagctccatagtccctaaatttaaaaaagaaaggcctatgtgcaaaacattaaaagaacaattgtttttagtataatgcatgttaatacagcataataatagtaaaatttagaagttgaatgctctagcactacaaacattgaggagttacgtggaattggaaaatagtctccttggtaatttaaccaaagtaaaccttatctataagcaaaataacacataaaacataacattttctttgcattttcttaaaaggaactttatatttttcagaacatatgttagcatttcatttagggtcttattaaaaatgccctggc

SEQ ID NO: 234413 - DNA, 1065 bp, Homo sapiens
gaggcagaggttgcagtgagccaagatcgtgccactgcactccagcctgggtgacagagccagattctgtgtcaaaaaaataaaaataaaaaattgaccaacaaaatttcagggagtaataaaggctgtatacagagttaaaataggatgatgtgttaagaaagtaatggatgggtacggtggcttacacctgtaattccagcactttgggaggcccacacagtcagttgaactcaggagttcaagaccagcctgggcaacatggtgaaaccccatctctacaaaaataaaaaaattagctggacatggttgcgtgtgcctgtggttccagctactcgggaggctgaggcgggaggatgacttgggcatgggaggttgaggctgcagtgagccatgatggaaccactgcgctccagtctgagtgacagagcaagaccccatctcaaaaaaaaaaaagaaagtgactaagtaggtatatcagattgtgtggtagggaatgctgctctgaagacatgacatttaagcagagacttgaatgacaagagggatccaaccaggcaaagaacagagagtgttctaggccgaggagacagctagagcaaagccttgtgatgggacagtctcaccatagcaagaatcaagaaggcctgcgtggctagaaagtaatgaacagggatagagaagtacagggtgtactggagggatgtaggcagaggcccaacaatgggctggcctctctgttcctctggtgcctcctgctactacaagagtttttatctgctcctcctctgtggtgcttagcattcagtcagtcagttatgggaatatagcagtggacaaaagagacaaaatccttgcccttgtggaacgtgtatcctaatagggagatagatgtgaaaaagtcataataaatagtatgttaaaaaaaaaaaggtcgtaaatgccaaaaaaaaaaaaaaagatagtcaacacaggataaactaatcaggagtgccaggtttggagggaggtaggccctattaagaaggtggcatcacacttgggagaaggtgaggaaattagcta

SEQ ID NO: 234414 - DNA, 539 bp, Homo sapiens
gaggcagaggttgcagtgagccaagatcgtgccactgcactccagcctgggtgacagagccagattctgtgtcaaaaaaataaaaataaaaaattgaccaacaaaatttcagggagtaataaaggctgtatacagagttaaaataggatgatgtgttaagaaagtaatggatgggtacggtggcttacacctgtaattccagcactttgggaggcccacacagtcagttgaactcaggagttcaagaccagcctggcttggcctcccaaagtgccgggattacaggtgtgagccatcacaactggccaaatacatttgtttttaaggcagtaccacatttttacttaatgaccatatagcatgtgtattatgctgttcttgcattattgctataaagaaataccagagactgggtaacttataaagaaaagaggtttaatcggctcacgttctgcaggattgcaagaagcatgctcggcttctcggaggcctcagaaagcttcaattatggcagaagtgaagggatcagcacatcacta

SEQ ID NO: 234415 - DNA, 381 bp, Homo sapiens
gaactgcttttgcaataagtaaagtcaatgaagaaagtaagaggattgcaaaggtttcccccgctgattctgccaacagaaatgtttttattgtgctgctttgggcgtggaaaaaaaacagtgaaacatttccaactacaatttaaaggaatgcatgtcatttatttaaaacataaatcagcaaacagagagacataaaattactagtggactgcttcaagttcagaagccactgccctggtagaggagttaccaacgatcacacatcctataggaatccaactacagtggccctgagctgaaacagcatgcgttccatgctcctttgcataatttgcctacttcttctcatattttgtaaatataaaatctacttctggt

SEQ ID NO: 234416 - DNA, 628 bp, Homo sapiens
ttcctatcccctcatgctgccatcaggaagatgaggtggaccatgtctccctagtgcctgcctcttcagttctgactctttgtgctgatgaacttcatgatttgtaagacatgtcaggactgaatgtatgttctaaaagttaggagaatcagcagtgccgctgactggtctttctggggagaggagggtcacaggccatgggtagattcaggaatcctggtggagacccagtgatggggagggagtttgatcagtcactttgtgcctgtgttctgctgaagaatgggcagagtgagagcactgggctctccaggatggtgaagaattttttttcttttttttttttgcgcgacggaatctcgttccgtcacccaggctggagtgtggtggcacagtctcggctcactgcaacctccgcctcccaggttcaagcgattctcctgcctcagcctcctcagtagttgggattacaggagtccaccaccatgcctggctaattttttatttttagtagagatggggtttcactatattggctaggctggtctcgaactcctgacctcaagtgattccccccgcctcggcttcgcaaagtgctgggattacaggcataaaccactgtgcccgg

SEQ ID NO: 234417 - DNA, 225 bp, Homo sapiens
ggcaggagaaaatttcccaaccctataaaaaacatctattaaaaacttatagctaacatcttaatgtgaaagatcaaatgttttctaagagcaggaacaaggctagaattttcaccccatcctttttttttttttttttttttttttttttttaatggtaaaaactttatttactatttataaatacattgcaagacaaacttctcaaaaatacttttcccccca

SEQ ID NO: 234418 - DNA, 359 bp, Homo sapiens
tagcaatccaatataaaaataggcattccttatttattttgcatatgagctctttgtcaggtctatgacactatattttttaaaattaacgttttactaaaaatggcagtgaatgctaaatgtccagctttacaataagtacagtaatagcaactcaaactaaaacaaaacatacttctgatagccattatttttctgtttaggacaattttaaaatcttgtttgtcacaaaaacaggaaggtacctatacaaaggctcaaaacaggccatccttttaaacaaaaaggcaatgattcacaaaagactatgaatagaacatgtaactagttgacacaaatctaataggatttgttaaaat

SEQ ID NO: 234419 - DNA, 442 bp, Homo sapiens
ggatgaagaggatataacacgtaggaggtgaagtcactaacccaaatccttgcagccggcaagtggtcagaattcttggaccaggtgtgaggccttaagagaacaagctagcccagggcttggcatgaagtaggtgcttaataaagattggttttagccaggcgcagtggctcatgcctgtaatctcagcactttgggaggctgaagcaggaggatcacttgagcccaggagttccagaccagcctgggcaacacggcgaatccctgtctctactaaaaatacaaaaagattagtcgggtgtggtggcgcgtgcctgtaatcccagctactcgggaggctgaggcaggagaatagcttgaacctgggaggtagactttgcaatgagccaagatcgcaccactgccctccagccggggcaacagagcaagactgtctcaaaaa

SEQ ID NO: 234420 - DNA, 1495 bp, Homo sapiens
taacgatgttgtgctcagggtagtaattgagaggtattttacaccagatttaagcctgtgcttttatcttcaaagatatgctacttaaaattgggggaaagtgtacagaatggaactgtatggatatggatttttagaatagtgcacacacctcaagtgtgtatttatttcattaatttcccccaaactgagtacctcctatgtgttaggcactggacaaaacagtaaacaaaatagtaaacaaaagaataaaaatccctgccatcatgaagttccactttggggatggggtgagaagacattgatacaaaaattaaggtacagtctttcctgtccctcggcatctgtgggagattggttccaggacctcccttggataccaaagtcctcaaatgctcaagtccctgatataaaatggtgtagtgtttgcagataacctatgcacatcctcctatctttagttcaactctgcattatttataatgcgcaatacaacttaaatgctgtataaatagttgttatggtgtattgtttagggaataatgacaaaaaagagtctatacatgttcagtactgacttttttttccttccccgaatattttttcatccatgattggttgaatacaaggacgaagaacccatgggtaggaagggccaactgtgtacgtcaagtggcggaaagtgctagagaaaaaaaccaaagcagtgcaggggtatagggaatgccaagagatgggagtggtggccatagaaaagatgatattaacttggaggcctacgggtgataaagaagggtgccacttggaaggagctgccactgaagccctgaagcaggcgcatactagctagtttgactggaaaataatgaacaagagggaaagaagtagtggatacttaggtggaaatggggccaagtcatttaggagcatgtgggaatttataagaaccttaatttgtactttgaatgagttgggttttgagtaagcagtgagttgatctaacttgtgttttaaaagatctgattgctatgttgactgtatgcagcaggtgcagaaataagagttgttagtaggccattgactgcatttatccaggttaaaggtcgaggtgacttgaatcagggtagtaatagtggcggtagtgcgaaatgaccagattctagacttttgagagcagtcaggtagaagaagggtcaaggacgactccaagggttacggactgagcaactaaagaatataacttggccgggcgtgatggctcatgcttgtaataccatctttgagagaatccccagcctgggcgacataacgagaccctgtctctacaaaaaaataaaaaattagctgggcatagtggcatgagcctgtagtcctggctacttgggaagctgagatgggaggggaggatcacttgacccccttgagctcaaggttacagtgacccatgatccttcactgtagtccatcctgggtgacagcaagaccctgtctcttt

SEQ ID NO: 234421 - DNA, 435 bp, Homo sapiens
aggtcagagccctggtcttgtcccagctctgcctttgccagctgttagagcctcagtttcctcagtgctaaaggggataacagtcactacctcgccaggtggttgtgaatatacagagagcacctgtaacacagttgattcgtaactgttgctcctcaccgaccccttttgcattcccatggggaagagccaaggctggggagttatgactccagtgatagactgctccatgtgagtgactgtgtgtgtgtatctctatgttggggccagggatatctgaactgtgtggtgttataggagtcggcgaacctcttagcctcagtttccctatctgtacaatgggtaaagtgatcatacctcaggatttttgcaagaattaaatgaggtcctccatgccaaactgctagcaagggacctcagtatatgctcatctta

SEQ ID NO: 234422 - DNA, 196 bp, Homo sapiens
acaaaaggaaaaaggagacttcaattttcagctatttcatgaattgataaaggacattttgatgtgtgtatgtgtgttttatatgatatgccaataaaatttaatatacagggcattccagaatggtttctgccccactgatggacttcaaatatgtctcatcaactacagtattaaatgccataattaaaggtct

SEQ ID NO: 234423 - DNA, 328 bp, Homo sapiens
tggcctggaacacttcagtggtttctgctgccacaggatggagtcagctccctcagtgtgtcttacacagccctgggggccagccgtgcccaactttgcagcggcatcattctcccttttggggtcttttgttttggccataatgaacatttggtttctcctagtgtgaaaggtgttttctctagtaagaatgctgtccccgcttagtccagtcattgaaacactcaactttttaagtcaggctgagttcaaatcttgactcagtcacctattagtttccccccacccccagaatcattccacttagtagtgaagtgaccttggatga

SEQ ID NO: 234424 - DNA, 183 bp, Homo sapiens
gtagagatgggggtctcactgtgttgctcaggtccaattatatatatactaactttgcagggttgttccagagttcactgaggctgtttatatattttttccaatcttttcctttctgttattaaattatataatttctattgctctctgttagagataattcacccatccttttgccatctc

SEQ ID NO: 234425 - DNA, 431 bp, Homo sapiens
cagcatccctggcccaacaaagattggtgcaacagaaagagttctggactgggaggaagaatgtatgggttgtggtcctggtacttcttaactagccatgtgagtctggacaagctcctcagcttttctgtcttaaaaattagggagttggctgggtgcagtggctcatgcctgtaatcccagcactttgggaggccgaggcagatggatcacttgaggccaagagctcaagaccagcctggccaacatggtgaaaccctgtctctactaaaaatacaaaaattagtcaggtgtagtggtgcgtgcctgtagtcccagctacttgggaggctgaggcaacagaatcacttgaacccgggaggcagaggttgtagtagccgagattgagccactgcactgtagcctgggcgacaaagcaagactccgtctta

SEQ ID NO: 234426 - DNA, 795 bp, Homo sapiens
tttagatcttcatataaggaatgacccagatgattatataaatctacatttaattttcattagaattgtcctaggtagtgcttgaactttaaatcctgtagagtagaagcaaatctgtgtttgcaatagaaattgccagaagaaagaacaaggaagacatttagataatttcatctgggtgtgcaaagtcatcacaagatccatctttccattatctggaagttgggagccacctgtttttcatgacggtctgacggttggaatgagaagcttttctgtgggtgaggagatcgagatcagcctagctgtgtgcttctggtttaatatgtttcatgaggctgggggtcgtgatgtagaccaaggctccagtcatctgaggacctcactggactggaagaacagtgtccaagatggcttcctcccatgacaggcaaagtgatgctggtttttggcaggagtcctcaggccttgtggacctctgcactgagctgactgaggagaggtggctggttttccccagtgtgatgagccaagagaaagatccttcgaggaggaagctgcgacaccatccatgtgcttagaagtcacgcagtcacttctgcaaattatatgatgagaattagctctgccttttgaaggaagaaatgccaaagaatggtggacatattttaaaaccacaatggctgatttttctgcagactgaaaaaaggaggggaggcatcaaaagattactaaacaggcttgggtttgaatcctgcctctgccactctgtaacttcgggaaaattattagcct

SEQ ID NO: 234427 - DNA, 343 bp, Homo sapiens
aaatatatacaatgtatattgaaatgtctataaagtggttcaatgcatttaaatgaaaagtttccaggtatacttgaactattattttcatatgaatagatacttatggtgtacatttttcctctaagaaccataattcctattttacatcgtaatacatagattgtagatgtaattatcaaagtattttataatatatatgcacatattcatatgtatgcactttaattatggttgataggttattcagtcttttagaatatcagagctgaaactgatcaactctacaatatgcagtggaattaaatttgcaacatatttcaagctctaggttcatagtttc

SEQ ID NO: 234428 - DNA, 455 bp, Homo sapiens
acacccccagccaggtgaccaacctcctggcatccccagtgtgtgtccactgatgcctggttccgcattttataaaaagaattttttcatgaaaagaaccctttggatgaaaagaaagtgaagcatcacattcctgtcgttttatttttgcaaaatattttctttgtaatatatctgaagggtgtggcttgaagacttcctgcctggctttgttctgactctccatgcagaccgatttatattccgccaccaagagaagggagctgagcttagtggctgcttccctctcctgggagaattttaagaagatggtccacagcagattcacatctattatgctttttgttccttgcaattgccctgtgaagtaagtagggtagagtttctcaccctcctgggggaaacatgttcagggaggtcaaggtcatacagctaataaaaagagcaagtcttga

SEQ ID NO: 234429 - DNA, 554 bp, Homo sapiens
aaaaaaacattaaaacaaaataagtaaaagtgactggttccctctgtagcacctggtgcagtctctttccctaagagagagagagtttcagttaccttgcagcccagggcagccgtttgtccccaccaaaactaggcaatcactgtggcagagccttgggttctggcctctgtggcagatgctggcagtggtgtgctagttagtggccctctggaatacagacaggaccaattcatagaatctgccaatttccatggtgtaaatattcccaccaaagctatttcagatcaccagcgtgacaacactgacttgcactggaacaggatactcacactctgctctcacaagcctgtgccagcgaaagatgctagcctgggaatcacatctctctccgtgggaattttgcggggtccctgcactgctctccttgcccatacaggaggccagcccaggttgtcctacagtcctagtgaagcggtgtcattgtctggggtaaatacccaagatttgttatctcacagccacggaaaactaggacacagacacacaaggag

SEQ ID NO: 234430 - DNA, 381 bp, Homo sapiens
tcatatgtgagcagaagtcaagttttctttttttccaaatgggtataaattgtctcatactgtttttacttaaaaggccatcttttcccccactgctctgcagggccgtttatgaaataaatcaagttcatctatgcatgggtctgttctagcttttctatgatatcataatgttctaattactgaatttgtgccaatatcagagcatcctaattactacctacttagagtaaggtttgatgtctggtaaagcaagcaattattccagctttatgttgagacttagtaacctcttatattgttgttctgctggagtatcttagctattcttggccctttacatttacatatcaattttgaaatcagcttgtcaagttcctc

SEQ ID NO: 234431 - DNA, 423 bp, Homo sapiens
tgaaggaaatacttgtacatttatggagggaaggaaatttattttattgcttgcatcagcatatcctactaagtaatgagtcctgaagcttttctttataggccacagtgagtggcttcttaacaatcacatatctattttcctttgaataagtaccattgcttcaatctattcccttttctccaaaggtgactgtatgtctcttttatctgggacagttcaggtctatgcttgttgttctctacatttatttacagtacccctttccatcttgaaagtatctcagtgtgggcaataaattttatggtcactatagactgttacctcaaactctctctttttttttaaatcatgacaattcaaatcccatttgtgcatatatttttgagataccttgtttaaataaacagtatctttctttga

SEQ ID NO: 234432 - DNA, 384 bp, Homo sapiens
ttcagttactttctcaaatccctaaaatgacagtaaggggcagtttcaaaggatagacccacaagggcaaagaacagaagaaacaaatattttggaagatagaaattggagaaatgagcagttactgatgtagaacagggtttgacaatttttttcaataaagggccaaatagtaaatattttaggctttgcaggccacatactccctccttcacctcctcttgcctcctccctctcctcttctccttcaacagtcctttaaaaatataaaaactattcttagctggcagaccagattggcccgtaggtcataatttgcccacctctgatttaaaagagacaagaaaattgaaaccagagccatacaacacagaatcctagaaa

SEQ ID NO: 234433 - DNA, 1074 bp, Homo sapiens
tggcacttactcctgtattttaactgcttgcttatttgtctgtttttcccatatgaccataagttccattaagggtagaaactacatcttgttcagggctattcctgtggcgcccaaaagtgataaatgtctgctggataaatgaatgagaagaattagctgacccagtgtggcccagaaaagcagccaatcctgaaggcttttcctcctgcctggaggtgacacaccaacccaaaggactgctcaaggagtggaaaggggctttctgggtggagactgccatcagccctctctggtctaagaagcctgcaaagctaaaagctcatgatttggcattagacctgggtccaccacatttagtcctgtgacctcagacaggtcttgtaacctgccctgagctttggctttctcttctattgtaaggaccagccacattcatgtaaagcactcaccccttgcctgacccacactgaccactcaataaagccatcgatactaggttctggttgccatttagcttcccaggagagctctgttctttgtacttcctcttccccccccccagcctccaccaaggtggccacccataggaggcatcagaaaatgcggcaggactgaagattttctgctgctgatcaggaatgactggagcagaaggaacattgtgcccctaggggaagggaaaccaattatttgtcaatacctaacaataaccacactcccggtttattgagcacatgctgcgtgcccggcgagctccggacttccctctctgggggaaccctgcggactgggaggcagaacgggatacaccgaaataggaagaacggagagcttggcaccctccccctcttcaccccacctgggcccctccaggagggtccaggcccttactgtgggcatcagggggccgaatctcctttccaccagctggcccatccctggaaggagctcaggcaacccctgctatctccaaaccaagagagtgggctcccggtcccttctcccttcacccccgtcctcccacacacgggacggaggtggcctcttctggagagagcagctggctcgagt

SEQ ID NO: 234434 - DNA, 455 bp, Homo sapiens
gagatggagtgtcactcttgttgcctaggattacaggcattaagccaccgtgcccggccaagctaccacttttctatgtcacccgacctttcctaaagtacttgcctcatcttttaaaattttgatggtatgtcttctgggtctgacagattaaaaataattaacaagggctgggcgcggtggctcatgcctgtattcctagcactctgggaggccaaagtgggtggatcacgagatcaggagttcgagaccagcctgaccaacatggtgaaaccccatctctactaaaaatacaaaaattagttgggtctgtggcgcgtgcctgtaatcccagctgctcaggagactgaggcaggagaatcgattgaacgtgggaggcggagattgcagtgagctgagatcatgccaccacactccagccttggcgacagaacaagactccgtctcaaaaaaaa

SEQ ID NO: 234435 - DNA, 406 bp, Homo sapiens
aggcaggactgtgaggcctagtgtagggcctcctgccagtggccggcacctacttgtggggctgggggttcccccagcaggttgggctccccacctgacacactcacagaccttgtgccttggagagccagtgttcccggggccacatagctatgccgcccaggggctgggcctgtcccagctctggtcccccggccccaggtcctggacgctggctccgcgcagcagcaggcggcctccggaggacacgatgtgactggctgccgctacgtcgcactcagatgagtctgcgccggatcgacctgctgccgagtcctgccggacaggcacaggcagggagtgaaaattatctacccctttttatttcttaataactgaatgaaaataaacattggtggtttgaaaa

SEQ ID NO: 234436 - DNA, 387 bp, Homo sapiens
ccagattccctctccagcctcctccacacttctctgtaccctaggaggcaggccttttaggatggtattcatggattccccatgctccctcacttctggttgatacggataacggcagatgtctacaggaactcagctgtctacctgccaggccaagggttggctatggctgtattcctctaccaaagtccccagctcctgccaggccaccttcacctacagctaaagccaaagcaacatcactctaagggtagtggtatctccctactttggttagccctagggtgcatcacccctttggtgggttccctgccctcatccttgtaaatggttccatctgttttctatcagttccctgactgattcaccagatcaagacttgggggt

SEQ ID NO: 234437 - DNA, 518 bp, Homo sapiens
acacatccttcctcctgccaacatcctaactcctttacactctggggaccagctcttctcaaatgctggcgcggggaacagcctatttaccgcagttgaggcgattttactgggaaattctcttaggagctccttggagagggaaagcctcacggattcggcggaggtcttaatctggagatgtccaaatttaggggaaaccctccccaccatttgtctccaggctgtattttggagttctcagattaggaccctctggactgggggcaagatttgtatgagggggtctccagcagcttgtgggctggccgcgtgccaggcctgactccgtgtcccccacccccggctgcgcctgggcctcgggggaccgggaaccagccggcgccgcgtccccgcctagcgggcgggccggggacccctcccctccgcccgtcccctcctcccctgctgccgcctcccggagggacggcctggggaggggagagaggagggacgggccggcggcggcggggctgtgg

SEQ ID NO: 234438 - DNA, 415 bp, Homo sapiens
tcccaaaaacctagtgaaataaaataaataaaatagtatatattatttaaagagaggctgtcattaactatagatgaatattgtaaattctacagtaaacgctaaaacaataatgaaaagaggtacaggttgagtaccccaacctgaacatccaaatgctgtaaaatctgaatttttttgagtgcttacatgacaactcaaaggaaatgctgatgggagtgttttggatttcagatgttcagactgcaaatactcaactgataactacaatacaaatattccacaatctgaaaaaatccgaaatctgaacactcctaatcccaaacattttgggtaagggatattcagcctgtaaaaataagctaattgtggatacgatatgaaatcatatttaaaaattagcaaaaaatgtgta

SEQ ID NO: 234439 - DNA, 668 bp, Homo sapiens
tgcatttttagtagagacggggtttcaccatgttggccaggctggtctcaaactcctgacctcaggtgatctgcccacctcgacctcccaaagtgctgggattacaggtgtgagccaccatgcctgccaggtttttttatttttatttttttgaaactggatctcactctgttgcctgggctggagtgcagtggtgagatcatgctcactgcagtctcaaactcctgggctcaagcaatcctcatgcctccgcctcctgtgagactacaggtgtacgccaccacacctgggtaattttcaaaatctttttgtagagacagggtctcattacattgccctggctggtctggaattcctgggcttcagcagtcctcccgcctcggcctcccaaagtagaaatatcagtattgttgtggttagccaccatttattgagcacctactgttgctcagccctgtgctagggatttcacatatgttattacggccttttatgaggtgggcaatattacccctatttcacaaatgaggaaagaggtttaaagggctcaagtgactggtacagaaaccaagtctgtttggctccaaagtccaggccctacccccctgccatgacccagaagcttgcagggcactgagcttgcagggcattgagaaagaggaagtgaa

SEQ ID NO: 234440 - DNA, 544 bp, Homo sapiens
tctggcttccttgaagaaagtgttcaacctttactgcttccaaagttaagacactttcccaagactagtaaacgatcttcccaaagccttttttaaatcatcagttcacatggtgtgaaaatagattaaattctacatattaaactgttaaaaaaattataaagtaatcaaaacaaatgctaaatatgtataagctgttagcattttatatatgagcaaagacttcaggaaaagtaggtattttataaactcaaattacccaacatataaaaatattcaaaacacaatacctcgtccagctcctgaagagacatgttgtccccatcagtcccatccagttggggaaagcacaaagaaagcagcatgggacagacagacagacaaggcatggtcagttgagaaaacactgagattttaagctgactaaatataaagatccactaagcaaggcattttaaaatctccttttttttttttaaattaagctacatcaatatatgctttaatttttatttactgtggttgttttgaaaatgagctagga

SEQ ID NO: 234441 - DNA, 596 bp, Homo sapiens
tgcgtcctctagcgcggggcggaagacccgcgaagtgttcaagcggccgcagagcggcccagagttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatgaccagtgtctgagcctacaactgcgctatcttccctggatttttcttcaccttttccttactcatgagccaggacccatgtgggcagagaggagagttctcacctggagttcagcatggtggacttgggctgcagccgtggccacctggtcctccagatccgccagatgggtctcatcagtgccactgtggatgcagcgggcggcatcttctagctcagtcagctgggtctccagtccatacacagtgcctgctgccaggtatacctgtagagacagtgcta

SEQ ID NO: 234442 - DNA, 814 bp, Homo sapiens
tgcgtcctctagcgcggggcggaagacccgcgaagtgttcaagcggccgcagagcggcccagagttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatgaccagtgtctgagcctacaactgcgctatcttccctggatttttcttcaccttttccttactcatgagccagggtatcccggaagcctgaagggaaaggttcaagtccaggcttccattaaaaccccactaatagacttgttctgccatcaatcagccacagacctgtactgcaagatgcctactacacacccagtgctgagctgtggaaaatccagaacacacgtgaccacagacaatcatgaaggcgctgataatagcagcttctcaaagggaaaattgtgtccgggacccgctgggtacataacagatttctctttattctcagattcaggcttctttgcttggggcagctccccaggagtataagtatgaatgggggggaagatagagcatatacttcttccttcctgatattgttgacaaaagtatgctgtttacatattgaaaatcatgggatggtgtgaactcacagggagaggacaggagggagcctccttg

SEQ ID NO: 234443 - DNA, 732 bp, Homo sapiens
tgcgtcctctagcgcggggcggaagacccgcgaagtgttcaagcggccgcagagcggcccagagttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatgaccagtgtctgagcctacaactgcgctatcttccctggatttttcttcaccttttccttactcatgagccagggacatgaacctggagcctgcccggatgcgaaaggagctgtaacactgaatccctctcaccctatgccagtgctggatggctgtcccatgtgatgggaagtggtggtggggccaggccagcccaggagccatcatgggccagagtggggcagcaggaccaaacaagctataacacaaataagctgaaacatgttcctggctggcctgccaagctgccagcagtgacatgttcccattcgccagactacaagacaagagagctgtgacccttctggggacccagacctcgggactccctgagtcagagctgtgacatgctgtaacacccccttggggctctgtggtt

SEQ ID NO: 234444 - DNA, 455 bp, Homo sapiens
tgcgtcctctagcgcggggcggaagacccgcgaagtgttcaagcggccgcagagcggcccagagttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatgaccagtgtctgagcctacaactgcgctatcttccctggatttttcttcaccttttccttactcatgagccaggcaacctgacatggttgatattttaatcccatctttagagacaagaaaactgtggctcagtgaagaaga

SEQ ID NO: 234445 - DNA, 458 bp, Homo sapiens
ctaatctttcatgatttggaaaccggaaggaaagaagcacttttgtagctgacttacctcaatgacatgaccagtgtctgagcctacaactgcgctatcttccctggatttttcttcaccttttccttactcatgagccagggtatgtgtttttagttccataaaaaagagccctggccaggcgtggtggctcacacctgtaatctcagcactttgggaggctgtggcaggcagaccacttgagctcaggagtttgataccaggatgggcaacatggtgaaaccccgatctataaaaaatacaaaaaattatccaggcatggtggcatgagccactattcccagctactcaggaggctgaggtgggaggatgtcttgagtctgggaggtggaggttgcactgagccgagataagtgccactgtgctctagcctggttgacagaaccagagcctgtctc

SEQ ID NO: 234446 - DNA, 415 bp, Homo sapiens
agagttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatgtaagtaaaatcggggtgcaggaacaaaacaagtccccttgctccggctttcaactcattggcccccgctcagcaactacctgcattgaaattccaaccccagttgcaggagcggtgttagtctcaaccaatactggagatgggagcctctctttccaggattggacggacctccgattccctagcacggtggatctcagactaaagcgtgtgtctctggagggcttgagaaaacactgatagacccca

SEQ ID NO: 234447 - DNA, 217 bp, Homo sapiens
acaaaacacaattcttatttgtgtacttttaaaacctcagagttatactttcacaatacattcctggctgaaagttcacactcggaattccagagcagtccatggccaggcccactgggctccacttgctctctccttggctttggtaaccactggccccagggactcagcctgctttcctatccatcccctcagtagctgtcaccatgcaggttac

SEQ ID NO: 234448 - DNA, 453 bp, Homo sapiens
actccccattatgtctccattgcctagcttagtgcctgatatatcagagtgctcaataactattgagtgaatgggtgaactataacattcctagaatattccatatgatgaaacattacctttttgttccctggtcaattttcgagagtgctaatgtcctgtctgttcatcttgcaatctgcaagtatgcaataatgcagttttagatattaaggtattgttaaattacggttcagttatgggctgaggaaaaagagaggatcaggattaagaagaaagccacaagccttgaatatatagtaaaaagtaaaaccttttttaaaatgttacaggggccaatgaaggaagatgctgagagttgagcttccaatctttgagcactttggctcaaatgatgacaaccaccattgtttacatccaccatggaaaaagacaaagaaaactgacttatgc

SEQ ID NO: 234449 - DNA, 402 bp, Homo sapiens
ttttggtaacatgaaagattcatttgcttaggaagggatagagtgagaaactgattggtctgaaattgaattgtactattaatttaaatgaatcaaaaagtgatctctggtttttgacaacagtattacaatacatttaacttttttaagatgacccttaaattacatttgaccgccttcacccaaatctgctccaccaattttttctccaaattatttagcagtcaacaaatacccaggacaacttgtttttagttatctataactgtcacacaaattatcagtatactaattgattaaaataattttactttagagtactttttctgcttgatagctatagactagtatagtcttctctcccaaatattatgttttgatatcataagtttcctcaaaaaa

SEQ ID NO: 234450 - DNA, 123 bp, Homo sapiens
aactagttatctgcaacccaagcttcatctaaaaaggaatgcttagatgacccagaaccatttcttcacttaatccctgagccttagtttccttatgaataacaagaaaaggctctggggcca

SEQ ID NO: 234451 - DNA, 450 bp, Homo sapiens
ctgagtcgtttggatgtgtatttttcacacaacccagcaggaacatctgttcaaaatatgcttcattggagtcagcttttaaattctactcatttgaaagcttatgactggggcagtcctgatctgaacttggttcattataatcagacaacgtctccattatacaacatgacaaacatgaatgtggcaactgcaatttggaatggtaaaagtgacttgttggctgaccctgaagacgttaacattttacattctgaaatcacaaaccacatttattataaaactatttcttactacaatcatatagactctttgtttggattagatgtctatgatcaagtttaccatgaaatcattgatattatccaagacaatctataaagaaccatggcgctgtgtgtttaaagatctacatcattcctaatgaaatccaattcttattttttttta

SEQ ID NO: 234452 - DNA, 726 bp, Homo sapiens
ttgaaacattttctatacatgaggcagaattctcagggtcagggtgaacttaataaaaatgttttgttgaaaaattgttcttttctctgtgctccttctagctcaactttgtgaatgttcccactgtcttcaaggcagaaatagaacagaaggtgggaaaagaagggaactaatatgtgattctaaaatctttactgtttaaaaaaataaaagtgaaatatttattgctggtagatgaagaattatgtgtagcaaatcttgctgctatgagagggaaaaagtgtagctctatacacaagtaaaaagggcatacaaacagtgaagatttattgtgtaaaagactgtagtaagtactataaatgtggcttcctgtgtttgctgcccagaaatatcctactaatcagatcaagaaagcctggctatgaaaaaatatggcatcctggccaggtgcggtggctcatgtctgtaattccagcactttgggaggcccaggtgggtggatcacctgaggtcagctgttcaagaccagcctgaccaacatggtgaaaccccgtctctactaaaaatacaaaaaattagctgggcatggtgttgcatgcctgtaatcccagctactcaggaggctgaggcaggagaatcacttgaacctgggaggtggaggttgcagtgagccgagatcagccattgcataccagcctgggcaacaagagtgaaactctgtctcaa

SEQ ID NO: 234453 - DNA, 327 bp, Homo sapiens
aaattaatacattttaaaaatcccttggggaactcacggttccggttttaagaaatactggtaaagtcattaagaacacaggcttgagaatcaggcattcctggtattcagttggttttcccactccatggctgcgtttctcaagcaagttatatatcctgtgtttaaagtgcttaatatagcactgtgtgcttactaagtgctatagtagttgatgctgctgatactgtcaataatgctattgttgattttagaccctaggcaagctcctttacctctctgaagttgtttatagtatgaataataaaacccgtcctctttacaatt

SEQ ID NO: 234454 - DNA, 406 bp, Homo sapiens
tctgaaggctctagctgagaatctacctcttggctttttgcagcttccagaggtgaccttctctcctggagattctcttcagaatgtctcttccacttttaaggacccctgtgagtacattaagcccacctggagaggcgagtattatcttcctgtcttaaggtcacgtgattagaaatctcagttccatctgcaaccttagtttgcctttgccacataacccaacatagtcccaggttctggggatgaggatgtagacatttcaaggagattgttagactacacatgacataatccgagttattcttgtgacttctttagaatcaatagaacttgaaaaaacatcatacctttggtagttgtggtaatttgactaaaaataaagagtcttcactcaaaaacactt

SEQ ID NO: 234455 - DNA, 172 bp, Homo sapiens
acaacctcacatttaattttagccaagcatagaactataactgtgaagctgtatttcagggaagatctaaaatgtatggatttccaggaggtgtttaaataatacaggttgtcagtattaaaatcagaagtgtttaaaggccaatggaaaacatatgagattttcatagaat

SEQ ID NO: 234456 - DNA, 556 bp, Homo sapiens
gaagttaggatgaggaaaaagaaagatgaaagatagtcctggctttcaagcctgcaaattctatgtttctaacttgttacttctccaggaaaactacaccataaatttggaaaataaaggtcacctcaaaatttagtaaattcacatcatatatgactgcaattagtaaggggaaaaaagtcagtggttttttatgttgatgagaccactgttcttttattctaaaagaaagaacttcagtgatacggcatagagaaaagggtagcgttaggcacaatagaggctatcaggtctgaaacttccaaaacagcacaagagaaaatgtgccctgactccttacacaaaaaacaagctctatgccaagatttaaggaagaacaaggagatggggaaagccactgcacctctaaatgaaaacaaatggatgttcacccactgccaccctccactgagacgacacacaatttgggaaatggatagttccatctcactaccagacacagaagcacaaatacatacacaggtgtacttactcatatcactacaactacagaaag

SEQ ID NO: 234457 - DNA, 742 bp, Homo sapiens
  misc_feature (664)..(664): n is a, c, g, or t
  misc_feature (680)..(680): n is a, c, g, or t
gacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccggactataaagaaccaggtgtattcaatggaaagcgtgtcctggtggttggcctggggaattcgggctgtgatattgccacagaactcagccgcacagcagaacaggtcatgatcagttccaantgggtctgggtgtganccggtctggacatggtatctctggaactctgttgtactaattggacctcctaagaaattacc

SEQ ID NO: 234458 - DNA, 417 bp, Homo sapiens
gattcctgacccagagaaactggaacactaaggcccattcttcctctcaagtatccagaaataaagttgctccaagtaacaagtggacagcataaaagattgtatggaaactataatgcatctacatctgcagtaactaatcataaaatgatttgtatgatcattcttcacatgattagaattactatgggaaagaagaaaaagaaatgcaactttcttgatttaaaattttatctgtgcaagtgtggtggcacacacctgtagtcagtcccaactgctagggagggtgggtaggatgatcatgtgataccaggagtttgaggctatgtagtgtactatgattgtgttagtgaataaccagtgcattccagtctgggcaatgtagttaaaccccattaaataaataaataaataagt

SEQ ID NO: 234459 - DNA, 555 bp, Homo sapiens
gattcctgacccagagaaactggaacactaaggcccattcttcctctcaagtatccagaaataaagttgctccaagtaacaagtggacagcataaaagattgtatggaaactataatgcatctacatctgcagtaactaatcataaaatgatttgtatgatcattcttcacatgattagaattactatgggaaagaagaaaaagaaattcctctctggatggtggctataacctatagccttgcccactacgactcagggtttggtactggctgtgcctttcatgggatgctttcttatcctggtcgatggcctaaagcccaactgtccagcttacatccaggaatacactttactgaatcatgaaaagctgtaaatagctgaaaagaaaaatgtggtcttgactctgaaaaacaacaaaaaggatcagcaacatttcaagcaacaagtcataaaacgattactgtggtcttgtattagttcagtccatgcagtgaactttgtctgacattgggcctgcagtcctcataaacataccagctatctctgagagtcc

SEQ ID NO: 234460 - DNA, 526 bp, Homo sapiens
gctgttattttacctcttctttcttctatttggttcttttgagcttttcattgcagcgagggaggaaaagaggcagagaaaatagagagagaaaataaaaattggacccctttgctatttgttagcctgttctattattgttttgttttataatgttcctgttggaaaagatcaaaacaattttgctccagtggaaatctctttatctctctggcctcagtttttaggcaataaaaaagactgggcgggaagatttcagcctcaacagtcaatgaccttgattctggaggagggaaattaccatgaattccaatgacctccacacaaataacaaagtttagtaagctgtaatgtagctaattttagggcatagtctagatattctttatcctatcaatctcattctgtagtggagtattccaaacttgtgattttagtaaaaataaaatcatctaggagtaaaacgaccacttctggattatgagacatctccatggaggtaataaattgctctttatttaagtgt

SEQ ID NO: 234461 - DNA, 708 bp, Homo sapiens
caaaaagaaaaaaaagatgaaaggaatgggaatgggggaaaaaaaagaaaaaaaagggggaatgaataaaagtagttagcttggttaagtctgctaagacaatgaatgcctggatatacagttatgggtccagaggcattttaagacatggttcagagacagattcttgatctgttggctgttaacactgtactaaccttcatgtcttgttcagccttcaacgcagcctgggcctgattacctctgactccagatagtgatccacaaggacccctggctacatgtggcaaacgagcatggctcatgaggcctgtggtcagcggaggaggcatctgactggccagtgccattggtggcctctgaacaggcgctgggaaggtgttagtatgtggggctcttaccaatggagggaccaggttaggctgagagagaatctgagtgaaaaaaacaaaacatacaacattgaactgttaaaaaaaaaaaaaaaaaaaaaactgccaactagaccaggttggctcatcccagagtaaatctgtgcccatcctaccagtgaaaggaagtgtacagattgtgccattccattaacaaggacaaggaataaacaggccatgcttggagagtttaacagaaaaactaggcaaagcatgctatggcacttcagttggtcctagcatctcagttgtaaattctgaaggggggatagaaaga

SEQ ID NO: 234462 - DNA, 414 bp, Homo sapiens
tgaaagaaaaaaatttaaagttaaaagaaaacttagtaatgtgaataccctttcaaagtatttttagaaatctcattattgtatatttagaagattaaaagacaagaattagagaacaaaaacaattttattttctattttgaataataaatactatagagataggtttgctcaaaattgtaaagcttgttttgtttttggtaaacatttgagaacttaaacttattatttggaaaaaaacattttaatagaaattttactttttaaaaggtttatgtggtttttaaaaaaagcaaaaaacatttgtttatgactaatcttgaaattttatatgtaatttaaaatgccatgtaagcaggaaggtactcatttaggagaaattacaaaactacttccttttcttttaaatgatta

SEQ ID NO: 234463 - DNA, 462 bp, Homo sapiens
  misc_feature (364)..(364): n is a, c, g, or t
aaggatgccctctcttctaggagcggattaacagggcaaagtgggaaaaagagcgaaagaaatgtagagatgccaccttggtgggcaaatctgagatgcctcccgcggaaagagacgcaacttccagacccgctccagttctccacttgggcgggaagctttgcgctcccagctggaagacgcctcccgagcgctcgctgcgcccttcaagcaagatcctagcaaccagagcttcagggtgggggtgggggcggggggacgctgaccggctcccacctgcttgctcctagaaagatcctagctcagattaaagggatgaagcgctaaggtcgacttgtccagaaaagagctcacggtgagttcnaccaccccctataccaattcatcgagtggcctcctacgcatcagcagagcacccccggggattctgtcagacatgaaccccgaaactggaagcggccg

SEQ ID NO: 234464 - DNA, 296 bp, Homo sapiens
ttaatttgatagaaattaaagaagttgattgtagcttttaggcatctgtgatatggaatacacagtatgggtgaaagactggtgagctagagatgactttagaagataaacattccttttggaatcttcacaatttatgtagatgtcaagggtctggtagaaagtaactgacatctgagttataaaaagaccacgagagaaaagaggttactcttaagccacagtgtagggaggcttgatgaaaatccacagtgaattcttacctctgactcttattttccagctacttaaataat

SEQ ID NO: 234465 - DNA, 448 bp, Homo sapiens
ctttgtagaaactgattttttacctgctcatattcacccaaaaaaaggagccggatgtggctaacagaagttcagcaggactcacgagggctatctcaggtcagtgaaaacaggatatctaatgccttttcctctttctgttttgttttgacacggagtctcggtctgtcactcaggctggagtgcagtggcatgatctctgctcactgcaggcttcacctcccgggttcaagcaattctcctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggc

SEQ ID NO: 234466 - DNA, 643 bp, Homo sapiens
gtagtgggcctgtaagttgaagatccaaaggagatacagagtgaaggggttaagcgagccagctgggtacaatggtagctaagttaacagacgtgaccttaagggcaagagacgggcacttgaggtttagaggtacttggggcagggattcaggcgtattaagctgtttgaatatgttggacattaacatgctttcaaaagttgaaactatgccaagaaagtataccccaatatccaagtctcactccctcccacatcccttccacctcactctcccttctacctcttgtaactaattttactgttttctgctttatccttcctgaacatacacattctttaattctccctttttcttgtatgacaagtagcactatgggtatttgtttctgctttttgtttcatgtaatatttcctggaaattactccatatatttataaaaacagatagcttttataaacatagtagtctattgtatgttccagagtatattcaaccaatcttctagaactggtcatttatatggtttccaatattttgcaattattaataatgctgcatgaataaccttcacaaaattatttccaaatgcaatacagactaaatttctgaattatactaactcctatgtgtgcagcattt

SEQ ID NO: 234467 - DNA, 410 bp, Homo sapiens
acccacctatgtacgcggctctcattgaactgtttcaacatagcatagtcaatatgctagtcacactactgttttctgctttatccttcctgaacatacacattctttaattctccctttttcttgtatgacaagtagcactatgggtatttgtttctgctttttgtttcatgtaatatttcctggaaattactccatatatttataaaaacagatagcttttataaacatagtagtctattgtatgttccagagtatattcaaccaatcttctagaactggtcatttatatggtttccaatattttgcaattattaataatgctgcatgaataaccttcacaaaattatttccaaatgcaatacagactaaatttctgaattatactaactcctatgtgtgcagcattt

SEQ ID NO: 234468 - DNA, 589 bp, Homo sapiens
gtagtgggcctgtaagttgaagatccaaaggagatacagagtgaaggggttaagcgagccagctgggtacaatggtagctaagttaacagacgtgaccttaagggcaagagacgggcacttgaggtttagaggtacttggggcagggattcaggcgtattaagctgtttgaatatgttggacattaacatgctttcaaaagttgaaactatgccaagaaagtataccccaatatccaagtctcactcctgttttctgctttatccttcctgaacatacacattctttaattctccctttttcttgtatgacaagtagcactatgggtatttgtttctgctttttgtttcatgtaatatttcctggaaattactccatatatttataaaaacagatagcttttataaacatagtagtctattgtatgttccagagtatattcaaccaatcttctagaactggtcatttatatggtttccaatattttgcaattattaataatgctgcatgaataaccttcacaaaattatttccaaatgcaatacagactaaatttctgaattatactaactcctatgtgtgcagcattt

SEQ ID NO: 234469 - DNA, 646 bp, Homo sapiens
gatatctgagagcaaccttctgccaggatttgccctgcccacaggcgttagcatggacttgatgactgcggtgtggcttttactttctcaattttccagagctcatactcctcaaactccagaggaataagatggccagcagtcaggaaggagatttgaatgtggagcacagcagagtgagcacgagctgaaaccctccaagcatattttcatcactgtattgcctgtgaacatcttcagagtgtgatgactcctacttcctctgaatctcatgtgagttcctcttttggcagctctaactctaaccttacaggaaaggggaatatagaaaacacagttcccagaaagaactagttccaaccagtcgattgaaccactcagcacagcttctaaaagaggactccctggactgttagggtcttggaaaccatgtcacacaaaaattgtctcatgtaactgaagataatcattctggagagcagaggattaaaaagaggcatgccattaaatattagaaacacttctgtgtcgaagacaaaaattgacttacacctataaattcttcagattttctctcctaaattctatggaaatgtatcaatattttcactgattaaaatttttttcccacctgttcaaactcttc

SEQ ID NO: 234470 - DNA, 383 bp, Homo sapiens
cagggggcagtgtggctccacagtccatcacagggcacccccccgccccaccgaccccgacagtgcccacagcccctgccatccaaccagggctgggcctcagcctgggggacagcttctgtgtagtttggttcagaatgtgtcctcataagaaaggcggcacctcccagattccttccctgccctctgccgggaagtcttactgccaaaacacccaggaatgtgtgtctgcctccagcaactttagctgcaggggctggacctggctttgatgctgcggcagctgatgggatcctggagcacagtgtgggaagctggctccttaggcctgggaacaagcccaggcaaccgggctgggactcgctctgcctggctgcctctcc

SEQ ID NO: 234471 - DNA, 474 bp, Homo sapiens
cagactgggtgatttataaggaaaacaagtttattcctgcagttctggggactggggagtccaagagcacagcaggcaccagatctggtgagggccttcttgctgcattgtaatgtggtggagggcgtcacgtggtgagagggtattagcatgcaggtcagccaccagtcctgtcatgggggccccatgctgatggccttatctaatcctaattatttcccaaaggccccacctccaatcatcatatgaattttgtgattaagtttccaacacataaaactaacatgtaggacacattggggacacattcataccatagtatatcacattgctcctgtttttgaattctggctcttctacttactggccgagtcccattgggcaattatttaatgtttcccccctcaaagttttctctgcaaaataagggttactagagtaataacaataaaaacaataattcgtgtttattgg

SEQ ID NO: 234472 - DNA, 672 bp, Homo sapiens
ttaagtcttctaccttgagttggtttttgtataaggtgagagatgaggatagctttgtcttttcaatgcagagtctatgagctctgcctgggtttcccctccctgtactgtggcctagaaattgtcctgaggcagtaagctaggacaatcacagggctcacctttgtttcccatctttcagggattactgtccattgcctgatgttcagggtcttaaaaaccattattttgtatatgttgtctattttttgtttgtttcacgtgacagggtcaacctggtccctttgtttcatctttttggaagtgaaattccctgtcttttacaattttcattctattcctatcagtttctcttcagtgtggggctccgtattggagaggaggcctggttgctcaattttccaagttcacagaggtccagactattctagccccttcatattttctttggcctccttgccttcatgcactattatactggacaaaacctcccccagtttcggtgctgttcccacattgccttgccatgctttctggtgagtatcttttggatgctttgagtttcttctgctttcaggtctgatcatctctctctgcttttttcagcacagagctgataccctgcaattcttggggctattggtggtctgtcctcatccacatatattttgg

SEQ ID NO: 234473 - DNA, 623 bp, Homo sapiens
acagagcacaggggctgactgctttgtgctcttccaggtgggatcattacttgccagccttccagctgatgccagtggcaacagcacgacaggctgaactggattctttatgactatgtattcattagggggaaaaagcacttccaatgcaaatgattgaaatggaaacaagatgtgcactctgctgcctaaatgaaagctctaccaggtaggccattcaaactcaattaagagtagcaaaacaggatctatcaggacagtggctgtaacccctgtcacagagaatggacagtgagcggtccaaatggattggggggcatgaatggcacctgacttacagcaggagctcagcacttttactctctttgccgcttcactggaaccaggagaaaaagacattaggatgaaggataatgtgtgatacacacataaagatgaaagcgagagggacacatgcaatgtcacttattggaaggaccactttaggctgctctgtcctctctcccctgaaaacatgttccacattgttttaaccatctgtggcccactctggagctcaaggaaccctggcctttctgctttattgtgagcacagccatatgaaactgcaatctggcagctga

SEQ ID NO: 234474 - DNA, 493 bp, Homo sapiens
gcaagtctgattttaaaaaaaaaaattaagttacacaaagtgcaacttctgataggagtacctgttgcttgaaagagtggaaatctgggaagatggtagagtgagattttctttcaaacaatggctctgaaattgtgcatttgtcaaagatttggttaaaataaagcattgaggaccttaccagagctctcttcttactgatagagatgaattaagaaacttcccaattgtctcatatcttatttctacttactggtaatctctactgtctttcctctttagaatcccaaactcctggcacatggcaggatatttttgtgaattaattaacacatgagacatgtttttgtgaattagacaagtactcaattacttgagacaagtactcaaacaagtctcaagaattacatgagacaagtactcaaacaaaaagaaacaattagttgtctttttaataaaaatatacacactttaaaactaacatcatgggaaa

SEQ ID NO: 234475 - DNA, 396 bp, Homo sapiens
gtcgggctgggactcgggttctttcgatttcggtgagagggaagccactgggaccaggaggcttggaaggaggtttgtctcctggggcctgaagacagtagagggaggaaagttttctgagatactccacagccccgttcttccaggaacccctagctgaagtgggcattgggcgaagagtaaactcttgaatctttccctctgagctaggaggataagaagggtccccaaccctctggaagccaatgagcttgtaaagttaacctggtccgcgaagcgtctgaacagatcagcctgctcacctcagcctatctctaggtgctggattccaatctgagacagtttctcaaattagccctaaagaggagtgaataccacggggctggtcctctggtg

SEQ ID NO: 234476 - DNA, 544 bp, Homo sapiens
ataccaatttggatagcatatctctactgtcaacaaacagtagtctgcactggtactggcaaaataaaaccgtatttgagcatggcatttaaagtggagatacttttttttctaggtcaagtattgactaaggtaagactgtaatttttcatgacacatgagatttaacgaaatttgttaaccaagaacatctttgagcaatgtctcttttgatgttgctactaactgtatttgatgttatgtaaaactttgttgggcaataaatataatgttctacttttgtatgatacagtgtgtatgagtcgggagcttcctgaactttgtgttttatgataccttttgagagaagatcatcaatacttctagaagccataataatttgctatttattcacagccaggaattggtaatactaaatgccgttagtcagtatgctggccaatatagtaagagtgacttgtgactggttattaattgaacaggtttttcagcacatacctattataagttcttgctttttccatcctagaaaattcaggactga

SEQ ID NO: 234477 - DNA, 309 bp, Homo sapiens
atatgggacagtaatgaccacataataaatgagttcgcacgcaaagaggttcttctgcagggcctgagccactgagacatctgccagtttaatccacacagaaactacacttggttatgcttttagctttcttgtgacaggctaggagcaaagtagattcttcacaaataatcactgggtggacattattaagaatgatcacctccagacacctctgacctggacaggttctgcctttagttcctccaatgacaactggctgcccacaggctaatcccccaaagctttatttagagtgaaattcaaggc

SEQ ID NO: 234478 - DNA, 1153 bp, Homo sapiens
ggctggtacaggtccggagaagtaaggatgtgcagaaggtgcaagccagagctcaggcagaacttccagagtgcatctgggatctgcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaaggagactcgggctgtggaacggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctga

SEQ ID NO: 234479 - DNA, 481 bp, Homo sapiens
ggaagatttcctcagctttactttttaaacttctgattgaattttaaaaatcttgttacacattcagggagtatatgtgcaaattttttgcatggatatgttgtgtaatggtcaggtttgggctgctagtatacacatcacccaagcagtgaatgttgttcccaataggtaagttttcaatccttttccccctttctccttccccctttggagcccccagtgtctatgatttccatctttatgtccatgtgcatccattgtttatctctcacttataagtgagaacatgcagtatttgattttgtgtttctgagttaattcagttaggatgatggccttcagctccatccatgttgctgtaaaagacatgatttcattcttttttatggctgcatggttgaattttagatttttaaaattatgcttttaatttttgttttttgatttttagatttctctccatacattactttaaaaaaag

SEQ ID NO: 234480 - DNA, 731 bp, Homo sapiens
tgctggcattttatccagacaccagaagaacatgatcattgtaagtatatttgttatctctcctacctccaccccctacaagaattcttaaaaatactgctagtgagtgcatagggaggatccgtatctcatttcttttgtgtggttcatgtaattctgtcatctttgacttctataatgatgcctaggtagggaagagtgccaaatggtccttagccctcaaattcctgccaattgctgagttgctgatagtattctctactgcaggggatataccaggacaattagctttagctcaaaaccatttatcagagaatgtgggagactgactcctggcacttgtttgtgtcatgtgagatatgctatttgtctaaaaactatccttttcacatttaatagttactgtttgctagtcagaacttccaaaatcttttccttggagatttccttctgaaaatgtcagtatctcctgactttcagagcaaattgagggttactgttcttaacaggtatctcattctgccttcaagtgtggttacttgatacagatgtcttctttccccttcctcgtggattcgttgtggtctctgcagcagtatttctcagtgtgtgttctatgggctgcctatatccgcatcatttagagtccttgttaacgaggcaattccaggggcccaaccttacttagagtatccaggattcttcactttaaatagccatcatactctccc

SEQ ID NO: 234481 - DNA, 198 bp, Homo sapiens
tggttttactgaggtggaggtgctgatggaaggatggtggtggacattccatagacaatgctgcacagcgaactctcaaaggttttctggagaatccataaataactgaatttggatttttcagaatttggcttcttcaaggataaaaatgtgcaaattacctctttgctagttgttagctaatcagtttacctaaaa

SEQ ID NO: 234482 - DNA, 343 bp, Homo sapiens
ggtccattcacttgcccagagcacacagtcatcagagacagttgggatccaagctcacgtctgtctgactcctggcaggcactgccctgtaccttggccattttccaacctgtgttttctgcggggccctccaacagcaccatggaaaggtgtcctgtacgcagccccttcaggccagctccacctgtgtggtttcttacacactcacagctttcatttgagctgggcatggtcacgtgcgtctgtgatcttagcttctcaaaggttcaggcaggaggatggcttgagcccaggagtttgagaccaggctgggcaacatagagagacctgtttcaaaaaaaaa

SEQ ID NO: 234483 - DNA, 577 bp, Homo sapiens
cccattttcctcctttctcttttaagttgtagcttaatatgcttaaaccaaatgacaccttcctttgctaccattcaatactttccataaagcccttacagaattaatcactccctcctgttttcccaaagcactttgatttcactactataataagctcttttcactttatattataattagttatgcatgtgtctgcatcccatacaaaagtgttggctgttttgtgtctttgtttcttcagcctctaatacaatgcctgtgacattgtattgtactgatttagtttgagatgctcagacttcaaatttagacagaatttaccagagtatcctgaacatatcatgagaaaacaacatctggaacgtgaattctgtgctttccttccttttaatgactctgagcacaaagcagatggaatcaactgttaatatgttgcccaatgtgatgaatggcctcagctgtgtccatggctccgtaatcttcaggctgcttccctgaatgtcttgaatgtgttaggtgcttaacaaatatttgtgtgttaaacgagttaataaaaacagtagaaataatgtta

SEQ ID NO: 234484 - DNA, 452 bp, Homo sapiens
gcagtgggtaccgcggctgctctggcttctcctggaatctcaggtgctccctcttgtggctgttctcagcctagacaaccagaaagccgcagaaaagcaccagccaaggccgaggctgcgagggtgctggcgggcaggcccatcacggggctggctgtcctggtccgcgattccttgtcagccattttcctcagggggagcggcaaacgccaacctggactgaactcatctggggacaaccctggcttggaggagggtcatgtggctatttgcagactttacttctcttactgtgaacacccatgtgctctgctgcctaaaacataacatgtttgacaatgtgatgcggcccagacctaccatggatgccatgtcacgtacgtactatgcatccgacaacagggccaggaagcagaaggttccggaacacgactttcccagctgagctcaga

SEQ ID NO: 234485 - DNA, 389 bp, Homo sapiens
cagtcattgatttttccattttcttaacattaacaaccatatttatcattcttttggtatttgagagataaactatcagaaaggaaaatccataggatgccttaataacagacacattctcagccagacccatattagaaaagaatacatatggtaattgaaattttaaaatgaaagttttttaataatcttcatgaccatgtactcctaggaaagttttcatatattcccatgtgttcctacaaatcacatctaagactactagagtaaagtaaagaactggcctaaaggcaggagaatcacttgaacccgggaggtggagttgcagtgagccgcgatcatgctggcgcactccagcctgggtgagagagacagagactccatctcaa

SEQ ID NO: 234486 - DNA, 392 bp, Homo sapiens
gagaacttttttttgagagagagagagtataactattgttgcctaggctggagtgcaatggcacagatctcggctcactgcaatctccgcctcccaggttcaagcgattctcctgcctcagcctcccgagtagttgggaatacaggtgctacaggtgcctaccaccacgcccagctaattttttgtatttttagtagaaatggggtttcaccatgttagccaggctggtctcaaactcttgacctcaggtgatctgcctgcctcagcctcccaaagtgctgggattacaggcgtgagccaccgtgcctggtcaggagaacaatatttaagaaaaaaaattgcagcaatgaatcagatagactcaatttctgaatttttgctacagcacatgt

SEQ ID NO: 234487 - DNA, 265 bp, Homo sapiens
aatagatttgtggctcagaatgaggaagaaagggatggcccttctctctttactggtataggaccaaaatttaggcaaaatttagaactagatgaatttaatctctaggcagccttctccaaaccccttctcccctgacctctaaggtctgaattcaatgttccttctgtgtgctcccatgttctcagtcacccttgatagtattatcacactgcatggcttaagaatgccagtaaggttttggtgcctcagtcacatcctgctc

SEQ ID NO: 234488 - DNA, 454 bp, Homo sapiens
ggtaattgtgagtattgttaaactcagctcttctttgaggtagtaccaagaagttagtcaacaatttaagctctttaatcattatagtcattgttggtaaagctaacatgttgcaaaccatcaatggctacttatagccattgtttttattatacctattaccttgttcagtttcagtttttagttttaattattgcattgagtatccaactatgacagaagacacatttaagagaccaagtgtcatttattgaaagcaacttttattatggcaaaagggaaagaataattttctatatgaagagccacagtggacattttctgaaatataaactagaaagaatgcatgtgaactgaatatttttctatctcttcaaatgtcaattacatgtcacatgctgataaataagggcttaatatgagaatacattaaggactttaaaattatctatag

SEQ ID NO: 234489 - DNA, 395 bp, Homo sapiens
gaaatcaaggcttgctgctgacaaaatataaatcatgccatatgatgccaattctaaaatgccattaattctcctccattaacccctgcagagtattcactgactgctgaaactagagcatcactgagaagcaagagatagactgacctaactagagggagagctgccatccaggatgatgccaccatcacaggaggtgagaaggaacacagcatcttctgcaaatgctacagtaaatagggacggggtgcaggtaagatcactgaccccaggtcactgaccccagtattctcagagccaacagctaactttgcaggagagccctgagccaattactagatatgtaaactttaaaaaaaatgcttaagtcatcaaaatttatttttttcaatggc

SEQ ID NO: 234490 - DNA, 526 bp, Homo sapiens
tgtattaaagatctaatagtttggatttttgtttcacattttagtcttgttttggccatatggtctatacttctaacagtaatgatgggaaaatgttagagttttgggggacagactctaggtcaacagtgaaaaggtttaacagccactccccacttctgaacctccatcacccttgaatttaaaggtattatacctgacaataaagttacatgtgaaaaatacatgacttgaaagacaaactttcttaaaaatgtcactaaatttcaaatctcaaggtcaaacaagtctgagatgtttgctttcagcatattttatgattacttcatgtctcaaaaatgggaattacttgcaagttaatgggtaactttaaggtgtgacttcatttaggtttcctgttagtctttttttttttttaaataaaatcagtttgtgaacaaaatggggttttcaaacctcagtccagcctcctcactcaaaggggcaaaaaagcaaccaaaaacctcaaagcaagtaaaaaacaagc

SEQ ID NO: 234491 - DNA, 376 bp, Homo sapiens
gagtttgcagtgagccgagatagcaccactgcagtccggcctgggcgaaagagtgagactccgtctcaaaaaaaaaaaaaaaaaaaaaaagacaaaatgtaaactgtctacatctaggttaacacaatacatgttatagtaatctgtatgtatttataacaagatttgaagaaataaagaataaattcagtacttttttccctctcaaaaatgttaagaatggtcaagggtctcttaacctcatcctggttactattcaaaaattgaagagaatcagtccaccttgacccattttggccaatagagcgatacggggtctgtccatggtcctgaaatctttagcattttcatcaagtgctaaatttgcaaactttcc

SEQ ID NO: 234492 - DNA, 410 bp, Homo sapiens
gtattcaaaagattgcatttccccacacttacccccttcgaacacatttaatctttctccagttaaaaatgaaagaaggtaatgctttgatcctcatcacatttttgttctttactaataaagttattcaatatgtcatttgtagctagaagcttattgaataaaatatatgaagaaaagaatgcaacactacaatttcttccctgagatagtcttagagctctttcaggagtttccaattcttgatagcactaactttctccaagatttcgaggattaaaaaaaaaaaacactataaaagtaaatgcccaaatgcacccaccctagaacaagtttgcccctcgttgaggagcctgctgttcttaggttgtgtcatatcccctgtggatttatgctcatgcagtaggaaa

SEQ ID NO: 234493 - DNA, 377 bp, Homo sapiens
ttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaaatgccgtctctactaagaatacaaaaatgagccgggcacggtggcacgcacctgtaatcccaggtactccgaaggatgaggcaggataattgtttgaactcaggaggtggaggttgcagtgagccaaaatcatgccactgcactccagcctgggtgacagagtgagtctctgtctcaaa

SEQ ID NO: 234494 - DNA, 372 bp, Homo sapiens
ggaaaggcaggggaggtggggcaaaggcatttgcagctggggcctaccagtggcttaaatgagactcaagaattctggggtggtggtggaggctgacatgatggagggaaggttctgggttgggtgagactggacagcagagtgaggctagatgatgaaggaagtccctggacccaagcaccacctccctattggacatgtgggcacacaagatccctgggaggtagacaaggggggttgagtcattcagtctctaaggctgggggaggctccttgcccacactgcctgcctgcacccccatcccttcctgctgacgtgggcccacgatgccacagtgggcaccagatgtgggttctgactctctctgagga

SEQ ID NO: 234495 - DNA, 634 bp, Homo sapiens
ttaacaataaacaaacatcagacaggaataaatgctatgcagggaattagcttcataggaagtttctttgcattttctttgggttgccctttcaaaacacatataagaagcttataaagcccatattccaatgttagagtactagacaggcttgccatcctcatcagaagttgtaccatgctccccttaatttaatgtgcaggaaaattgcagcaatatatgagtggtcccaataagtttgtttttctaaagagtagaagattagttgctttaaccagaatctatttgatagataaggtatttgaaattaaatgttttattttcttatatgtttaaatgtattcttgtctaattttataatatttatatttaagattgatacaatcaaacactcctagatatagaaagtattttagaagtaatatttactttatttttttcccactgtaagcatactttataaatcatccttgacaaatagttgaacaagacctactgaaatttatggtctgggtgatttagaggttgaaggtgtcactaacaggcaagaggacacaggaaaatgatcagatttaggccatagaggaaatacagggagggcatggtgagatttgtttcagagcagagcttctca

SEQ ID NO: 234496 - DNA, 358 bp, Homo sapiens
acctaccttagcctcccaaagtgctgggattacacgcatgagccactgcgcccactccgcattattaaatatagaacatttatttgattcatcagttaatattcttcttaaaagtactattttaatgtagcaagattgctttccaccaaaaggtggggtttccacggtggggtttccaaattattctcaatggggtgaggatgtgtgttatcacacccccgagccatcagatgctgtcagaaagtgatcactctgaagtctttgtttcaaataagcacagggtttggataaagagacgcaattaggaaaggaaaaagcagaaggctcgttccagacctggatgagatcctaaaaagca

SEQ ID NO: 234497 - DNA, 435 bp, Homo sapiens
gggtccctgttctcactccacagcggacgaggtgccactgtgcccccctctgcaaacaggaaccgggggctccacaaagtgagtgccccccagagggggactcacatctatcggtccaaactgcacctttctgtaagcccctcgctgtgtcacagacctcggccaaagtgaagcattccgcaggggtttgggccgtgaggaacagcctgcccgacacctgacttgaacactctgcggggaaaaacaccgaggaacatcacgattaccttctgcgggaacaagggccaaacaaacggcctcatcctgaagccgtgtggcccgggccgctcccacccatacctataggcaccccagcccgtaggcggcagtgggctctggcatccagctggtcccccacctctgcaggtgtttgcaatgtacccgtgttgatgtaag

SEQ ID NO: 234498 - DNA, 911 bp, Homo sapiens
aacggtatgattccgcttaagttccaatataggcagaactcaacaaaaaattgcttaggtatgtatacatatataggtggtaaaagtataaagaaaatcaagaaaataattaacaacattcagagtaataattatctctggagaataggaaggaggatttggttaaggtggggttctaaagtacctggtactattttataaaatgattttttttttttttttgagactaaatctcactctattgcctaggctggagtgcagtggcatgatcttggctcactgtaacctctgcctcctgggttctactgattctcctccctcagcctcctgtgtagctgggattacaggtgcccgccaccatgcccagctaatttttgtatttttagtagagacggggtttcaccatgttggccaggctggtttcgaactcctgacctcagtccgcccaccttggcctcccaaagtgctgggattacaggcatgagccactgcacctggcataaaatgattattgacttttaggtagatggtgtttgtttgaattaaaatttatacaatcttttacatgtgttattttattttgtaacttaaaaactatgaaaatcctcaacctcaatggaaattaacactatattgaataaagataacctacagactgggaaaaaaacatttgcaaattgtatttctgatgagagtttaataactagcttatctaagaaactcttacaactcagccccaaaagacaacctaattgaaaaatgggcctaattgaatagacatttctccataaaagatgtagaaatggacaacaagcacatgaaaagatgttcaccatcattgatcattaaggaattgcaaatcaaagccataatgagataccacttcacacctgctagggtggcttttattt

SEQ ID NO: 234499 - DNA, 416 bp, Homo sapiens
gagataagtgctgcatattaataattaagaccacatgcatattcgccaacaaaagaaaagtttcaaacccccattccgggaacagctgcccgtgtggggcccggcagggctgtggaggcccaccccacagactctctcttctaggaggaccagccaggggctcctctccaagccagtgcctcccccagcaccagggggcctggcctccagagtgggcagggggagtgtgtcaggggcgctgagcccagagtggaatggggaacgccagcaccaccgtggagtggtcctcacacacccacagagcccaaaccaccaggcagggtcccccaaccccaacaccaggcaggctctagccaccctgtcggttcccaataagccatttattgaataaagattgaatccaaaactccaggttc

SEQ ID NO: 234500 - DNA, 593 bp, Homo sapiens
taaaattttttataaaattcttttttatttttatttttagcagaggtgaggtttctgaggtttcattatgttgcccaggctggtcttgaactcctgagctcaagtgatcctcccacctcagccttccaaagtgctggaattgcagacatgagccaccgcgcccctcctgtttttctctaattaatggtgtctttctttgtctttctggtaataagcaaaaagttcttcatttgatttggttaaatttataactgttttctcatatggttaacattttttcttgcctggctaaagaaatccttttctgcccaatactataaagaggtttgcccacattttattccaaaagttttaagttttgtctttcatcttgaagtctaatgtatcaggaactggcttttgtgcctgttgggaggtagtgatccaattccatgtcttgcatgtaggtaaccactggtccctgcgccatgtattcaatacgtcgtctttctcctgcgggtctgcaatctcacctaccatccatcaagtttccatagggccatgggtctgcttctgggctccctgttctgttccattgtcaatttgtctatcct

SEQ ID NO: 234501 - DNA, 1903 bp, Homo sapiens
  misc_feature (752)..(752): n is a, c, g, or t
gatagggtgatacatcaaaatataaatggaatgtaattagtcccatgaaatatatgtatacattccccacttttgctatgctagcctttattcactttcctcatttctgcctttctacacatttacttcttgtcactctgggatgttatctttcattttcatttcattatcttatcctttattcccctccttttccaactttcctgttttaataagagcatttttccgaagtatgagattctcttttgattcattatttgatttacttagtcacattttcattttttattttttcaggttcgttcattcccacccccattccttcatccatgtccccgttgtctcttgctgtagtccacctttttccttctgggccttatttaactgtcttttgatatctccccttcctgaggaccttctgtttcttaatttttttcctcttgtctccttttttgctcgtttcttaataaaatggtgctctgagtaaaacgcatgttgtgtgcaaagttctaaatttttcttaatcatagcaagatgaataaggcatggttcttgcctgtaaagaaggcagcattcacaaagacttttatttttattttatttttatttttttgagacggagtctcgccctgtcacccaggctggagtgcagtggtgtgagctcggctcactgcaacctctgccacacgggttcaggtgattctcttgcctcagcctctgaagtagctgggattacaggcatgtgtcaccangcccggctaatttttgtatttttagtagagatggggtttgccatgtaggccaggctggtcccaaactcctgacctcatgtaatccacccacctcagcctcccaaagtgctgggattacaggcttaagccaccacgcccggcctaaggctttgttttcttattgtctagtatgccaactttaactgtgccaccgcacccaggagcattcaaaaagacttctgacgcacgcctctaaaatgtatcctgttcgtttgtcagctgggcccttaatattttgtgataatttttttactcatttctaattgtttcactttcacacttgcctcattttcttttcttccctgaagccccatctcagtcaccattgtgttagaagctggcttgcctccagattcacacacaaaaaagataccattgatcatacattttctcaacttttgatttcctcttctctcccttcaagccccacacttcacctggtaaatcgtccagtacatctcaagttgcatacattcctacctcattttctatttcacaaggagtggctcacctccttgcctgtggcatagtaatttttatatgcccagtacctggctcacgagaggaacttaaacatctgtggatccaaattaaggtacattttcccacccgtactcttgaaaccatttcctccactctttatggcccatcacttacttttgccatgttttcatttccttgacttatttttgttagtttttgagggcagaatttccatctctgattcccaacatcttagtaagtagcagaaattctcaaaacagttttgcaatgagagaataaacactgaatccatcatgttgtctgctatgaaaactggtaacaggctgggtgcaatggctcacacctataatcccagcactttgggaggctgagggaggcggatcacttgaggtcaggagttcaagaccagcctggccaacatggtgaaaccccgtctctactaaaaacagacaaaaaaaattagccaggcatggcggctggcacctataatcccagttactcgggaggatgagtcaggagaattgcttgaacccaggagatggaggttgcagtgagctgagattgtgccactgcactccagcctgggcaacagagtgggactccatctc

SEQ ID NO: 234502 - DNA, 1132 bp, Homo sapiens
gggctgggcacggtggctcatgcctgtaatcccagtactttgggagaccgagacctcatgtaatccacccacctcagcctcccaaagtgctgggattacaggcttaagccaccacgcccggcctaaggctttgttttcttattgtctagtatgccaactttaactgtgccaccgcacccaggagcattcaaaaagacttctgacgcacgcctctaaaatgtatcctgttcgtttgtcagctgggcccttaatattttgtgataatttttttactcatttctaattgtttcactttcacacttgcctcattttcttttcttccctgaagccccatctcagtcaccattgtgttagaagctggcttgcctccagattcacacacaaaaaagataccattgatcatacattttctcaacttttgatttcctcttctctcccttcaagccccacacttcacctggtaaatcgtccagtacatctcaagttgcatacattcctacctcattttctatttcacaaggagtggctcacctccttgcctgtggcatagtaatttttatatgcccagtacctggctcacgagaggaacttaaacatctgtggatccaaattaaggtacattttcccacccgtactcttgaaaccatttcctccactctttatggcccatcacttacttttgccatgttttcatttccttgacttatttttgttagtttttgagggcagaatttccatctctgattcccaacatcttagtaagtagcagaaattctcaaaacagttttgcaatgagagaataaacactgaatccatcatgttgtctgctatgaaaactggtaacaggctgggtgcaatggctcacacctataatcccagcactttgggaggctgagggaggcggatcacttgaggtcaggagttcaagaccagcctggccaacatggtgaaaccccgtctctactaaaaacagacaaaaaaaattagccaggcatggcggctggcacctataatcccagttactcgggaggatgagtcaggagaattgcttgaacccaggagatggaggttgcagtgagctgagattgtgccactgcactccagcctgggcaacagagtgggactccatctc

SEQ ID NO: 234503 - DNA, 887 bp, Homo sapiens
tgaccctggcttactttatgtaaatttaccgttagtaaatgataatggggtctcccatttctcatttgttacacaaacattatatggaaacattatagtttttaaaaagaaggaagccttccaaaggccaattccctaacttactggcacccttctgagttgcattcgagtcacgtaccaggtactgtcatttcatgtttataaaattttgtgtcctgttgtttttcgaaaagcaaacgtgtatgacagcgtttgaaccctccacccctccccttctgtgaacactgggctaagtcacaaagataaagaagagaaaactcgcggtagggggctattaatggagagagcaccaggtggttccctgcagacacagaaccagctccagctggtgacccttgagagtctctcccgcagaatctcggaggctgaccctcgaccaccagcgtggaggaatcctatgccctcacgtaagtcccaaatgaggatctgcgggctgtgctgaaaaacaccaccttccagggaggctctgactggcagtgaggagtcacatgctcatcctctgaccaattacaggacggtactgggaacaggacacaaatgctgctggggtcacgtgactgactgatcacaagcaaaagatgcccgctgccactccatggcccaagatacgaacatgtttatttcttatttttattttttgtaaagatggggtcttgctatgttgcctaaggtggtcttcaactcctggcctcccaaagtgctgagattacaggcgtgagccacggcatcccgcctccagacatgtttttttatttttccagacggagtctttctcttttgcccagggtggagtgcagtggtgtgatctcggcccactgcaacctcca

SEQ ID NO: 234504 - DNA, 544 bp, Homo sapiens
tctagggaatatgactgttaacatttgaacactttcaaatagcagtacgttttactgtggttttgataacctgacatagaataagctgctgagatgcaaggataccttggtatatagaaagagccttagacttcgtatgaaaaaaacttaggttttatcttcagcctagccatctaatgtctctgtaactttacagacatctggtgtttcacttaacctctctgagacttagtttccttttctgtaaattgatagttgtggccaggcaccatggctcatacctgtaatcccagcattttgggaggctgaggcaggaggatcacttgagcctaggatcctccaggatacttgagaccagcctgggcaacatagggaattaaaaaactttttaaaaatcagctgggcgtggtagtgtgcctctgtggtcccagctattgaggaggctgtgggaggatcacatgagcatgggagggttgaggcttcagatagccgtggccacaccactgcactacagcctggacaacagagcaagaccctgtctcaa

SEQ ID NO: 234505 - DNA, 157 bp, Homo sapiens
caaactccagaagggggaagggtaggagtggggcaagaattgaaaaattacctattgggtaccatttttgctacgtgggtgatgggtatgctaggagcccaaacctcaccattacacaaacctgcacatgaaccccctgaatctgaaacaatataaa

SEQ ID NO: 234506 - DNA, 498 bp, Homo sapiens
ataccattagtagcccttgaaatggatctccaggaagtgctgactgttaatgactctgccctgatgctcctatgtgagcagaacaaagagataatgtctaagtttgcaggtagctgagcgctctaaattgatgactagctcagggagagggaggtgctgtgccatcctaagcctagaagacatcgccaaaggaacagtgggagattaacaactctcccatgttaggaggttgacttgccaaactgatggaagagtgacaaactgatagactgtggtgctgtgtcccttctacgagctgagggagggcttcacctgaggcagtcagaagtgctaagagaagatttatgtggtaagggagagggaatctttccaacaatagctattaattgactttcattttgtagaagaatattgtattaagtgtttggagataggaaaagtatggcatgctctcaggatgtttataatttacttggggagataaggcacatgattgaa

SEQ ID NO: 234507 - DNA, 343 bp, Homo sapiens
tttctttctaccagtgtgaaaacggactaatacagctgtgaaagaaatggagatacggctgggcgcagtgactcacacctgtaatcctagcactttgggaagccaaggccggtggatcacctgaggtcaggagtttgagaccagaacggccaacatggtgaaaccccgtctctaccaaaaatagaaaaattagccgggcatggtggtgcacacctgtagtcccagctactcgagaggctgaggcaggagaattgctggaacccaggaggcggcggttgcagtgagcagagatcatgctattgcacttcagcctgggcgacagagcaagactccatctcaaaaa

SEQ ID NO: 234508 - DNA, 457 bp, Homo sapiens
agatgagattcctctaatgggtgagtgcctggagaaggaggccctggacttccttaacggggaagaggagctgactggtgacctaggccttcactgatctaagaaggcagagccctggacctgaggcacaagcagactacatgctgcagcttgcccagaacaagaccctgagcagtcctttttttttctgaaatcaggttgcgcgtcatccaagatcctcttacaaagagaagccatgaacttccttggctcatggaaccctccacttggctcagaattgccactgtaaatcataatgtcaggtttgcatttcaactcttagaccaccatgtgtcaaccctgcctagagaattagaaagtaaaactagtcctcgcccaaaggaaatccaattgaaaccctagtcccttcctttttatacaatatatccagagacatcaggcaaaacaaaacaaaaca

SEQ ID NO: 234509 - DNA, 1966 bp, Homo sapiens
  misc_feature (922)..(922): n is a, c, g, or t
attctcccaaagtgttgggattacaggcgttagccaccgtgcctggctcttcaagtttttcagtgtatcccttgtcagatggatagtttacaaatatattcttcgatactgtaggttttctcttcgctttgttgtttcatttgctatgcagaagctttttagcccattgtaattccattttcctatatttgcttttgttgcttgtgctttgtaggtcttacccaaaaaatcttgacccaggccaatgtcctataacgtttctccaatattttcttctagtagttttatagtttctttcctgactgtgcagggacttgctgggagacgcaagcctctctgagccaacaagacctggtcccccagtgttggcctgacagcaacctcctcaggggcccagtctcagctccaaccattctactgcattccatctgtgctgaaacctgctgggagacatgcaccagcctgagccaaggagaaaggggtctcctttttggttttagaaaagagagggagaggatactgttttctgagtactgactttgatgaggtgccaagcaaccttagaaagctgctcatctgtctcatcttgtgtcacatgtcaagagtttcccacttttgcactaggtgtttgtagcattaacctaagtcctttggattgcctaataacactagacctgaagcagttgaatagacttatgattatgtgtttctattaaagaacttagatacctatctgaaatgtaatagtttgcaagttcccaatttaatttactattcatactttaaattagttaggaagactggaagaagtttaaatgcaactactgacctcatttcagttttcaagtcaacttgcaaatttttcaagtgacagcacttttgagataacggagttataggtttatcagcatgggtctggatntaaggtctggcattcctatggctatttaaattgctccagacacatatttctgaaaattatgatgataggagtaaataagtttctgggacataatgacatcaattctgtagtaaattcttttttcattaatatcctgcaaattatcaaattaatggataaaatacccaagtaattactccagagaatatacaagatgcattttaagtttgctagctttgcctttaaaaaatagctaattttctttcttgatgtatgggcaagaagagattggctagagtaaaaacaaagttactttcaacataacgatttctttatcataaatacaagcctcagctcactgactgtcatgtgattttaaagaatagctttcccagtgttttccctttgggacacagattatttaagtgctgaatacagtaacttaaatatcttcttcaacatagaataaaaatcttgacttttttcattaggttagaattagtgcatagaagctaagaaatagtaaaacttatgtaatcacattatgcttgggaaactgttttcttgcaaacaaaggtatttgtctcttatttattgtgttgatcatgaaaatagtatctctaccctgaggtgttacaaaaaattaatcaagtcagcatgtatactgcatatgtgtcttctggaatatttaccatttaatcaagaacctaaaaaatatataacctagctcccaaaaagtaacatcagtggttaattgtcaggttaaagaaaagtaaaataaggctgggcatggtggctcacgcctgtaaccccagcactttgggaggtcgaggtgggtggatcatttgagatcaggagttcatgagcagcctggccaacatgaagaaaccctgtctctactgaaaatacgaaaaagttagccagtcctggtggtgtgcagttgtaatcccagctactcgggagcctgagataggaggattgcttgaactcgggaggcagaggtctcagtgagccaggatcgcaccactgtactccagtctgggctacagagtgagactcaatctc

SEQ ID NO: 234510 - DNA, 724 bp, Homo sapiens
agtgagatggcatttacacaatggaggctgcactgccagcaggcaaaaataaccagttaattcagtggcttaaagaaaccaaacctacccacaacgcttgacctcccattgatccatctgcgacaccggcagtggctaccatttattgagtgctgatggtgtcacctgggattgacttagtggtctctggcgctagttccgaagttgattctgtctggagagcttaatgcagtgttcagacctcagggtccgaacctgagggtcacccaaagatgagtgggacatagctgtgtgacctcggctgagtgctttcacctctccaacctcagtttcctcttctgcaaaatggggtggcttcatggcaccttcacgtggtgtgattgcgaggaatgaagggatcgatgccttgcaagtagaggagaaggggccggatacatcttagttgttatgttatttaatcatcttggcaaccccgggagggaggaaccactatcattttattttccattttgcagttgaggacaatgatgattccagcacagacagggcccctgacggggcagtaggaaaggagaattgctttggaaggagcataggctggactgccagcactcataggaggcttcgtgtgtgcccaggactgcgagaattaaatacaggacacccagttcagtttgaatttcagataaactatgaataatgattagtgtaagtatatctcaat

SEQ ID NO: 234511 - DNA, 491 bp, Homo sapiens
ctctttttatgcagagggtggcaaacatatatgctgttctgcatataccttttaaatgcattttggaatgtactgcctatcggtaggttaagagcttcttctttctttgttaaggctacattatactactgtatgatgacttattaactacttcctgactgatagacatttgggctgtttccagtttttcccaggatgaacagtgattcagtgaatagctctgtatcacattattttgtatatctctaggaaaaagatcctagaaatggaattgttgcagctgaaagtaagtacatttatcatttcgattgattttgtcaaattgccctccatagacgttaacagttaacaattctgctagcaatatgaatactcgtcagcttttttcatacttgtgaaaatagtaggtgaaataatgatcccagcttatggtttaatttgccctttcacttattttgagtgatgttgagtataatgagcactttaaagga

SEQ ID NO: 234512 - DNA, 232 bp, Homo sapiens
gcgaaagatttaggatgcaagatcaaagaaagagttcttgtttatttgtttgctagattttccagtactctgaggagcctgtgtataagaagaaagaatgaagctgagaggaccaaacagatgaagagatggaaatgaagattcatggtagcattcacatccccagttccagatatccctgagattccagttgcaaactatctttcccttagtttagttgttcatctcatcc

SEQ ID NO: 234513 - DNA, 456 bp, Homo sapiens
agttttgttaaagaccagataatttgtacgcatcccatggtcataggccagtactcattcactcgaatcaagactgacagtaaaggatcaagattctctttgcttggaaggggagaatcagaaggtagactctagtgggacaaaaaggatacagtgaacccaagaatgaatgtggttagtaaacatagtatttgttttatattaagagtagcattccagcaaggcacagtggctcacacctgcaatcgagagactgaggtgggaggatcgcttgaacctgggaggcggaggttgcagtaagctgggatcgtgccattgtactccagcctgggtgacagggtgagaccctatctaaaaaaaacaaaacaacaacaagaagaaaaaaaccagaattcctcaacaattcagaatcatttattaaaagaccaaaggcaatgttagctactttgaatgaga

SEQ ID NO: 234514 - DNA, 197 bp, Homo sapiens
actaacctcccctaaaatgagcaccccaaagagaaccaggcagaagctgcacagattttctaacctagccccaaatatcataaagcatcattcccactgtattttgttgattaatagggagtcactcaggccagtccagtgcaaagatggaggatataaatctgtcctcttgattggtgaggtgtccaagaatttgc

SEQ ID NO: 234515 - DNA, 1851 bp, Homo sapiens
  misc_feature (819)..(819): n is a, c, g, or t
  misc_feature (837)..(837): n is a, c, g, or t
  misc_feature (1491)..(1491): n is a, c, g, or t
  misc_feature (1800)..(1800): n is a, c, g, or t
taatgtggtaccatatattctttcttttaaggaccttaagaatctgggaagaattagccacactctaatttaggaacagagatggatgaatccacctatggacatttactggtatgagtcactggggaagttcactaagtcactatttaagatgatccagaacaggtgtctacagctgccttaagaatgagtactatggtggtgatgaaaatgttcctctcagatgtccaactgcagggggtgggtatgaaattgccagatggccccagctggtgtgctctggaatccttggcgccaaggccatgctgccaggggcttctccaggctggtgatcaaatgtagtgaggatcctaaggcaggcccattcctggaagacatgggactctcccgataggtgagtttggctcaaggactcctcatggtcctgaaagaaactctctgagacctgtacttcagtggaagcctgtctttcctttgctgtctccttcccaagggttaaacctacattgcagtctaatggtggctctcccggccttctctggctccctcgacattttctctcacaggcatttcctttaataaatctctcgcatatctgatcctgtcttggcttttgcttcttggaggacccagaataacacaagtactgtcataattatatctcctcactttaaatctctcaagtgtaattactaaaattgtgttgtagtggaagtaaaaagcaaggttactaacttgagagtatctatgaaacactcacccattaagtttcattctttagtacatttataataacttttattccaattgtagcatggnctatctccaagggcaagntcctgcctgcgtcttcattgaaaacagtggaactttgaagcaatgggggagtttgttgcttctcttgacaagcggccagccctaattcagagttataaaagttttcatattctgcttttggcatatctgtaaaatatacttgggcatacatttttttttctgtttggatcataagtgtgtgaaacatacgtggtaagagccagttatattccaatcacagaggatgtcttggaacacatcactgccactccagaggtactgaaactttcttcctctagtaaggaacatggctggggtgggggtgagaagagatattcttacatttataaactgtttctcccaccaccagaccagacataaagtttgattttgtcctgaagatttcagttgtcttggagccagtggaactgagttagcccaagaatgagagtggatgtcctttttctctttctgcctttgaaatatcaggttcattggacaggtgctcagtagatccaattttctttaattgcacctacatcagtgtaatataaatgtcttcattcacaatcccacaagggttgtagatatcaatatgccgggggatagtgtatgggaattgagggtcatagtaggtcaatactatataagaaaattcctacagagagtgagtcnaaatccctactcctatgggaccagcgactattattgtctatttatttacttatttgaaaatgtaaacaattatttcccagtggactaattacaaagttcctgtgacatcaagatcattccttctcaaggcttttcactatatattgagacgtgtagtcttaatttcattttggtttgccccaagacttccaccaagtctaggggatctgtacggaactatcctttcccaaggtacatcatgcatactttctgctattattttttttttcagtctgtcccttgtggtcaatcaagagaaatgcagacttnaatctctataagaagagcaaaggttctccctttttaaacctttgaactgag

SEQ ID NO: 234516 - DNA, 511 bp, Homo sapiens
ctttggtagggcttctactttgttgaagccaggaagaattagaatctggcctataagaattggatcagcacttttagtagctgagctgtttgtttttatatagaacatgagatcagtaaagaaattcccatgattcattataatgtgtcttcatcagagtattggcaaggttaaatagggatttgtagggattttttttctttccaagaatatataagcgtgaaatgaaggtaggcagaaaaagtctaaaaattttagaatattagatattgcttcagcaaaaagtcacatgacattgcatcaggaacaggcagtcagctgacagtcggcctcatccactctgggaatgtgccagtggaactcctgcacctctgtcattggcagattcctgtgttgccaggggattacactggccattggaacgcttgcctgagtgtaatgtaagtatggcctggagtgacggagtgacaagatgcctatccagtccatatcccaccatttccctaactat

SEQ ID NO: 234517 - DNA, 461 bp, Homo sapiens
aggacctgtgacttgctaatagaatgtgaccaaggtgatgggatatcactgccatgattatactgtgttataagtgaagggattttgcaagtgaaattaagttaaggttctaatccgcagaacctcagaacctctgtagaacttctgttctaatctcccctaatcaagtagtcctttaaaagggggcttattccttccctgagcttagagattctggatagcagactccctcttctgtcagccctaaagaagtaagccattattaattttacagatgtacagaaataaattttgccagaatccacatggacttgcaagaggaccccgagtctcagataagactgcagcctcttgaacatagtcttgtgagaccctaagcagaggagtcagataagttttgcccagactcctgatccatggaaactgtgaaataataaatgcatgttgttttaagctgctaa

SEQ ID NO: 234518 - DNA, 447 bp, Homo sapiens
ctttccaaacaaacagcagattggcacctgtgaactggaaccttagaggggattggtttaagtcttgttgaccccctctatggataatctgatgtatatttttctcagtgctaagtgaaatgtttcccagaatttcagcagcccgagattcaccctctggagctgcataaaaatgtagtcaatatttggtgctcagaaattgtacccaatattccaattacaggcttaatcactacagtgggcacagtgggagggcagtgccttccttcatcaggacagacctgtgcatctgtgtgtcctgcctgtgtgctcctgaccattcccgtgcattgcacctgtgttcaactaaaaccctttgccattgttcacctttaccaatgagtcctaccctcttcccaagtctttaacttatccccttgctaaataaaaatttctgaagttttttct

SEQ ID NO: 234519 - DNA, 378 bp, Homo sapiens
gaattgaatttaaaaaggaaattgaacagtaccagttttattatttcagtacatatttcagtcattagtcatgagaaaacatgcaaaagccttgatactatctcacatttgatccataaaacaagaaaaggaatattgagtcccacagatgcaggaagcactggcatacagtgaattcacacttctcaggcagcatgttcttgacttttattgcttttttactttgtgaaagaatctcattcagcatatgagaaaaaggaaagaggaggacttcatttgtgggacagcaactcattagttgtctcactgtaaaatactataccaatgtaagagaaaattcttgctagttttgaaattttcttactggcttctcagatt

SEQ ID NO: 234520 - DNA, 179 bp, Homo sapiens
gccataaagtagtatatgttttattgttctgtaaagtttgaagtgaccagcccaccacagttaggtcactgagtgtttcggttgcctggttattctttcaggaatgtttgaatcgaaatgctcacaatttattcccccagaagagagaattttcagaaatctcctaagaaagtctgatg

SEQ ID NO: 234521 - DNA, 533 bp, Homo sapiens
ggatagaagggaaggagataaatgaccggtgtggagcaaaaaacactagagtgggagccacgagacctattcctaagcttcaatactgtgtgacattgggcaacagattttacttctctggactccatttcttcaactctaaaagggcagggctggcccagatgacctctgaggtccttttagcaacagtagtctaggattctgcaaacgtgaatggcattaggttaagagaagggataggaagtgtagcattgattatgggggcaaggaagaccgcagagtacaagatcacacagaggaaggtgtcgtgatgtaccactaaaaaagtgtgaaagagcttgccttttttgggaaggactgaaggatgggaacggaggatggagaccggaaaggataagaagtagtgagaaaatcacgaggttgtttttaagaaagttatacagtgttagagatcattattttacacagatagcttttcaacttttttaaacccacgattcacagacggaaataaaattgacatcatggtccag

SEQ ID NO: 234522 - DNA, 339 bp, Homo sapiens
tggtctcaaactcctggactcaagtgatccttctgcttcggtctcccaaagtgctgggattacatgcatgaactaccgtgcccagcctaatgtattactctttatataggaatacctattcactgtaagattccttcaaaacaaactttgacgccataacaaaaatcataggctgtgactcctgtagccacccacacattcctttcagaacacgcatactttttccccaagatataagccctgcgtttgggggtttgccatgcagagatctgttttgcagccacccaagaccatgcttgtgtctgtaagttcctcctaataaatcatcctataccaata

SEQ ID NO: 234523 - DNA, 169 bp, Homo sapiens
agccacatcgacattccataggtatgaaggtgtacttaagatttttctttaaatcaaatctaaatcattcacttttttcttatcctgaccctaaacaatgacagccttgaaatcttggcttctgtgtgctaattcttaatgctctaattcatattcaaaaaaaacataa

SEQ ID NO: 234524 - DNA, 2205 bp, Homo sapiens
  misc_feature (1416)..(1416): n is a, c, g, or t
  misc_feature (1512)..(1512): n is a, c, g, or t
  misc_feature (1546)..(1546): n is a, c, g, or t
ttttggattacccggatgggccctaaactcgatgacaggtgtccttataaaaaatacacatagagggacacagacacaggggagaaggccatgcggagatggaggcagaatgatgcagccacagcatggaatgcctggggccaccgggagctggagaagacatggcaggattcttctcttgagccttcagaaggagcacagcccaacggacatcttgactttggacttctggcctccagaactgtgcaaggattaattgtctattgttttaagccgcccaatttatggtagtttgttacaacagctctagaaaatgagtatcatttctgagggcttcagccttaaaatgggcctagataggagaagtgcccactttactgagctttggggaggactagaagggatgcctgtaagatttgcccacacccagcacctggagagcacttgatgaaggttagccctcatacagagcatcatttattacccggcctttggctgctctgccctgaacccttgcagagcccacggaagccagcccttcacattgccatcttcttgtgtctgactcgttgccactgggacccctgagcccagcccagcgtgttcctggctcaggaatctcagaggaatcaaatctgactcccagacccaggctgcagaggcctctctgagccattattaccagggctgccagagcgagactatgaacatccacatgtggcgttttaatattttacccaagaagtcattttcttccacgattcagacacagaagactcgaagaattaaagtgagaaaggtactcagggcctgcatgatttccgccaatgggcgtggaggattttcctgtgtctgttcaggctctttctttcttatctgcgtcttacagcagacgggaagccagctgacgagagattgcatgttcataccaattattaaaaatatatggcaggcttctggaaatgcattcacatgccaaggaaatagaatgcagtcaccagcccaggcccctgcactgtgtgctttggaggaacagtgcggcatctgtaaacacaatgatacaaggttttggaccagattctgccacctcccagctgcgtgaccttgggtgagtgacttaacctctctgagccccagtgcccataggggaagttcattcctccctcacaggtttactgtgagcgtcattaactgagataacatgttcaagtacctagttctgagcctggcacatagaaggaggtcaatcagtctgatttgtttccactccctgccccagaatttcctgactccctaagaaaactgacataactaccctgccaacctcccaggtcctgaggtgcactgctgccaagagcaaacgtgcaggatagatttacaccttccagtgcacttccatggccatccactcatttnatcctgcagactctgctgcagagagtgttctgtttccattttgcaggggagcacctggagagctctgaatcacataggtagcaagtggggctcagnggtgagaagccaggcctgctaatccccaaagctnggctccttcataccccatgctgactgtcaaatgagctgatggatgggaaattgctccataggcaacagagctctatcccagcctgagggctggactgttgttatctccagcacctgtctgtgatcaaggctctttgctacctttttgtccatgtgtattgtcctcacttcccccttctaggcatgagcaggttggatcagtctcatttggctcattccaaggcagtctgtgaacttgccgcatgtgtggttaaaatgtatgcatgctcccactcccacttcccatgtgccttctcatgctccacgctctctgccccacccacactcactggctcgcacatccaggaggtgctcagcacagcctgtcctctgttatgaagaagacttcgtggagctcaggtgcaccatagagccactagagagacacgtgtcattcattcatctgccaaacccacatttactgggcacccactatgtgccagatgctggagccacaatgatgggttaggtgcagcccctgatctcaggactcccccagtccagggggacaagttaattgacaatggcagtgtaggtggcaagtgctagaatagctccgcccggggccctgtggaaacgcagaggaggtggctgctcatcctgccttgagaaatgtttcac

SEQ ID NO: 234525 - DNA, 291 bp, Homo sapiens
aagtttttgattcaaggtgactaacctgctctttgctcaggtctctttggccacctcatcttcctcaaatgcaaggaattcctcacgtatcattctccctttcgtgcttgctctcctctctcccgctggagcctctgagataaacacagacttaagcaaacaacaacaacacaaacatctcctgggaaagaagctctttcacttgttttgtctcactgaagctaatgctcctgcatgcctagtccaggacatcatatgatttttacaaaaataaataacgttaaattcaaa

SEQ ID NO: 234526 - DNA, 468 bp, Homo sapiens
tgcttaaaaaatataagaatattatttatcaggaagaatttggagagtagacgatgatagtagatggattcataggggaaatgcagagatgttgaggttgggctgaattgaattagaataaaattagaataaatagtttcaagaaggtaacaactgttttaaaattttgtaaatgtaccttgtatatatataattttgtcaattaaaaataaataaaatttgccaatttagtttggaattatccagaaatagcttagcaaaacatctggttaatgtgctattcaaaattaattttattttaatagattaaagttatataggcctcctttgggaagaaaactaatttttctcaaatgtaataattataaaatgtaataattatatgtaatacagatttttgtagatggaatcattgtaattagagtatacatatgtgtgacttttatgaacacatacagaatgtctaaa

SEQ ID NO: 234527 - DNA, 471 bp, Homo sapiens
catcatctgttatcatcattaccattttcatcattctaatggcagacactctatgtccagacattagactacagatttatcagaaaaaaatcttgcttaattctgaaaacaaccattatcatcattggtaacaggaagaaaatagaggtggagtgtttaagtaacttgcttaaatcactaaaaatgggcatatcaaggattaaaaataagtgtgtcggactaacgctgatccacctaacagatgttatcatttcccttggcattcaccaggattttgtgtaaattttcttccttattttcatttttatctgtttcttagtaaattgcaatatatcgattatattttcaacaaatgatctgagggaaatatattatctttaaccttcccaaacattgcagatctcaaaatatctttcacatgcactcgaatctaaataaatagaagttattgaataaaaaactttccttctc

SEQ ID NO: 234528 - DNA, 844 bp, Homo sapiens
aggcagatgatgaatttgaagccctgacaaagagaaggcaaaatcagtttgtgtccctgagttgctaagtggagaagaaacgtccaccaaccaggaaacacctgcctccaactgttaataggtctgtgaaatgtgctttgtttctggtcagcatggacacccgctttaatagtggcttcagatgaggcaccttgtgacagaggagctcttcccctgcagcaaccttgaagatgttgtggaagacaatagccattcttacttcactctgaggatcacgatggcgtgcaagggtgtgccaagcacattgctatctttggccattctctctcacattagtacacctggatgtgaatggcacgttatctatgtaagcagtgatggtctctatcttgtggtagaaatgacagaattacacacaatcaggacagctgagattccatttactagctcagtaatcagagaatatgtatgacatcccagcaaaaaatgttgaacatgttcagatttcatcatatcagcaccacagtatcagtcttacggggaggtgctcgcattcagttcctggctactgaagaaattttgcaggagttccagataacttacttgtcccataataatgaaaactattacaattatgctaaagaagaatacttaataacacagtaaaaatgtttatgatgtcttttaatttctaaagcatgttataaaagtattacagtatgatctcatatttgtaagtaaaatatatattaattcatttagcaaataaatattaagcccctactatgcacataccaatatagatattggtatttgtgtgggtgtgtgttacagcagattttaa

SEQ ID NO: 234529 - DNA, 425 bp, Homo sapiens
aatacaaatatgtgtaaaatggaaagtaacaccccccccccacattctccctaaaattttacacccacagatgtgcggccaatattttggtgtattttccttaagtcgtttttctagactttctttgtttggagagttttgccatacccctgcccctcaagccttgttcactcagcaaagccctcctttggagtgtgaaaggcagaggtgatgcggccctgctctgggatccgagtcctgagttgagaagggttttcctgaacctccaagctggtcctctgtgtcgttgctgtccaggaacaaaggacaggagctgagggacaggaaaccccatgggtgtccatcctacccaggacaggacaggtgatcaggagcaacagccgaatctcttgggcggcctcttgggggccaccttcaccagcgag

SEQ ID NO: 234530 - DNA, 437 bp, Homo sapiens
tacagaaataggtgttcatacctactatatattaaatatatactattatatacatatattaatatataaataaatatatcataaaacgacctctccatgttaaggtgtagaatctatagaatgaaacataaataaggagttaacagaccaagcgccgtgacttatgcctataatcccagtattttaggaggtcgaggcagatggatcacttgagggcaggagtccaagaccagccaggccaatatggcaaaactttgtttctacaaaaaatacaaaaaaaaaaaaaaatagccagatgtggtggcgcacctgtagtcccagctattcaggtggctgaggcacgagaattgctcaaacccaggaggtggaggttgaattaagccgagattgcactggtgcacttcagcctgggtgacagagtaagactctgtctccca

SEQ ID NO: 234531 - DNA, 472 bp, Homo sapiens
atagagtttgtgcgctcctatgagaatctaatgccactgctgatctgacaggaggtggagctcaggctccacccggtaatgcggtaataatgccagcccatctgctgctcacctcctgctgtgtgggctggttcctaacaggccactgaccagtagcagtccatggcctggggtttggggacccctgttttaaactataaactaagtttttcccaaagttagtttggcctgtgcccaggaatgaacaagtttggcctatgcctaggaatgaacaaggacagcttggaggttagaagcaagacagagttggttaggtcagatctctttcactgtttgagttataattttgcagtagcgatttcagtaggaaataacttgttctagaagtgaaatgagagcaccttctcttaactctgactcttttcagtgattcacagtactggaaataaataagaattacctacatagcaaa

SEQ ID NO: 234532 - DNA, 308 bp, Homo sapiens
ggtgatgggattttggctcagatcagcctggatcagggtggacctctacaagctggcttgcatgaatgtaaatgtctgctgcccatcttgaagaccatcggcaagctttggtgggttcatattcagtggcattagggattaaggcaaacttaaaatgattctgagtgtaaacagatacagatataaacttttgggggaacaatttggtaatagctaataacaatcgttaaaatgtttatatcctttgacctgatagtgttagttctaagaatttaccttaagaaaataaataaatttatatcccatga

SEQ ID NO: 234533 - DNA, 437 bp, Homo sapiens
cacccacaggattaggctcaaagcctgccccagtgccagttcagcccccatagactcaggcttcatgctggcccccaaggacacaggatccaggcccagccatgtaaacacaagctccaggcatgcccaagtggaccaaggttccaggcccacccctatggacccaggcacaaggctacactctgtggacacaggtatcagacctgcctactcaatgacccaagcactaggctaccctacccaaggactccagcagcaagctagttcatgggcctcatcagctttcctgcccagaatctctgaacaggctgactagtgaagcattttctctgccaaaaccagtttgtaaagacttgaaatggtgccgacttcttcaaatgtgcagacactaatgtaggttacaagaatcgtgaataatcagggaatgatgacaccat

SEQ ID NO: 234534 - DNA, 285 bp, Homo sapiens
tgtgccaggcacagctctgagtcccttatattgagacctcaggaaaaccctgatataggtaatgctgttgtctccattatatggttgagggaaccgaggcacagagagaggaattaacttgctcaagtcacgcagcagagccaggacttgagcccaagcagtctggctccagatcctatgcctctgaaagtaagggaagagagtcacagagagaacgcactgggagggggagaaacaggggtgggaagttggtggaaaaaggaactaaaaatttctgagagcctg

SEQ ID NO: 234535 - DNA, 461 bp, Homo sapiens
cctgtctaggggttaagaagccagactgcacacctgattagaattaggttcaaagtaagagtctgtaggttttgaacaaaagtttgaggggacagtctttgagtgcagtgctgagtacagtgcatgggcttttagctacttagtgctcctttcttatttaaatgtctaggtcattctggatagttatagttaaaatttcaacaaagtttgaaatgtctagaaatggttacttttatttgctgacagtggttatggatttgttgtaaaatccacttcctacatggggcatcgctaccatggttagtctgaaggcaaaggtagacaactgaacttgaggtccaaagacctgggtttagatcaggggtgtccaatcttttggcttccctgagccacatttgaagaagaattgtcttgagctacacataaaatacactaacagtaatgatagctaatgagctaaa

SEQ ID NO: 234536 - DNA, 96 bp, Homo sapiens
accaggaacacagaccatctgtttcctttggtgatacagtatctcagtccacaatgtggttccaaatgaataatggagattggtttttacaagcca

SEQ ID NO: 234537 - DNA, 336 bp, Homo sapiens
acatggttagacctggccctctgtctaatactgtctggtaaaaccgtccatccgctgcctgatcaccgttagaggagagagctgcctgccctgcagctcatcagtgcaaagccgcccggtctggggctctcatgcccccctcactatggcctgtgcccatccgcagcccatcagtgcaaagccgccggggtctggggctcttgtgccccaccctcgccatggcctgtgcccacccggcctcctggggccctcgagctgtagtccccgggcagatgctgtggaccccgtgctatcagcctgggcaacagagcgagactctatctcaaaaaaaaacaa

SEQ ID NO: 234538 - DNA, 232 bp, Homo sapiens
gggtcaagtattagcaatatatagaatattaggacaattatttattttctcttaatcctttaaagatattaatctattgtgtcctggcttctgttgtcactggtaagagtctgctgtcagtttaattattggtcttgtagatcatctatttttttctcagatcccttttatggtgtttctttttgactttgattttattgtatgtgcctagggataagattttaaaagtgta

SEQ ID NO: 234539 - DNA, 491 bp, Homo sapiens
ttatatgctgtgtacatttgttttgtcactatatattatgtatactgttttatatagatagatagctacctatatataaaaattatgaaagaatggtaaagttgtgatttttttttttttcccacacactccactttggggactaccattgtaagcagcagacaacacctgggtcctctgaggtattagtagactatgagcctcaaacaaaagtttctgcaataaaattccataattccttgatttgaggagacagtggataagatgcactacagcttaataatcacttctaggcacacaaagaataccatcacaacagttgtacacataaattgtaaagatttatttctatttcagaaactgtgaaattgtgtgtctttgacttatagaaatgtgataagttgaaaaaatattgacttatataaagttatacagattacttacaggacttcttagagtttttgatatttgaattggtatgctgaacattg

SEQ ID NO: 234540 - DNA, 239 bp, Homo sapiens
ttcaggcattatcagctgaacgtccctgcaaccaggagcagctacataatttgcagggtcccatgccaaatgaaaatttggagcccattgttaggaagttaataagtggggtgcagtggtgtatacctgtagtctcggctgctcaggaggcttaaggtgggaggacagcttaaacccaggagttcaaggctagcctggacaacatagtgagaccccagtctctaataaaataaacaata

SEQ ID NO: 234541 - DNA, 362 bp, Homo sapiens
tggtcaggcaagtcacttgatccttctaaattattcttctgtaatcagattatctgtgttgcacagaggtatgtcaacatgaaaaagcacattttcaaatgtttttttcagtgtggtccaaggatcccttgggaaggggtttacttttgcattaagtatttataaacacagatttgttttatatacattaattaaagtaacttaaaaacaacagattgaatgtagaagaatcgaactgtcttccattcaattagtcatgaaagagttctgcaaaagggtgaaacaataccattattctcactaggcttttgtctattttggaaagtatagatttttaaaaataaaagtgtgttgtttatgtt

SEQ ID NO: 234542 - DNA, 504 bp, Homo sapiens
ttagtttggtccctgcggcctgcagccatgggagggctcagtggagactggatgacaggagcaggcaccacttggctgacattgaaaaggccttaacagttgatgtctgagggtgaccacctgaaaagaggaccttgagctgccagaatgtggaatacaggactgcagaggggaaaataagtgtcattttcattccagagaatattaccgaggtgcctgcaaagttcaatcttcctttccaagccttttattcaaactaagggccaggttcaggcacagaaggagcacctacaagctttagctttgatttggtcttaatgcacgcgtatgtcgccgtcgagatttacatatttcttaatgaccagaaagcaacaattagaaagtccaagatcaactctcactacggtatgaatttcttcatctgagcatttttgtaagaagcatggattcctactataatcacaataaaacaataaagatagaaaaaaagatctgggaaaaaaa

SEQ ID NO: 234543 - DNA, 542 bp, Homo sapiens
agggtttaagcctatcagcatctgctttaaattgaatccatttttgaatagatcctttcaaatacaggatctaggttactttcctgagagaagaggacactagaaagtagaaagagggaagtgggtgcctagaagaggagagggcatccagagcagactgggtgatatagttgtgcctcagtctatcctgctaacaggagtgaaccgagggtatcacccagaaaactgcagaaaactggctacaaactggcctcagtcactgataactgcaggaaggggtgacattcttatttccctgactcctcagagaatccgaaacagaaggagaagttgagcatggacagagttaaccgtgttgacttataaactagaactgcctgaaaccaaatgtggagttaaagcatctgatagagttaggacccctagtgcatttacatacttgactcattaaaagaaaattctggtggagtccctggacaccatcctaggtggtcagggagatgcaggataatacagcctttgtggctggagggccaagccca

SEQ ID NO: 234544 - DNA, 516 bp, Homo sapiens
tttgtgaggtttgggattgctgcactcctttgcatcctctcaatctttggcacatactcaagacagtaaatagtgtggtggcaaaatcatgtccccagtgtttaatattttccccagccagaggcaaaatcttggctcagttcttatgaacttgagttctatgaacttggaaagttgagtggcaggtgttcctcatacatggtgtatgtgtgagatttgccatattgtcatagaggcactttacaaatacagcatggggaaaccctgctgcagcatgaatttgggtatcatgctattggccatcagaccccgtcctccacaggagagcccttggtcagctcatccacctcatgataatgcaagtctgccttttgtgcagtgtcttaaatcccacttgtggttggcatcatttcctccagaaaatacttcctggtccctttccaggtgctcttcaccccagcccacggcagttgcccctcctaagtgttccccataacaccctgatatcggcctgtc

SEQ ID NO: 234545 - DNA, 1996 bp, Homo sapiens
agcgtgtgggccaccgcacccggccagaactcaatttttatctgttggtgagataatataggtcaagtatatagccttttggtgttttaacttgatccaattgtagaactttaggaattcagaccccgagatgttaaatgactgtcccctgttttaataggtttcctgagtttcagcataattgtcttagttcactgactagtttcttataagcataaccactggggggttacgtgcaaggatttcttcaggccgggtgcagtggctcacaccttgaatctcggcactttgggaggccaaggcaggaggatcacttgagttcaggagtttgagaccagccttggcaacatagcaagatctcatctttacaaaaaatttttaaattagccaggcatggaggtgcatacctggagtcccagctacttgagagtctgaggcaagaggatcactggagcccatgaattcgaggttgcagtgagtcctgattgtgccactgcactccagcctgggcaacagagccttgtctcttataaaaaaaaaaaaaaaaaaaaaaagccatttcttctgagttgtgcttgctgaactcaaaatactaggtgatttggtaatgcgcctaaagagcatggggctcctcctgccaattataagcaaagacatcacatttggagtttggcaagatcagaatatctcaggttgagcacctgctgaatgctaggattgtgtctatgcattttaaatctatttttaatctttattacagtcttataatagggattatgacaccagaacagagacagctgtcttaagatttcaaggggtgctagctgaagaaaacagagaggaaagttgggaagaagctggatccttgataacagctgagccatggacttaaccagtcttagatgagcgatacctcaccttcagatttcatgtcataccacctgaaataatatattttcattattgttgaagccattttgatttgggttgtctactatgctacctgcagccaaagggaaactaataaatgtgaactaagaagcaaacctacattcttcttcccaaagtccatgtttctccccctcgccatcctcttcaccaaaaactacattcattgtattcagctcctgcaaagagcacacattaagaaacaggtttaaggaagtgttagacactgaatgtattcgacccccaaaattcatgtgttgaaatcctgactcctaggactaactgttaggaggtagggcctttgggagatgattgggttttgagggtggagcccctcatgaatgggattagtgcccttataaaagaggccctggggagctgtctcccttttccaccatgtgaggacacggcaagaaaatggctgtctacaaagcaggaagcaggccctcaccacacactaatataccagcaccttgaccttgacctccccccatctccagaactgtgaggagtaagtgttgtttaagccacctagtctgtggtatttttgttataatagcccaaatggactaagaaatgaagagaaattaagatggggagggctattttcataataaggagcagaaaactaggaagagtagatatatttagaagggttaagaggagaggggagaatgtatatgtttggatagggagggacaagatgcccaactcatcttaaaagtgctgttgattcctgtgaaatttgtaacactcatttacattatttaaaaataaactaaattcgaacttgtcttggaggcatgaaagaaaaaaaaagacatgtttttagttattgtatgttactctgagctacacattatttaacatctctgaaactggaatatattttacaattgatagactcattttaattagcaggttattgttttcttagcagtacataagaaatggtgaatcttattgattcagtggcatttagattctattaaatataatttttaactgaagttgtacatagttaaataaaagtttactatgaaataaa

SEQ ID NO: 234546 - DNA, 1641 bp, Homo sapiens
aggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttctaaaaaaaaagtt

SEQ ID NO: 234547 - DNA, 792 bp, Homo sapiens
aggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaaggtataaaaatgtgtaagcaaaaatctactaaaatgta

SEQ ID NO: 234548 - DNA, 640 bp, Homo sapiens
agcgtgtgggccaccgcacccggccagaactcaatttttatctgttggtgagataatataggtcaagtatatagccttttggtgttttaacttgatccaattgtagaactttaggaattcagaccccgagatgttaaatgactgtcccctgttttaataggtttcctgagtttcagcataattgtcttagttcactgactagtttcttataagcataaccactggggggttacgtgcaaggatttcttcaggccgggtgcagtggctcacaccttgaatctcggcactttgggaggccaaggcaggaggatcacttgagttcaggagtttgagaccagccttggcaacatagcaagatctcatctttacaaaaaatttttaaattagccaggcatggaggtgcatacctggagtcccagctacttgagagtctgaggcaagaggatcactggagcccatgaattcgaggttgcagtgagtcctgattgtgccactgcactccagcctgggcaacagagccttgtctcttataaaaaaaaaaaaaaaaaaaaaaagccatttcttctgagttgtgcttgctgaactcagaaagccgagggggcatcgggataagtggcccgtaaaacagctgggggcccca

SEQ ID NO: 234549 - DNA, 740 bp, Homo sapiens
aggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaaatggatatggcccaatactgatatcagttcaccagaatatgatcttaattgagcatatacattgcctggaagacatttatggaactttgttcgattcttctcttagatttgtcttttagcatgttactacattgcagatgagtcactgccaatcaaaggttaggcggaagctcctcagttgcatagttaaatggattttgaagcacttaaagtctgaaaaaacacttctggaactgtttgagtgtgcaaaatatatctgtgcaaattaatgtaggtatggagatcttgtccctattttaactttgaacagcacagtgataccaagcagtgtcagtaacacctgtgaactcattaaaagccaaggaaaaccactggaaagtatttacctggttttaaattgtctgatgaagctccagtttcctcatatctttgagcagctgttcttgccaa

SEQ ID NO: 234550 - DNA, 361 bp, Homo sapiens
aggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaagtaagattaagttgaccactgtttaagttgaaaacgcagatttttttttctcagtttcacatggaacaaca

SEQ ID NO: 234551 - DNA, 1771 bp, Homo sapiens
aggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagcttgtgctttacatgaaataaatcacttaatcctcaaaacaaacttaaagagaagatgatgccgtcctcgttttacagatgggaaaactgaggcacggagaggctaaataacctgccgagattgcacagtaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttctaaaaaaaaagtt

SEQ ID NO: 234552 - DNA, 2501 bp, Homo sapiens
aggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagagtcttataatagggattatgacaccagaacagagacagctgtcttaagatttcaaggggtgctagctgaagaaaacagagaggaaagttgggaagaagctggatccttgataacagctgagccatggacttaaccagtcttagatgagcgatacctcaccttcagatttcatgtcataccacctgaaataatatattttcattattgttgaagccattttgatttgggttgtctactatgctacctgcagccaaagggaaactaataaatgtgaactaagaagcaaacctacattcttcttcccaaagtccatgtttctccccctcgccatcctcttcaccaaaaactacattcattgtattcagctcctgcaaagagcacacattaagaaacaggtttaaggaagtgttagacactgaatgtattcgacccccaaaattcatgtgttgaaatcctgactcctaggactaactgttaggaggtagggcctttgggagatgattgggttttgagggtggagcccctcatgaatgggattagtgcccttataaaagaggccctggggagctgtctcccttttccaccatgtgaggacacggcaagaaaatggctgtctacaaagcaggaagcaggccctcaccacacactaatataccagcaccttgaccttgacctccccccatctccagaactgtgaggagtaagtgttgtttaagccacctagtctgtggtatttttgttataatagcccaaatggactaagaaatgaagagaaattaagatggggagggctattttcataataaggagcagaaaactaggaagagtagatatatttagaagggttaagaggagaggggagaatgtatatgtttggatagggagggacaagatgcccaactcatcttaaaagtgctgttgattcctgtgaaatttgtaacactcatttacattatttaaaaataaactaaattcgaacttgtcttggaggcatgaaagaaaaaaaaagacatgtttttagttattgtatgttactctgagctacacattatttaacatctctgaaactggaatatattttacaattgatagactcattttaattagcaggttattgttttcttagcagtacataagaaatggtgaatcttattgattcagtggcatttagattctattaaatataatttttaactgaagttgtacatagttaaataaaagtttactatgaaataaa

SEQ ID NO: 234553 - DNA, 328 bp, Homo sapiens
tgtcctcatcaatgtaggtgagcatcagctaacccaggaagggcctgaacagaacaaaaaggcagaggaagactgaatttgctctctcttcttgagctgggacacccaccttctcctgccctcagacattggcgctcctggttctcaggccttcagatgcagactgagacttacaccattgattcttctggttcttaggcctttgcgctggagttacaatgacaccaccagttttctggttctccagcttccagacaacagattgtagacttagcctccataattgtgtgagccggtccctcatagtaaatctcttcctatatatcca

SEQ ID NO: 234554 - DNA, 404 bp, Homo sapiens
ctctgggtgaaaggggaagagaaacaagtgagagaaaatcgatttttactttcttttcaggcccgtccccagttggtgagttttccagtggccggaagaccgagccctagagtaacagctgtggactcactgcccactctgtgtttattgggctggaaccccctctctgtcctggaacttctggttggagagccctctgagctcatggggcctgtgaatggtgggtcttggagtgatttccagccccagtgatcaggtgtcctgtcagtgcccctcaactccctgcagtcccctacttcccatcaagccaactcccaaattccaggatgtgacagttcccaggtctactgccttccaggcactgagctcatgttggggacccagaaataaatgagatacataca

SEQ ID NO: 234555 - DNA, 461 bp, Homo sapiens
ttcgagaggtctgaaactgctgtggcatcactggtgtccaggttttcttctctcagttattccatactggaatggcctctgccatagcccttctccccagatgtgtcacacatgccctgggttctccttggtctcttgatcagggtccagatctcctcatggtagaatggcaggatcagccaggcatggtggttcatacctgtaatcccagcactttgggaggccgaagcaggtggatcacttgaggtcagttcgagaccagcctagccaacatggtaaaactccatctctgctaaaaatacaaaaattagctgtgcatggttgtgcatgcctatagtcccagctactcgggaggctgaggcaggagaatcgcctgaacccaggaagcggaggctgtagtgagccaagattgtgccacttcattccagcctgggtgatagagcaagactccatctcaaaaa

SEQ ID NO: 234556 - DNA, 452 bp, Homo sapiens
gcagcaaacagaaagaaagaaacacagaagccataaaaaaatctctgccacatgaagaaaaacacaacaacacagcagaaggtagaagaatgcatgttcagaaatatgcacaaaaagaaacaggttattttagtcaatggcctgctatgtgctttcagagacaagaaggaaaagaaaaactcaatgaaacaagagattaaaaattgtaaaacgatagtctaaaaagaaaaggaaatatgaataaaaaattatatttggcttcaaaatagctttagataaagtctagaggaactgtaatcatgagaagaaatgatcaaaatttcatttactttccatattcttaatcttctgttcgctaatttgacttcaggggagaggaggcgccccttcggcggagttcaggggcgccgttcagacggacacaaggagggaggccgggtcgccgtcgatta

SEQ ID NO: 234557 - DNA, 667 bp, Homo sapiens
attttttaatccattctgtggcttgttccatgcctgagaacttttgacatcctgtgcccagacttaaactcaccccttcagtgtgtgggtttagggggagaagtgaaggttgacacattcatatcaacaacatagtctactttaccatccaacgatgtattttgatatcagccaagtatttctctctacaactgtgagcaatgctaatccactccagccttcttacactgtaatgataccttttctttgtcctctctgaaagtttctagtagcatatctccaaataattattgaatttgaaagcctcagctggacaagtcttctctgtggttgaattgtgacaatgtctgtgttccttaaaaaaataaaaaataacataaaaccaagtaaggttagacaaaacagttgaaagtttaaaatcccttggcctcatctagttcagtggagacaaactttctaaatgggaggagggccatgtaatgagaggagaggagaggagagaagtatttgatgcactcatggcctcagggtcagggagacctggaggagcagtggagatggtggagagccagagaacaggtgccacctcccaagaggcagcctttactcacctctggctgattggtggggttggggatgtgggtacaggcatatcagacctttagat

SEQ ID NO: 234558 - DNA, 312 bp, Homo sapiens
gtgcttgtggtccgtgaaataactcattcagcctccttgcacaaagtctagcacttactgagcatttgataaatgctagttctacccttaatcactgttctacagtagaaatcatcaagtattttagggcatggtactttcttaggtgtatttagagaaaaaaagcaaagttattaaaatctgacccctctcttcccaagtagcataagagatacgaagctgatggtaattaacttgtaccccttgaagtgagaaattatactttaataaatgtcattattattttaaatctttttctaattgtaaaatgta

SEQ ID NO: 234559 - DNA, 480 bp, Homo sapiens
gacagggtgctgggcccctccctgctggcctgagaagagaaagccaagttgaatacacttgctaaattgcaggcctttgccactcagcctctgcacctgccagcagccttgcagtaagattgccttttgtcaataaaacgatacttcattaggaagtcagaagatttccttgtatgttactgaggtaattcaaacttggtacagcagagaataggtttttataccaaatactgtattaattacatgagagctactgaaatgaacaccatcagacacattacattcactagcttccattccctggttaagaaaaatctggagctcaaaatggatttttattctcctagtataggaataaagggtttataaaataattcatccaagcgttagctgaatttttgtgtttaagttttgggtttatcaatcttcagccataaagaacctacatacatagtagcatttatttgttaccagtcagca

SEQ ID NO: 234560 - DNA, 233 bp, Homo sapiens
tggttgttaggagagatgaagaaggggtgggagttggaggaaaacaaaggaatggaaatatagtgggaatattctgtttcttgactgttatcaatgacagtaatctggttgtgatacttgaaagatgttactgttggaggaaactgggtaaagggtacatggaatctcttatgttttacaaatgcatgtgaatctacagttgtctcaaaataaagttcaaaagaaagaataac

SEQ ID NO: 234561 - DNA, 1538 bp, Homo sapiens
aaaacatgataatctgcaaaagttcatgtatctacttcattgtgcataggaagtgtttacaggtaaaattaaaatcaaaaattgaaaaaacactcttcattttggctctcctttctgaattttttcagtttcctgtctctacccgccatcctttgagtgatactatatctgtattggaccaaatgtatttactggtttcattttgtttattgaatgactttaaatgtatttattatcattgtttaatttaatgttggatatatttgtatcattacaggaatctggtaataatgggcaaatttagattgatgaggcttagggatcggggatgctccaggattcaacatttcttccaattgttcatggtttgttctaaattaggacagattaagaactaataaaacattattacatttgaacttgactcaataaaaatattctgatctcctttatgaatattaggaatattctttgtgattagtgtaagtagtttggatcaaaacataaaaagaagacctatggtttatgctacttctagttatttgtagttcacagtaaaacatgcacagacatacacacaaacattttcatcaatttcgaatttgaattgtgaaaaatatataagaaaataaaaacaatttatacatttgagcaaattgagcaatcacatttattgcatttatttccctttttcccttttttcactcattgaaagtgtgggttttctaaataatattagacactaacactcaacagatttattcacaaatgacacaagtacacattttaagacttctttgtatttcttgcaattataaccaatcactagtcatgaaatatacctacataaaccaagtcctacactttcagtgaggaagaatgtaaggaaggtatgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagggcccaattttcaattttttctttggctatcaagttgctagtcacttattcaggattttcatccaaactgtgtttggactgactgtataagtcttactgccttttcagaaatctgctttcctttgtgtgatttttcttgtactgtatagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaa

SEQ ID NO: 234562 - DNA, 585 bp, Homo sapiens
aagaaatgcattttctatcttaacttatttacttaactctccattctttgtttcttccactttgacatgtgtccgtcacagagcaaagtccatctcccacttcttggtttcgctaacttcctacttttgttgactacttgcttcttaccctaccctgtcattgcctaattatattcaggctcagtgagtagtagaccattatggggcctctctgctcagatgttactgggatgttgactgtttcctgcaccctatgagaccctaataagagagtaatttcataaggacattctaaaagttgatggagatccaaagatgaccttcaggtagtccatgggaaagcgctaatgtttattaagcccagttgttgccttcaggcattgtaagcttaggataaatgaaaatgtacacaattcttaacttattaatttgacagaggcaagcattctgaataccatcaccatcaaaagttcctttgtgactgcatttagtccccactcctgccccctaaaccagcaaccactggtctggtttctgactatactttcgctttttctataaattttatataaaaggagtcataca

SEQ ID NO: 234563 - DNA, 281 bp, Homo sapiens
gccttctagagaagttttaatgaaaatagtgcagagagaaaacatgcttagcaacatgatcttagagacctgagattgccatttgtacattacgggttttcaggacacagagagaaaaccatgttgtgttgggataactgaaggaactaccctacacccgttcttctccagggcccttctgggagccagttttatggtgaatttattggatgttacttctcagagtgtatcagagattcttcacattcatggactttaatcttccccttgtcagctgcagc

SEQ ID NO: 234564 - DNA, 341 bp, Homo sapiens
cagtatttgtagcagatgttacaaatgtcataacacgaagctttgggatcagactgaaaactaaaaaatcaagataccagatgtggacgtcttccttttaccagcaactgcaactgacactgcactatttcagtggtaatctccacccccttcctactgggtggaatcatgccataactgtttgcttgctgctgaggtcagaggaggtgacaacagtaaagcggcactcattggaaaggcttttaagacagtttgcaaaatgaaagtgtaatcatcctttcccctcttgagagagtgtaccaaatctaacccttattaaaaatttaactgctcaaaaaaaa

SEQ ID NO: 234565 - DNA, 356 bp, Homo sapiens
aggtacccataaacatttatgaagtacatgagatgttttgatagagacatgctatgtgaaataagcacatcaaggagaagaaattttgatttttttctaacacattatcttatgtttgctttgcatgcattcgttcatatctttctgacctcaagactacatggtccttgagggtagagaccagcctattcatctttattaatttcaattgtttattcagtatagatttatttagcatgttctccatgccaggccttgtgttcacaatgtagttagggaacgagtattcagcaatggtgagttcttgtagaggaggagacatgcctcagtcactttcctgcctctctcagtactta

SEQ ID NO: 234566 - DNA, 440 bp, Homo sapiens
ctataatcccagctactccggtggctgaggcaggagaatcgcttgaacttgggaggtgaaggtacagagtgagactccatcacaaattaaaaaaaaaagtgaatttaatgtgaacacagttttgtaataataagagagaaaatgatagatcggtgatgaaattaatgtaaaaattggaaacttcaaaggcataatcgaaattttagaagatttgtctcctctattattaggtcagtcaaaagacatggattaaacataacaataaaataactctaccaagtacattatcttggagaatgttaaactcagagtcttgtatttttcttatttcccaaagaattccaagttcacgattactccaaatccaaaaacattcagagtgtggactattatattgaaatgaaccaaatataaaacgaaccatcctgtctacacaattt

SEQ ID NO: 234567 - DNA, 274 bp, Homo sapiens
attttttttttttttttttttttagattcagggagtacaagcacaggtttcttaacatgtccatattgtgtagtggtgaagactgggcttttagtgtacccatcaggtgtacccaaaactacctattatgtccaatgttcactgaactgtgaactcactgccactcactgaacagtgaacattgtacctaataaataatttttcaaccctcaccctcttcccatcctcccacccttctgagtctccaatgactcttattccattctgtatatcc

SEQ ID NO: 234568 - DNA, 512 bp, Homo sapiens
tacaccttcaccgtctttgcttcctgtgcccagctatcttcaaggacaagaggggatttttttgtacctgtgtgtgaacaccgcagcccacaaaaccaagttctgttcacactttctaacagccaccctctgtctgcgtctggatctgaggtgtgcctataccagttgttgggtccttcattgggaggacagttctcagaagaagctagctcagggccaagaagtggctttggtaataccagtcagggaattccagggtcctgggtcttggggacatagtgggtacccaggctttgggtgctggcctggagatttttcaccccataagaagagtcaggttggtgtcctctaaaatggagggcctagaacacggtttttcttgctggggtctaaggacactactgcctctggcccctacaaaatttatcttagggaccaatttgcaggaatctgtttatctggctagagctttctcaatgggaagtaaataaatggtctccatttatcattta

SEQ ID NO: 234569 - DNA, 212 bp, Homo sapiens
tctaaagcattttaggtagagctaaaacttcacctcttcacccatctcctgctctccctgtctgttttttcctttgtcaaggaacctgctttctaatgtgtttttgtccttttactacatatgataagatctatagatactgatttttggtatctattgagacttgctttttgacccattacatgaccacttttataaatgttctgtataag

SEQ ID NO: 234570 - DNA, 93 bp, Homo sapiens
tcattattgagtatatgcacacattgctacttatttgattatgtatcttttaaattgattcagtgcatagaaaactatctcttacaaacttta

SEQ ID NO: 234571 - DNA, 468 bp, Homo sapiens
aaagatcctgcctaagccgcagaaagtggaggcggcaatccctggggccggcctcggccaggaggggtccaggtcctcccacaaataacccaacctcccgtccttcagaggcacagcccttggaggtgcctggtggaactgagcatggctgctctccgtgggaaccgctcagcaactcagctgcacagactcctttcttcccacctctccatcccactgctccctcctgtcccctcgggcttcctgggtcacctccaggtaatccacctgcacccaagcccctgcctcggctctgccttcaggggaacccaaaccaagacacatctcttttacatcaaatgcagtgtgtttttctgctgatagacatggaaaggccctcaggggaaacacaagaatctggcgacaatgaccgcctttggagagacaccagtaggagacaccagtaggacgtttactactcactcttcc

SEQ ID NO: 234572 - DNA, 274 bp, Homo sapiens
ggtctgggtacaacaagggtttgtcagtatttacctttgcctagaaatttacatgcattaggagacttgacaatgtcttcgtgtattttaattttttttattttattaaaagacattttgaaaacatgcaaataaaggaaatgatcctagatacatatttttcttagcttttctcagtattgtttcaacttgatgatattgttccaagtattgttccaacttgcaaatttaagttcactaataagggttccatgaaaaagccacagctttaaag

SEQ ID NO: 234573 - DNA, 509 bp, Homo sapiens
ttctgttctagagacatgctgatctagattttatcaggtacccttctctccttgcctcaaggcctaaacctttctgttactgcttttaggatctgttggtttcaccttttgtatgtgacctcttttgagttttgacttgtggttcagatctgagattttgtattataagagaagggtggtgaatgagtgaactgaaattcaaggactggaggtggtgtgtggtgctctgcttgatgaatacatatggtacaggcagcccctaccttccagtgagactaggagcaccctgctggtttctcctgtgatacatgacaccttcaacaaatgggccagccaggcgttgctcagactggatgcaggcctcacatgatgttcttcttggcctttcactcatttctctgtccacactactccaaggtccttgtgctcctgtgtagcctcagagccttttaacccactctgtgcaactctgctcttgtgttaataaatgaaatgtgatttgttactga

SEQ ID NO: 234574 - DNA, 490 bp, Homo sapiens
caggacagagagtggggtggacacacagcacaatcacagcttaacccttgtgctaataaagatcatggggcaaggaggaaatggaagcacattgccttcagaaggacgtggaatgagaggcaatcaggaatgagatgctctgaattgacacagaccaaattcaagttatggttctgctacttagtaacaggaatttaaggaaattatttaagctctccaagtcttattcttctcaacagcaacatgggggataatgccatctactttacagggctattgtgaggaacagagaaaatggtatgggaacaaaacctcctttgtggctggtttggactgaattctcaatgaatggcaacaattattatggagacctggcatctgtgggtagcttctgattttgaattgtcttaaaacaacaacaacaacaccaccaacaaaaaccctcttatttatacttaacatattcacacaaaaaactaacaagctacct

SEQ ID NO: 234575 - DNA, 218 bp, Homo sapiens
tagtagttttggctcaattgtgttctgcctgcaatatatacaagtgccaaggtccctgcacccttcccagaaaggcgtgccctcacccaccttgatcttccataatctaggtgaaaagtggcatgagcatttgagttgactatttatatagatatgaacaatttttaattcttttcctgaaaaaggttaaaatccttttttatgtttctgtttgctgg

SEQ ID NO: 234576 - DNA, 429 bp, Homo sapiens
caggcttggcaaatcaaacgcaagagtgagcattttcattagtcttagatttttaggagacaggtacaggaaaaaaaaataagcacttaaaatcaggttgttatatattgagtgaaaaaagccaggttaaaaagaagaagatgccaaaacattgattagaagggcatcaaacgttatttgatgcaaaggtgtctctgcatatttacatggcatggataagacagtaccttatggcacccaagtgtacagtctacagctacaattactttattgatcacagaaatcaaaatccattcaacacagaggacttgttttattatttgttatacctcaaattactttgaaataacttaaatgaaagcaaaattggaaatgattatttcattgattttttgaagaaataaattttctaattaccgaatgatctgg

SEQ ID NO: 234577 - DNA, 171 bp, Homo sapiens
tttataacctagcatgtttgagttcggctttgagactgaaatcctctattttgtggactaaatgcatttttaaaaatatttttgtctcaatgattaacataacttgaacttagtaccaatttggacttctctgttgatattttctgtctttgataaattggaattaatata

SEQ ID NO: 234578 - DNA, 456 bp, Homo sapiens
cacacaaatttattttgtgtgtaacccttgactttcagaaggtttgggttattctatgcataattttttaaaaaaccatttggtttaaaataatttcaaacttaaagaatttgcaagaagagtataaagcattcccatatattctttacccagattctccaaatattaacatcttatcacattatttaaccctccttttgtgtgtgtgcgtgtgtggttttccccccacatgaaccatttgagagtaagttgcggacctgttgcccctttattcctaaaaatgcaccttaaaaagtaaaaaagttgcattactgctttcttctcttgaaaatattaatctgactggggacagcatcatgcctataatcttagcacttctggaggccaaggagggaggatcggttgagcccaggagttcgagaccagtctgggcaacatcgtgagaccctgtctcta

SEQ ID NO: 234579 - DNA, 532 bp, Homo sapiens
ttaaagtttgacttgccaaccaacaagctaaagcatgacctgtcccacggccatgcttcaaagttccgacagatatattcctccctaaacactgcatctatttcaaaatcctttttataaaaaagggagtaatgtccacaaaggatcaaagggcatcctacagtctggcaattgcttaagaaaaatggcagcacttccatgaaatatgccctaaaataattttgcggcttggtatgtcctaatttcaaattggatgtttatcttggaaaggcttctatctaacttgtccataaaacagctccacttagctctatgagctctgtgaaaatggaatccaaagctggttattaagggggcctagagatcggttccatatggcggaacagcatgggagggcaaggctgaggactgtagcaggcgcgacttggctggagctcctgatctatccatggacactcgctgcattacaccataacatctggattattgcttgtaatgtccctgggaaatatccactttccatcaaagcttt

SEQ ID NO: 234580 - DNA, 162 bp, Homo sapiens
cctcccatttttattagggtataacatgcatgccctagagtgcacaaatctcaagtaaacagcttgatgagttcttacaaatgtatacatctgtgaaccccccaccagatcaagctattacacatttccagcccccacccccatcccagaaggctccttcct

SEQ ID NO: 234581 - DNA, 874 bp, Homo sapiens
actattattggttggatgattagataattgtgtttcctcggcagaatcaaactcaagtcaaatgtgtggttaccgggattaagaacagaaagaatagaggggactcctgagtgagtttcactttctctctctttttgttattgttgttcatttgttttgttaatagaaagatcaatatagctatagagcatttaaaataaaaggatttgggccatggtggtggtggcgaatgctgtaatcccaacactttgaaagactgaggtgagaggattgcttaaagccaggagttcaagaccagcctgggcaacaaagcgagatgccatctctacaaaaaatgatttaaaaattagtggggtgccttggagcacgcctgtggtcccagctattcaggaggctgaggcaggaggattgcttgaggctgagaggtcaagactacagtgaactatgatcaggcccctgcacttgctccagcctggtgacagagtgagaccctgcctctctagaaaaaaaaaaaagaattggggggggggggattaataaaagttcagtgccatccggttcagagtgattcaagggtggcataagtcaaataccacatttagaaattttggtcagggacggatgattatggatgtctcacgggccatgcccaaatcagagtcaaggctaggggtggctttctaggcagcaagggtcattgggatactgaaaatgtaaaaggagtgggcttcaatcacagaaacacagagaagtctcttgctttcagaggaacaggcctcacagccccttcctgccctcccttgttgccctgaggatgaagtgggagggagaaaagggccccactcatcaacccaagatcatagctagcaccttc

SEQ ID NO: 234582 - DNA, 590 bp, Homo sapiens
ttactctctgcagtatctattcaactgcaaggaagtattgcagggcagaagcaagctcttcaatacaaagcagctcatttcaaagcatccaggcttacttttgttgtctgtgcctattcatcctataaactgctcttcatcaaaatagttaactctcccctgttctgcccccatccactcttgagaatgaggggatggcaggaaaccatcaatacaaaaatctatgtggcaacaacaaccatttggcctgttgagaggtgcttatgcagaaagaaacacaagaaaacaaagaggaagtgtgtgaacttctgaccctctttgccacatgccatttggtgggtgggtggcatgagcaagcatcctgcagtgggtgtttttatgggaccaagtgacaaagagccaaacagggtgagaactcatgagtagcaagtggaaaactaccaagagctgtcccatcactcctgcaacaaacttcacctcgctcaagggagggtagctgaggctcccttctccaaatcctgcaagacacaggcactctgatggggccagctcttcactgcatgggagggcttttgttgaacagtgagttt

SEQ ID NO: 234583 - DNA, 273 bp, Homo sapiens
ggtaggaccactggtagaaagaggctctctttccactgggattgatgtgctgtgaggaggtgaaattgggactgtcccagctatcttgttcccacagggagcagtctgtctggaataaatcaagacacaaaaagtcagagctgtgagatgggatgaggtcaattcctcacactgttggtggaattcgcaaacccaaagccagactatcccatccctccatggacttctccagttatacgtggcaataaattcctttcttgcttaagccaaaca

SEQ ID NO: 234584 - DNA, 230 bp, Homo sapiens
tactagaaaagcaacccaacaaattttataagaacataacataaagtgaatacaatgcattttctacaatatccagtctttggccaaaaattagtagatatgaaaattaaaagaaaaatgtgacccactcacaggaggaaaaaatgcaattaatagaaaatgattctgaggtgttgttgttaatatttcaaatcaggcagtttataaatatgttaaaataactaaagaaa

SEQ ID NO: 234585 - DNA, 499 bp, Homo sapiens
agtcatatccatttttggctagaggagtcaattgaagaaaagataccatctttctatcttttcatctataattttaatgggatacaaacaaacataccaacaggattattttggatcttgacaagctgattccaaagatcatgcagggaaatcaagaaaagttctgaaaaagaaagagaaatgcgggagacaaactctgccagatcttaaagtgtattataaagtgacaataataaactgttcattgcaaattcagaaatagaaagatgaatggagcagaagagcaagtctggaagtagaccacaatatttaaggtcatttaataaataataaaagtggcatttacattagtggagaaaagacggattactcactaaatattgttggtgcaactggctagtcgcctgaaaagaaattcagctggagacttactgcaaatctttgccaggataaattccaactggataaataaattatggtacatgcatacaataaaata

SEQ ID NO: 234586 - DNA, 417 bp, Homo sapiens
acagtaacctgtgttaaataaatgtaaaggttcagttttgaagctgtaaatattttgtatgatgtttattagtacatgtggtcttaaaacaaagtttgaatatttggaattgcaaaatataatttaagactagacacagtaattttcctataaatttatcaataatttttgaaggtttttctgtttggctaattgatttgtttaatataggtcaggttaaaatagaagttttggtttcttctaagacgggatgaactttgcctgctgctaaaatatgtatcttcttccacttttcatatttaaaaagatagcctataaactaatgaatacaataaagatattatatataatgtaatgaaaactaatgtatataaaaagtaatttcataactagtccgagtctcaaattccaaatgaa

SEQ ID NO: 234587 - DNA, 412 bp, Homo sapiens
caggaccaacagttatgagctgtgtgacttcaaactgtatttcttaggtcgccaaggttcagttctatcacatttaaaatagaaaatgacagtagtcattccaaagctatcttgagttaaataagataatccacataaggggtttagcacagtgcctggcacataacaacagcttgccatcaccactacagcaaccctgggcagtccaactttttggctgtttccttaaatgtaaaatacagggtttggactagataatttctaatgtctttactcatctaaaattaaaattctacaatgtatcaacaatatacaagccaactctatttccaaagaacataaatttggattttcaccccagcatgatttaagtactgtaaaagaaacttatttttaagatatccttttattt

SEQ ID NO: 234588 - DNA, 481 bp, Homo sapiens
acggtttcatgccatatcaccttttgaacatgagacagccagcactagccaagaagggtttaacgttttcctgaccctgtgtaaagagaccatgaatttctttggctttcagcttcacaacattgctgttcaccacacttactgtttaattgatcgtcatcccatgaatccacaaagttagccacttttctataacttcatcacatgctatagatgttactgtagcacttttgggaatggcctcatacacagattagcacattttctcttcatttttctggatgtatcatattgttgaatcattgacattgaactcaaggccagtagcactataattcatacctgaacaaaagctcgtctaatacatacacatgtatggtgttatagtgtctctgtaaggcacatcacagccttcttgcacttaggaacactagcacttcagcattacacttgggggccaccataaacggcaaaatcacaa

SEQ ID NO: 234589 - DNA, 455 bp, Homo sapiens
gccagtaggactaagctggcagcacatttggagtatatttagagagtagagctgatgggctttgttagtgggctgaatgtgaagtgtgagacgaagaagggagtcaaggatgaccccaaggttttgacccaaacaattgaaagaatggtgtcgccattaactgagttggggaagactgcaggaggagcaggttgggaaggggtgaatatcaggaaagttttttttttttttttgatatgttaaatttgagatacttattattattattatttattttttttctgtcctcacaatctgttcccatgagatgcttattagatattcaagtggatgttgagaaggcagtacatcctggttacttcaattaaggtatttgcctgtataaatgtactatagaaattctaaataataattaagtgtaaccttattctcatgcaattagggaaagatatggt

SEQ ID NO: 234590 - DNA, 390 bp, Homo sapiens
ctttgatgagctcttctgagtctgtttctgccttagcaacatgatgggttaggttcatgtttctaaggtcctctcctgccccgatattcagtgattagaggaagcctggtgtttggatactgctgaggtgtgagggcaagggctgcctgatatggagtttagaatggtcgcatcctctcctgggctagggttagccttgcccatcaccctgttcagttctcgtctcctcctccaagaagcctgcctgagcaagcccacatccatcgtatttgctttgtactttatattttattaggtgcctttgatatattacttcctttaattctcacagcaacctagtgctatatctttgtgttatattgatgctatatccgatagatgagggaaaag

SEQ ID NO: 234591 - DNA, 236 bp, Homo sapiens
cgtcagtggctgggggcaggtggttttccaactctattacatttaactggatccagagcacgtccaggctctgagtctcattaatatcctgccaccgctcactgagccagccaccagccctgtgccttggccataaactcctttttagtggcctctagcggccttgagtgttaagtaatttattatttgcaaagtggtctattgaaacacctgtatggtgaaacctacccaaagca

SEQ ID NO: 234592 - DNA, 520 bp, Homo sapiens
gaattaaaattatgggcaacttttttggaaacataagtattccatataattgcataaaatatgtattcttttaagctgtatagataaaaatgaatcacttgtatcagagtcatggaatactttatactagggctaaatgaggaataagagaatgatagtttccattgtagctgacagtatttccaaatgtggttaatcttattcaaagtaaaagaactaaaagaacattgaagacatatgttaagtgaaataaaccaggcactaaaggacaaatattatatggttccacttaaataaggtacctagagtagtcaaattcatagagatagaaagtaaaatggtggttactgggagctggggaagcagggaatggggagctactgtttaatacgtacagtttccatttagcatgatgaaaaagttctggagatggatagtgaatgtatttagtattactaaactgtacacttaaaaatggtttaaatggtaaattttatactaggtatattttaccacattg

SEQ ID NO: 234593 - DNA, 511 bp, Homo sapiens
ctgtttttttttttaatttttgattttaatttttgtgggtacatagtaggtatatgtatttatggggtatacgagatgttttgatataggcatgcaatgtatataatcacatcaggtaaattggggtatccatcccctcgagcatttagcctttgtgttacaaataattcaattatactcttttagttattttaaatgtatgattaaattattgttgattatagtcaccctattgtgatatgaaatactaggtctaattgactggttttgatagtgtacttgagttggttaagaagttacctttgggggaaactaaatgaagggtgagggtcctctatgtactattttagcaacttcctaggaatctataatcatttcaaaatcattttccactgtttccatgttaagaaatttctccaactacggattatattttcacaaatatctatttttgtaaacttatagaattcttcaaaaacaaaaaaattgtaagaaaaatgtaaaactagcg

SEQ ID NO: 234594 - DNA, 449 bp, Homo sapiens
ccacgtgctgtgtgccagattcctccatgttcttgatctcattttatccattcaaccctgtattccaggcccattttacagagagaaggttgaggcttggaaaggcatgggggcttacccagggacaagcatttgaagaacaaacaaagggagtgatatgtgtcaaccccaaggcttagttactttctctctctgtctctctctcatctctctgatggggggctgtcaggcaccgtgacagactggtgtgggagatatttggatcaagcacatccttgtgtcctctaatctcaccacccaggcagcggccaactctagcataaggctggtgatgggccagacagacggattccttggaggctggatgcagaacagctgcctgcactacttctgctgcttctagaggccacagtggccctgactgcacacattttcccaggctgcggccg

SEQ ID NO: 234595 - DNA, 335 bp, Homo sapiens
aatacaaatattttgcagtcgtctcaaattgtcttcagaatcaaattacaagctatttttctcattatgacaaaataaagtcttcactttaaccaaaaacatgatttcccagctaataatctaattagacatacttagttataaagatacattttaatcaaaatcaaattaaccttcaaaaggcaaaattctgtcacttctaaagatagtcacaaaataaaatataggctacaaaggtgatttcaaaggaagtatgagttttaagcaacaactactgagctactacctataaaatgctacaagtatttacaatactagtctcaaaatgcatctag

SEQ ID NO: 234596 - DNA, 635 bp, Homo sapiens
atcagactctggctacctaaacttaaggaccacatattactcttcttgaaattcttgggctttaatacagtgcttcatgcatagtgaggatgatataactatttgctgaaagtaatatatgagctctatacaaacatacagtggtttttttagctgctgtggctttttaagctaggttcacattctcttaattacacgtgttatttcaattgcattttagatatcctatatgaatttctaaattttaattacttattgttgcaagattaatagggatggtagtatcttaaggtgaactgttttttacacaaaccccactttagaaacagattccttttggctctcggaaggtgcttgttgaggtacctaatggagcagtggtaataattaacatttccaatcatcctaaattagaaccaactcaaaagagagaaagtgaactttaaaaagatgttttccagagaatcatctggtaagccatttctggaaaataatctgtgctaatgaggaaaaaaacaagtgaagtaaaagtgggatgtgggctttgctattttcggctctttgttttgctttcaacaaggtgtctctaaaccttgctgtgaattttgtacattctgtctgagtctcataatctg

SEQ ID NO: 234597 - DNA, 287 bp, Homo sapiens
gcatattcttcgtattcttaatttcagccctatccaaatgtttacagaatagtttgaagagatttgcagtttcttgttatcagtcttattaagccttggcaaacctttaataacaagtctatcaacaacccaccagggatttgattttagtcttggagtgcctgaatttttacgctattgaacaatttttaattggaagcaccgggaccttttctgatcagttgtccacgttgcctcatgaatgggtggcattcatgctcagcttgaaaaggcaatggcagctgggg

SEQ ID NO: 234598 - DNA, 548 bp, Homo sapiens
tgtgttcattcttctttaaatatttggtagaatttaccagtcatctagtcctgggatttccttcttgagagctttttgattatgctttaatctcttaccttgttataagcctattcagattttctatttctttttgagtcagtttggtagtttgtgtgtttctaggaatttgtccatttcatatagatgaatttattggtgtacaacacttcttagtaagaagtgggtatacaaactcatctctgctgtataagataaatactaaaataaagcttgacaacagtgtaacagaagcctgaagaaaggaaggcttagttgtgtttgaagttggggagatgaaatagattcacaggagaggtgattgaaactcattgggtgccatagaatgagtaaaagttggttaggtgaagatgtaggaatggataagcatgtagggcattccatgtagggaaatgatgtgagtaaaggcagagaggaataaaaatttctagcatgttctgaggccatgaggtgggaagaacataaaagagtttctagaaaaaaaaaga

SEQ ID NO: 234599 - DNA, 180 bp, Homo sapiens
cacactgttcctctgagtgaggaatcaggtttcaggaccctcaatgttgacaactaacattttacccttgagattttacctagagataccgaaagaaaagataacatctgaatacaagaatcgcgttgcatatttgctgcctccatagggttgttgtggtagcgactgattttccacccc

SEQ ID NO: 234600 - DNA, 693 bp, Homo sapiens
gaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctgtaaagaaaaatgaagcttcgcttgcttgcctgctgctcacctactgctttgtggcctggttcctaacaggccatggactggtaataatctgtggccctggggttgggaacctctagccctgaccaatgttagggagcttttttcctgtgttttcttcaagtggtttcatggtttggggtcttacatttaa

SEQ ID NO: 234601 - DNA, 357 bp, Homo sapiens
cagtttcggtaaagcattaaaacctttaacccgtgcttcccccttttgtcagttcttccaattggcagtaggagcctgggaaataatgtttgtagcctccctaccctgcttacagatcaggatagggaacggctggtatgaggcaggctgagggacaagagataaacaactagatcaccattgtatcctcagcatctagcagagttcctgataaatgaatgattctgaaaattgactggttctatttgttcttttgtattattaacataacataaaatctcctgacactgagtgccagagaccaaagtattcatattcatatttccagacataaaagtcttcccttatttctaaaga

SEQ ID NO: 234602 - DNA, 969 bp, Homo sapiens
tggagagagggctatgatatttttggtcctctgaaaatgaatccaaaacaataaaacaagctgaatgttttcctctagtggaaagaaagaaagcaaacctactacaggtaaattgaaatcttcaaacagacccataacacactgctgagacattcttgagatgatggctttagttagactggggccacacatctttacatttcttcattcacctggcaggactaatgagattttatggcgggcaagctgtttatcccttgggtgacattggcaagcacatctatatctttatcaatcaagggttttctgcactgcaactcccacccccaacctaaagattgccccagcctggatcacaacatttacaacacgtaagaacctcattccttttcatcaacactccacccatcactttctgttacctagatctaatcatgtgtgtcctaacatcacattgctccataacaaggggcaggaagaagaaatgaataaaaggaaaagaaaaaaaggtttcgatggtacctgcaagttgatgcagagctgacagctccatggctagaatattatatttgcccaatagaacaataggtctgctggcaagctgttacctacagtactgtatctgctgaacaggtggaaaaagctctcttcccctctgcagtggtttaggaacatgaggaggtgaccaccactccagtttggaaacaaggatttggttcccctttgtagctttcatattgcctgaattcacctgcaatgtctattttcagtacttaataaatactcatatacacatgaacatacaaactcacatatttaacaattgccatcataaactctcaggatgatgtatccattctacctttgcaacctggaaaatgtccccagatctcagaccaaggagatactggggaaatggctctgcaaaaatccaggaacaggttttggttctggttctcccatagaata

SEQ ID NO: 234603 - DNA, 238 bp, Homo sapiens
gcttgtttgttttgtttttaaactaagcagaaattcataaacatgtattataaagttgtcactcattctagtggctctctgttttttcttttcaagcttgtggaaattgtacatatttttaatgctttcaaataaaacatacatcaaaggaaaaaattcttttcctctgaacaatttaaaatcccattaaaacgctttatacaggccgggtgcagtggctcacgcctgtaatcccagc

SEQ ID NO: 234604 - DNA, 437 bp, Homo sapiens
tcttagctccaatgagaaatgttgaggatgctgtttttcagggcagggcagctctctggacacaggtaactaggtatcccccctgcccaaggggctaaaacactcgtagtctctggggcttttcccaggagtgggagtcttggaaaactcagaggaaacaggaaggagaacagctcctgtctcagccctgggctcccagtttaggctgctcctccccaaggcctgtcaaaagccattttccttcacctcccagcagattctcagcatccccaggacatgcagtaagtggggtcctcaaaggctctttgatctccaatccacgggagtgccaggccataaatattatgttactacccccgtcaccagccctccaatgcgacaatgtctgtgcttttaattcggacttagattaacaatggttacgttctgtttaatga

SEQ ID NO: 234605 - DNA, 528 bp, Homo sapiens
cactataacaatacaaaatcacctaaatatgtgtttatgtagcctacatgcagaaaagcttctggcacaaacttcttaggcctcttctcaagagccttaagcctgagcccctgaagtgacagagctcaagtcaaatcaggaaggatgaagaccagaaaggaataagaagaacaatactttgtggtcacttgtttgttctacctttctaaactggtcctagttcaggttctcttatatatgccattatccattaattcagctattatgataaaatgtttccagtctgtctaatgtaggcaagtactgacacagtgctatttttcctacatgacccagatgaaatcttttgacagccctggaactctcatttatttcctcctctagattcctattctgtggccccagaattactatggaggagacacactgtgaatggtcctgtagaaataggtgggtagagtaagagaattccagcaatgggctcccctcctccaatatcaatttttctttcttctctatagtatttaa

SEQ ID NO: 234606 - DNA, 413 bp, Homo sapiens
tttatttagaaagacttatgcaatgtgtataaaattacaagatttgtgaagagagcaacaaaataaaatgctgtatctcctccctccccaaattgagaaactaatattatcttcattttaccaatgggaaagctaatagcaaagaaaatagcatcgttattagaaaggatggccaccaagccctttttttgtttatttagctgtgacacattcattcttttttccctttctattttgagagctcaggattgatgtcatttaaaacaatacatgtcaaaatctcagattagatctatttgtatatttactctgctttgtcggcaagtgtcaagtatatgaattaagtagattacaaaaatgttaaatggcttttgtaaacgacaaattaaagtcacttgtcatccactgtcaat

SEQ ID NO: 234607 - DNA, 500 bp, Homo sapiens
actgtacattacatcctcctcatgctcagggcccctctgacttcctcttcagctactagtcagagaaaactatttgcttttaaagggctcatacgaatgtagcaagtctactcagacaatctacttatcttaaggtcaacttagtaatcttaattgtatctgcaaaatcctattttgccatataacataatataatcatgagagtaacatcagggagtggggatcataaggcccatcttagaattctgtctaccacagtgatgatatagaagatctgaacaacataatcaacatggcttaactggtgtttccagaacagtcattcataaagttaagcatagacctacactatcatccagctattcctctcctaaataataaagacttttatatgaatattaataagattgcataattaacaaaatagaagattctaatgatacaattaaagcatgtgtcttttcagaatgagaaaaataaaggcaatgagaaactccaga

SEQ ID NO: 234608 - DNA, 326 bp, Homo sapiens
taaactgacagtgatatttaatactcctaacaggggctagatgttctgatctgttaaactgcttggcagttcatgcagagaagacaaaagtgcactgacatcctattgagaggccaggacaaaatatatctcttgaatcacaaataacatgaaaaggacttaggactgaccatatatgcatgactttcatgttattttaaaataaaatgttctaaacaacttatacctctttactatttcatgtccaataattgcactctgattttgtttaaggaaatttttgaattgcctttgagttcagggtgaggatctcttaactaccttta

SEQ ID NO: 234609 - DNA, 214 bp, Homo sapiens
gggcgcccgcggccctacaccacctccgcacacaacgcggccggtgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttc

SEQ ID NO: 234610 - DNA, 446 bp, Homo sapiens
cagattataagacagtaaagatgaaaattcttccaaattaatttataatttttataattttacaaaattttgttttataatttctatcaaaattccagaaaatatttttgtagatatagacacaataattataaaatgctcatgaaatggtaaaggaactataatagctagaacagttttgaaaaaaaaaaagtaggaggaatcagtctacctgattataaaacctaatttatagctatagtaattaggatatgttattagaggaggtatagacacatagatcaatggaatagaatgaagatcccagaatagactcacacaaatatgcccaattgctaaccaaggtgcaaaaaaaaaaattaagatatacagccttttcaacaaatgaacctggaaaaattggatattgataggtgaaaactatagaacttgacctcaacttcata

SEQ ID NO: 234611 - DNA, 218 bp, Homo sapiens
attttaccagattgctctggttagagacaactgattaataatcagcatatgcgttatgagaggaccagatcaactcccagtaagtcctgatcactcctcaattagtaccctgaagcctaggctaggaaggaaaatgactgccaggctgaagaggataaaggctgtccaaggccctaaagaaatgtcacatgaattgaaataataaaacaaatatggtg

SEQ ID NO: 234612 - DNA, 409 bp, Homo sapiens
tctgtctcatcttcactctctcatgtagtctctatgtttatcttacccttcttcaatgaataatttcctttcatcccccttcatctaatttattattatacaaatatggtggtatccattagatttttttttaaccaaaataacctaggacaaaaatttaccattacatagattatagaattgtagaaataattaaaatgttaaattacatgttatattttgaaatatctcttcacaatttacagttgtattaattacctcttgtatggaaaagtgtgagagcttagtttttaatagtaccttatttaactgggtttgcattgaaatagcataggttgtttctattctgtgtggcaaaaagctaagtataaataattgtataaattctgcttcttccaagaaacagaga

SEQ ID NO: 234613 - DNA, 511 bp, Homo sapiens
aggtctcagggcggttatttttcgccagcagaccgatgctgtggcattctcacggtgtgctccagggagccaggctttcggggagggcccctttggccttttgagctcccagtctctgcctctgctgtgaaagaaccaagagttacaggtggttaaaggtggaggggacttgggacccgtttgctcagcatcttccactggtagatgaggccagaggtcaaacagcctactcaaggtcaaacagcctgttcaaggtcaaacagtcagcgacaaagccactgtccccttcagctcgcccctgcactgctctttgtttattacagtgatcctcaaacaaggtagtctcaggactcactttgtactctgaaaaaccactgaggctcccgaggagctcttgtttatatggccgcatctatcaatgtatgttgcattaacaattacagctgagaaacttaaaaaatatgcatgtattaatctatcagtcgattaataaacctgttgcacaccaaca

SEQ ID NO: 234614 - DNA, 479 bp, Homo sapiens
catataagtggaattatatagtatttgtctttttgtaactggcttatttcacttagcataaagtcctcaaggttcatctatgttgtagcatgtgtcagaatttctcttaagactgaacagtattccattggtgtatatacaacacattttgttatctgttgttagagatttgggctgcttccacctttgagctattgtgcataatgctactatgaacattgatatacaaatatctctttgagactatgctttcaattcttttggatatatatccagaagtgaaattgctggatcaaatggtaattctatttttaacttttgaggaaccaccatactatttctgtagcagctgaaccattttatgttcccacaaagagtacataggctttcaacttcttcactctgttattttctttctttttaaatttgttttattgtttgtttttaataacagccattaaaatgagtataagttgcta

SEQ ID NO: 234615 - DNA, 1421 bp, Homo sapiens
tggtttcttgaaatggaatttattcctagtgaagacgctgtgcacattgtggaaatgacaacaaaacatttggaatatcacatcaacttagtggatagcagtggcagagtttgagaatagcctccaactttgaaagaattttcactgtggttaaaatgctatcaaaacagcatcacatgctacaaagaagtctttcatgaaaggaggagtccatcaatgcagtaaatttcactgttgtcttattttaagtaactgacacagccaccaccaccctgatcagtcagcagccatccacactgaggccagattgtcaaagtataaaacaagcaggactcactaaaggctcagatgatcattagtatttttagcactaaaatattttttaattaacgtaagcacatttttatagatataatgcttgctattgcacactttaagtagtatactgtaattacaactttcatatgcactgaaaaacctaaaactgttgcgtcacttgctttactgcaatacttattttactgcggtggtctggattagaactcgaattatctgaggtacgcctgtgtacaaggacaggattcacaaatcactctaagtaaattaagcagagtgatgaaaggctcattggggtcagcctgccatcttccaaattatgactaaatgcaagagcatcaccaataactatactggcagaggttcacatttcacctcgattcttccttatgtttagagaaagcctatttttcagtatgccaggaaaaatcatgaaagtagacctaactaaagctgggggtttctttcatcctgaagaggaaccacttcctaaggaaaaatcatctactgttttaaaaagcaaactctcgtagagttggaagagaaccccacacacaggtggaacaccccccagggctgcggccccgccgtggcgctcagcctggcctgccctgggcccgacctcaggacgccaccattcccggaccctcgggcctcccgtcaggaatccgccatcggaacggaggccctaactggtccggtcgcagagccactgtccaaataaggcatttcgagagccacgaggatgacataaagcagactccgcgtttcttcatttttcgttaagtgacacgatttccctcacaaggaaggtgcaaacccacagggcgcccagaccctgcccggcacttcctgtcatccattaccacgacccgtgtgacagaagcggctcttcccaccaattcccgggacgccggaaccgcttccccagcacccggccccaaacactgccgtcagcgagcggccctgggctgctcccgcgccggcgcccggctgagggccacgagccccatcacgcccaccgcccccaggaccccgacccacccgctcgccacggccgaggccggggccggggtcgcggccgc

SEQ ID NO: 234616 - DNA, 449 bp, Homo sapiens
aaggtgagacggtaggatcgcttgagcccaggaggagttccaggctgcagcaagttatgattgtaccattgcactctagcctgagcaacagggcaaggccctgtctctgaaaaatataataaaaataaagaaaaggacaggtgtggtctctttcagcagaatgaacccaggagttcaagactgtgggcaacatggcaaaaccccatctctacaaaataatacaaaaacattagctgtgggtggtggtgcctgcctgtggtcccagctactcaggaggctgaggcgggaggatggcttgagccagagaggtagaggctgcagtgagccatgaccttgccactgcactccagcctgggtaacagagtgaaaccctatctcaagaaaaaaagaagccaggcgcagtggctcccgtctctaatcccaacactttgggaggctgaggcaggcag

SEQ ID NO: 234617 - DNA, 297 bp, Homo sapiens
tcacgcctgtaataccagcactttgagaggccgagacaggaggatccctggaggccaggagtttgagaccagcttgggcaacatcatgcgaccccttctctacaaaaacttaagaagttagccaggtgtggtggctcatagtccttgtggtaggctcttcgcctatagtcctagacactcgggaggctgtgatgggagggctggttgagcccaggagttcaaggttacagtgagctatgatggccccaaggcattccagcctaggtggcagtgtcacagaccaagaccctgtctcta

SEQ ID NO: 234618 - DNA, 963 bp, Homo sapiens
ttcttttttacatgaaaggttagcatactatatttttcatggtagtattttttaaaagcatggtagaattctgtcctttaaaatttgatagaagtcatctatgtaactaccaagacatggagactttcaagagagatgttctttgataatttatacaattccatggttattggtctattcagagtgtatctcttcttaagtcaatttttggtaattcatgtcttaccaggaaagttaagatattgagtagaagatgcaaatctttctttagttcagagaaaatttcttctgccatatattttattttctcatctctctccttgtggaattactgttatacacatattagacctctatagtctagctatcacagatcatcttttctcttctgaattccaggataaattttcaagcttgagttctgggtcacacattcagctttcttcggttcccaatcttctgttcattgtttccattgaggtttaaatttagcaagctaaaaatgtttcctaatttcagtttgtaatttcttaatgattccttgtaatttcagtttgtaattacataatccactacacttgcaaatacaatatcctcccaaatattattaaaaacataaaagagaaagatgtttaattttttttcctcttcttcttgtggaaatttcatttcaaaggaaactaattttctctgaccatgttccgttctgttgaaagtctgaatctttttgtgttttcatatcattactttttctctctctgtttatttttaccaggagggagtctatatttattctggaatagaagttgaggtggttctcctgattatcatgaatagtcagtaagcattcagtcaaataaataagtggagagaggtattttaagcagagaggacagagagaggaagggcatgaagatataaaagcccaatgtcagctcgtgccgaatcctgcagcccggggga

SEQ ID NO: 234619 - DNA, 517 bp, Homo sapiens
tagatttttaagtatttttaatattatcctaggagaaaatattgcaaacttaacacgagaaagatattggtttgaaatattaaaagctattggcatccttcaactctccaaaaattgtcattttaccaagactcaggcatatgattaggttgttctcagttgacaatcatcatgatgctgagccccagatttaatattgtgtaacatctggattgtcctgccgatatagcagggtgacagcttcacacattccttgaaaagaggtgtccacacactgacagttactcatcattcagaaaatgaaaaaaataataaaatggaaaaaagatgttcttcctgatcttaatttaggctaatctatgtaaaatacattatctaatagcagccagctattaggtaataccagaacagttttctggcacaattgcaaattgcagctgtctgaattatagcaagaaatgtttacctgtgatacaaaaggcaaaaagtttttactaaaggccaaacttcctacaaa

SEQ ID NO: 234620 - DNA, 463 bp, Homo sapiens
agttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccga

SEQ ID NO: 234621 - DNA, 575 bp, Homo sapiens
catgcatcacatgcatccagggttgtgggatgggagaaggcagatgggagaaggcagtctctcccctgggcctccacagaccatgcccagcccaggaggtctaggctgaggggcaggaactcaggaaagagcctgggggagccgctcagggttgagtccaaagaactgaatggtgtaacaccgaggcatcaggagaggagggaaggggaggagagcgtgagacgtggcagaaccagtgaacaccccgagtgaggaggctgagcaaagacaggcagccaagcaagggggcctggggaagggagtaaggacaggtgctggggtctggctctctctaatggacccgccaacccggcccgggcaagtcatttaaactctcggagcttctgattctcccctggaacccgaccatcatgagaagggttacccagcagggccactggcagagggagatgccacagtggattcccgagggctttgcgggccactccatttacgaggtgagaggctggaggtgaggataataaagtgaaagattctaagacaaggtgaagaggaaagactccagaaaatactta

SEQ ID NO: 234622 - DNA, 468 bp, Homo sapiens
atggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggctgactctgtcaggatgccctggcctctggacaaagggaaatggtgaaacagtggaccctcagggagcttctgagcctctgctgacaagggaagggcacagatcctacccactcatattccaccggccaaccaagtcacagggctgtgccggacatcctgggcaggagtgtggtcctccttagggaggggccctgtagggtgaggcagcaaatatatttgaacataaaatgtcaaa

SEQ ID NO: 234623 - DNA, 500 bp, Homo sapiens
cagctgtttatttagcaactgattattgagtgcctcttccatgaggggacaggcatgtactaattttgggaataaagagatgtatattgtgatcctaaggagaagcaaaatgtcctggcacatagtaagcactcaataaatatatattgaataaataataattcctgctctctctgggcatcatagtctagtagggggaagaggcatgtaaacaaataaagttgttttagtacaatagtaaaggaatcgatcaagtactatacatgtagaataccatatctacctggaagttagggatgatttgatagaagaggtaacatttgcttgatgttgaagaacaaatatgagttttccaggaatggaaagtaggaaaggtctttgcaggcagaccaaaattattatactcataggtcttattgtccacgggattggttttgtcactcctgtctaatcctaacttgcaaatataaatatttatcaatatttccctggattttaat

SEQ ID NO: 234624 - DNA, 1937 bp, Homo sapiens
ctacaaagggacgcctccaccatcattaaggagaggagtgtggaggccgaggagaggtttccggtaaaggctgggattgggaagatgattactcacacctggtgatttctgctcaatcctgcatgtgcaggaggtcatgagctagaacaaggaggaaggagatggggaagccagttttgcaaaccatggactgagcggttttggagatcttgctggcctgagcagcgtctgggagatgtgtcctttctggaatagttggccacactgctgctatgaaaagtgtggtgggaatacccacaaagccagcatggccttccctgccatgccccagacagtcacatctgacactcacctgccattcccagctgtagcagagacccacagagctttatctgacccattcttttttttttcctttgagacggagtctcactgtgtcacccaggctggagtacaatggcgtgggctcactgcaacctctgcctcctggattcatgggactataggcacgtgccaccacacccagctaattttttgtatttttattagaggtggggtttcgctatgttggccaggctggtcttgaactcctgacctcatgacctgcccaccttggcttcccaaagtgctgggattacaggcgtgagccactgtgcctggcctatctgatccattcttacagcaacatggagtggcttgagagagcctcagagacacgaaatgcaaaacaggtctattttattctcctttattaaaaaataaaaaattcaatatagacagccccaactcataaaagggttgtattgtaaccagtggtttaccttcctggctagcacctagaaccataattgccaagcatataactgaattgtagtgcagactgcaagcctaatgtatggactgtgggaacaaaaaacagtataggaaggaggaaaagaaaaaagctgagagtttcttatctttttcctggacctgaagctgccacagataaaattgtaagtggaagagcttgccctttgtcttcccctgacttctatagccctctgtgtcggtccccagtgctgcactcccaccctgggctccactctgcagcctctgtgtgtgtttacagggcaatgggcaggtcagggtgagattgaacagaagagggagttggtgtccaagctctcctagttctcaacatgatcttgagcaaaccactttacattcctgagccctgctgttcttatctgtaaagtcaaggtaatactaaaacccacctcacaagcttgtaataaaaatccaaagagataaagtttgtaaaacttcgaaaaatactgggtaagctgtaaagaactctgttacccaggaaagatgtcttattaggaccagactaccaaggattagtcgggacattttggctggaaatgagaaccccactcagactagcttaggtcatcaaaggggagatactggaaggagcctcagattgctcacagaattgaaagaagaacttgaaaccagagtgacacaaaacggggctgatcctgacaacgtcccagaacgggggccctaccctctgtttctcctagttctcagagtttgccatgtcaggtatgtgactgagtaagtctacactcttaagtcggtatgaacaaatctcaagaaaggatcgaccgggcatagtggctcatgcctgtaatcccagcactttgggaggccaaggcgggcggatcacttgaggtcaggagtttcggaccagcctggccaacgtggtgaaacctcgtctgtactaaaagtaggaaaattagctgggtgtggtggcgcatgcctgtagttccagctactcaggaggcagaggtgagagaatcgtgcttgaacaggggagatggaggttgcagtgagctgagattgtgccattgcactccagcctgggcgacagaggaagactccatctc

SEQ ID NO: 234625 - DNA, 432 bp, Homo sapiens
tacaatcagacaagccaagagtgtgtaagatgagttagatgcgagggtctggctccagaaccctaaactctgattgactgataagctttgtccttgatctggaatgacttgatcactgggaataaatatgaattctcaagcaggagtatctgctcatggggattataaagcagattagtgtaagacaagacaggaagatttttcagtgtccgggaagactctggccccacccactactgatccaaaaccttttagctgaagtctaccgttcgctcctcagcagcagcagttcccagtgcagttattgggcccttttgtttgggtgtggtcttttctgatgtgtggaatatgaatgagaggggtttggcacttttggtttactcttttgatatctatctaagtaataaacgctaaatctaaaagtgtcttctt

SEQ ID NO: 234626 - DNA, 493 bp, Homo sapiens
agcaaagcccaatttacgttgttttttttgttggcttttcagcccattttccctctggtctcccacgctgccccctcgcctccctactccggaatccgcgctctcccgggccttgcaggctcttcactcccgctcttggcaactggctgacaacgagcataaagaagggtatgggtgcgtggtcccgagtgctgtcacccagggctcagccacccacactcggcaacgggtgcagacgccagtgaactgagacgggaagttgaaatacataacgttgaaactgttggaaaactggtcaaaaccagggccatgtggacctttgaaactatgtggagtaaaaggggaaaatggaaagagcgagactgtaacaccgcccgcccttgcagactcctaacttgtgcagtgtagatttctgcacaaggaggttattgatagacatgagaggaaattcgagaaagactggtgaggggcgctggtgtgtgtggtggggacg

SEQ ID NO: 234627 - DNA, 342 bp, Homo sapiens
taatacatttagtaggtatatttgggcatatttaattcatttagatgtcttggatttgtacctcagatgctgtcttggtgagggtatcaaatatgccagcaagagtttgacgttgagacagtgaaaaaaagagtaagaggaaatcagcctataaatggaaaggagcgaaatataaagagcattaataagttacacagtttcagaactggttggctatctaatcaacataatgtacacatgttttgttattattgacttcacccctcatagagatcattgaatgttgatttttctcagacctacctttttcatggtaatgaataaagagcatagcttcttttc

SEQ ID NO: 234628 - DNA, 595 bp, Homo sapiens
cacaagttaattcactttttaaaaaacttcatgtcatctgaatacttaagctgctttgtttggaaagtgtctttttaaagaaaatagttaataaaattacagtaagataattgtcacaaaataaaaatcttaggtggccagttgtgtattacagagatttggttttaacagttatacaagttatttaagtgggaaacattaatattaaattttattaagaaaaattttgacaccaaaaaatctgtccttcacttagaatataaaatgtatagctgaacaccagcaggtgtcactgtgataacatgttttccccccctgaacagttttatgtggatgggtgcataccaactatggacaaagatatttaggagataataaatgtaagttatatagctgaataaaaataccaaaatgtaggaaaagcctatgagttccatgttggttaggaatgctgtatttttttttttaggattgctgtatttttaggagaattgtatttttttctcgctttcttcatgtcgtaaacatacagtcttccattatgtaagtgatgtgctgttttattagcaataaaagtagagtaaaaatcccttta

SEQ ID NO: 234629 - DNA, 850 bp, Homo sapiens
agtttttacagaaaatatttgggggtggccagcatacccagttggtgttaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtcacactgttgcccaggctggtcttgaacccttgagctcaagtgatgctcccactttggcttcccaaagtgctgggattatgggcgtgagccaccacacccagcccaaaattattttttggcttacaaaagaagttgctttaaacttctgtttcatctgtaggatatggataacaatagttaagagttgtgagaattagaagttagagaccttactcagaatactagggagcaggtgttagggattttggagctttaccttttaagaacttttgtccatatagtagacaacatactcaccagtgaggacctcaaatagcaatatttctgtggtgaaatttggggatatttatgttaaataaacagcatgtcagtcaaggttgggttttcctgacaaaatttgaaagaatttctctggattttggttttcaggactggtgtgacttaacatacatggcatagatagtatacgtctgttaagtcagtaattacacttacttgagcacaggtactgttcaaggtgctgagaatacagtatagacaaattcctacccttatgaagctgatgttgcaaaaaa

SEQ ID NO: 234630 - DNA, 449 bp, Homo sapiens
caggaagagaagccaccagaagcccctaccctcattagtccgcaaaatcctgtctccttgtgttagaggaatgagaccaagattttctcccatctttccccacagttttaaagaggaacaatctgaaaccatggggctgggaaaagctgccagaaaatcaggatggatttggggacagtggccctttctgtccactcagctgtcctgtcggactgatgacttggagcccgcagttcagaagactcctcatgggatgccccaccccacagagtgggggtgtggtgggcggccggatgcgtagtccagggacgtttgtgatttggagtgtgctagactatgtgtataagtcacatgggtgtgtgtcactgtgtgtgctggcgtgccttataggtgtgcgtgtttccctgtcagttttgacacggattatatgaaattaataagggttttta

SEQ ID NO: 234631 - DNA, 538 bp, Homo sapiens
tattccagaacttacagtaaaaataaataaatagttaaaacttagcattacagttaaatacatgaatttgcacttttgggggaaattattgttgtagacattaaatttcctggtctatgatgtatagggtacatgtcttattcctaaaatgttgagttgtatatagagtgaatttatgttttatctatctactagttatctttgcttgcagtcttatgagtaagtcaggaagatttctgtatcacatgagcagatttctaatttttattgctcagttaattttttttcttacattatagaattttagagttaaggaaatggaggcccgaagagcttaagttatttgctggaaaatgcatagtttttccagacagtgcctagaactgaaatcttctgaattctaatccatcctctcaactggtatgtagactttgggccatttttttttttctccagtgcatttccctcttgcccagtactatcaagaagtaagttaattctaatactagcttaccccaaaaaaataaaaataaaaacc

SEQ ID NO: 234632 - DNA, 2601 bp, Homo sapiens
ggccatggatgggcttggataaagcaccataagttcttcctctaggccatggactccccctggaactggcagcctggcccccaggcttcaggctgtccctgggttgaaggtggtgtttcacctgggacctgcccctttctgcccaggagcctgtctgcctcctgctaccatcaacatggcatccacagcacccaggctgtgcatgctgagggacgcctgcaggcctgcactgagctgccctcagtctcctcttggcttccctcctgtgcctgtcggtgaccaaagtctggagggggccaagatgacaggggtcttgcatgtcaacaccacccagagtacatacacacccagctgggttgcgacagcacccaggctcagtttcaactttgctccaaaaatcagagtggacactgggagtggtgagatgccagggagcgggagcaggcaattacaagcctgcatgacaggggggcttcctgggtccccaagagcagagggatgcctgggtccagagctgtggctaggtagctgcagctgtgcctgggagctcagggctcctgccctgccaacttgatagaaggcagggttcccacctgttcctggtccctgccagctctgtggagcatgcagccccagctatgcctcccctgctgcagctggcatccccacagcagctgctccagataggccactgctgccatcactgacaattctttcagctcacaaaggtagccatgaattaggaaagttgggtcaggctccaggcagcctgcgttcaggcaagctcaagagctgaggatgcccacctttgcaaacatggcaactctacccatccctgtgtctcctagacactagagcccccaccctctgctattattctaccatactcattccccagccagagtctgggacctgggctcctgcagataattctacatcaaaaacaggggaagtagaaaagttcatgaaggctcctaagtctctccaaccacccagggccacaaaatccatgtagaggcctcatgaagggttttgtctaatcaaatagtttgctccaaccagccagcatctttcttttgatctagatgtctgtctccatagaaaaggacatctattgagggtcagggacctaatggcttgtgggttcctgagatacaattatgtgttacggagaaacaaagaaaattttgagacttttaggcaacagagaaaccactgcaaaaccctgtaattacagggcaagaagaaaaaagtgagctgccacagtgcctggggtagaaatagcctgacgttgcttcctggatggacctagaatgttgcacaaggtgacgtcagagtggttgcttagaagagaggtcattggatgcagttttccagctgagtacagtgggtggggtgcactgttgttcctggggcagagtgggcgagggagctgtggggagagatgaggaagcaggacaggaaaccacatttgctgaaggccaagggctgtgacaggcagacactgagacatatcgctgcactcagttctcagaacaactcagcgaagtcaggccttgtacccctagtcactagacaagaaaacagagggtcagagaggtgaggagacttgcccaagctcacctgatccctgacctgactgattgaaggcccagggcacccatccatgctaactaaggtgcaagttcgtactgtcacttctttgtgaaggggctgctctttaacaaaggataaaatgagaggttgttctactctgaggggaggggaggcagagagaaagaggggagagacttgcctctgtttgcctacaggtgccaagccaaaagaggggcttgagcttgtggagaaagcattgagttggaaatcgaatcacccagcttcaaattctgcctctactaatgccatgtggtctggggccaattactttagttctctgtgcaacaatgtcggcatcgggagtaaaggggttgaggtggtggggtgagaagtgtccactcttggtccctgcaagtctgaatcctttacactgcatgtcagcttagaataatgacggttatgagcaaggagcctggaatcagattgccaggttcaaatcccaactttgccctaagctacagtgtgacgtcaggcaagccacagatctgtgactcagtttaccctgtgtaaaatgaggataatgataatattcacaacctaggttgtcatgacaattaaatgacatcatgtgcgtgcaaccaaaatagcatttggctcatcctaggcacgggagaactatatgccaggactcagcccatggctcacgcagagctggagaagatctgggggaaggaaaaacagcttgcttgctgggcggtcccagactgcaaggtctccacctaccccagctcgcatcataactccttgaagtcaatccagatgggctctggccaccccaggggactgagcccattcccatcgagagctcattaaaattacccagaaatgggctgggcgtggtggctcacgcctataatcccaccactttgggaggccaaagtgggcagatcgaagtcaagagattgagagtatcctggccaacatggtgaaacctcatctctactg

SEQ ID NO: 234633 - DNA, 867 bp, Homo sapiens
aatgagtgaggctggggaatgggctgggggtattagcagtccttttgcagtgtgtgtggtggggtcacaccactatggctaagcctaagacactcccagagagaagtactgcagaaggaactggtttccggactgcagagggatctgcatttttgtttttgaccacccccaccaaaaaaataggttagatctgaagggcaaagggaatacccaagcctctgatgcctatgagaagtccctggacttcgacccttctgatgtgtgatgttagccccgtggggagctgctcacctgagcacctttgggggtgagaagggagcagggaggtagggtgggatattggagtcagcatctgtagtgggcagccctgagcctggaatagatactttttggtcttttggttgtagatgttatttgagtacatttatgcccctggctgattgagagcttctcagtacttcttgccatccccctcactgccctgacccaaccccactggaccttaatacagtgaggggtggtatcctggacagggactctgcactcccagctgtttggatcacagaagagtgtttgcccctctgcctttgccagaagagggtttgtttctccaaccctacaaggccaggcagacgtggacaggagccaggggagcagggtaatgaactttttttcctttggcaagtggggcgctcctcgcctctctctttgccccatagcccgctcacggacgcccggcctcaccaggtagtgttgcttgatttgtatgcaaaatgttgttcttcctttatctgaaattcaaatttaattgggtattttgtatcttatctggcaatcctaccgccaacctgacttcaggccggagga

SEQ ID NO: 234634 - DNA, 213 bp, Homo sapiens
atgaagtcttcaaaatccagcatatactttacacttaaagtgtatctcagttttaagtgtttgagggtcccatgtggctggtggcccacttattgggaagcacagcaccatctcttctgaacagaagacttcaatccttgctatttatacaaacccattctctagttatggcctcacacctcattttcacaatggatgatctttcttctgatt

SEQ ID NO: 234635 - DNA, 393 bp, Homo sapiens
cgggaatgaatttcaagtcataataatcagaatttttagttttacttttttcttttacaatatggattttgttgttatttggatagtggttcaataaatcttaagctcagataattaaacactattttgaatcttaacaagatactgaggctttttttgtatgggatgatatcaacctatgtacaatgaatttaataaacttaagtattgtcagattttttgcacattttagctcaataaaatcttaatgttcaagatttttttatctgcatttggaaatacaattttgtaaaatcaatgtcttacctttttgatacaatagatcatgttttgtttttaataaagcaagaagcccttttatctgttgtttttcagggaagggattaacattta

SEQ ID NO: 234636 - DNA, 472 bp, Homo sapiens
ccacaaggagccatagaaggttatagagcaggggagtgcagcaccatcagagctgcaattgagctccaggcctcaggtgtgtagcagacaaaggcacccctaattcaaggggtgaatcaggcatggtctctacccttgcagagagtttgggtacctgagcccatgggggactgggaagctgcttccccaccccagtttcctcatcagcaaaatggacccaggtatgtgatgtagcatttcctgacccaagggacccaacaaacagctgcgataggattttggagggacctgtacccgcacctccaccttcacaagttgtgcatttatttcatggtttaatgacttcaccttcttttggacttttatattatgaaaaatttcaaacctatagaaaagtagacagaatagtatcatgaatacccacatacctatcacccagatttaataaatcttaacattttgtcatgcttca

SEQ ID NO: 234637 - DNA, 413 bp, Homo sapiens
tacaatgattattacttttacaattaaattcaaaaaggaagtcaccctcccttgtaccctactgtcttatcttgcagccacggtgtgaaaccactacttacacgtgtgtattttaagagctggcacaaacagctctgctaatcatagacagaacatatgctgcgttatatttgaaaaccctgaagattcaggttttactgctgataatacgactttggcaacgacacagcacctacttgtccatcaccctgtgggttaatttaaggaataagtgacttcatagcaagtacccttaatatcacaccacaggctcttctgaagaatcaactttcaaaaatttccaaagcttttgagtgttatttctgttgcctcagtaaatgtgcatttctgtgaaacacagattttataggatg

SEQ ID NO: 234638 - DNA, 1111 bp, Homo sapiens
tgaacaatcatctgatgctcttcagaatgaagaccagtatattcaggtacatttacctgtgaaataaagaaacacataaccattaaaaacaacattcaaaatgcacactaaagattctatcctgaaataaatcattaacagcaggtctcagagatttcttcatcgagcaaccagtttgtttcagttacaaccaggtgtactgagaaaccccaacacattgccagttggctggggcctgggaggcagagcttgcaggcagctaaagaaacaatgctcctctggcaacttccatttatcctcccagctttcccaaggctagaagctgcaaagaatgggctccgtgcgcgtactctcagggaggagccttcaaggcttgtgcgcttttcaaagaaaccgggtaacagtcctttctgggagactaggtttacctgggaggaggctcgaatggcactgcgtggttaggcttccctcagacaaatggctttgccggcagtggggcggggatgtatgtggtgccacagatacagatgaacacctttctatgttttgagatgatgctcttcccttagtaacctaaggctgctatgactcttccagaacaccctgtggcaagtataatgaagccataactatcattttcaggggactcaaaccgtttctgaggatttttctacccccatcctcaacccatatatttgttagcaaatagttttcatagtctttttctaactataatttctcttcctcactttttttttttttttttgccttggattagggacacacctagaatcagtgttttcctttctatttaaccagaatactagtaccagattagcaaatgaaactacaggttgaaaactcacccagttcaacagattcaattactgtaatttggatttttaaaatatgatttgggaaattaagaccatataactcattcttaaacaccttcaaatatatcctcactatgctttatttttggtgtagaataaatagaaatattttctaaagatgctcaagagattattagcaaaggcaatatcatttatttttcccagatagctgcattctctcattaaacacacacacacacacccctaaggctttt

SEQ ID NO: 234639 - DNA, 453 bp, Homo sapiens
ctggaagatggtgtgttttgctgctgcaggaattgtcaaggggctgggcagagggcatgtgaagtaacctgggacctgttggtcaccctgggtgatgtgatggcctcattctactggtacttgctgttgctgctgctgtactcccacttggagagtttggcccagcagttcctgaaccatatttgttacctgttctcactcaggttgagttctgtggccagtttatattctcaaagtatttctcttactccagttgttgtactttgttgacattgtattcctggtgctgcctcaactgagaggaaagggtggatgttaattcccgaggttcttgtatcttttattccagtactgttctcttcatgggtatttgctgatgctttattagttcgaaatgcaagaatttagggaaaatcatacttatttgattaaaaaaaatggcgtgtactgaac

SEQ ID NO: 234640 - DNA, 222 bp, Homo sapiens
cactctctcagaggacaacaacccaggagggtgggaaagagctacggagacaaggtgcccaggcacctgctcgagggctgccgctgtttttaggatccagcccccacagccccactccttggtgccaggaaagcaaccggaccttgtgatggggctggggttcctgggctgctgtgttgtcactggggtctcccttttgcttcgaggtgggatttccaatca

SEQ ID NO: 234641 - DNA, 1116 bp, Homo sapiens
acactgtcttcaatgggtggttcctgctctccaggtttatcataaaggaatatccaggcatttgtttctgacatggaatgaatggtcatctgtggtattatttcttttatttgcatcagttttcctacttttgttggtttttaatgaaggtccagcacaggtcctaaaggagccacagacactgaatcaagggctaggagcttggcgggcagggaaatcccacacaacccttgtgccagcctccaagtggatgccaccagccctgctttacaaacgagggtgctgtgtcagcgtccatccatccacagaacctggaagagctttcatccaaaagcatctagaggaagctaacccatttggtgttgatttttcttctcaagctctgagcatttcgagccaccgaataaagacttcacaaagtgcctgcattccgcatttagcactcacacagcatggggctctccagaagtcagtggctccaccaaaggccaaggtgcagtgtgagatgtgcttggggaaaggggcagcctccactctgcttggcacagctcctgctgcctgtaccgcaccctcgtatccatccttctcacccggaggctggcccatggtagcacccacctcaccccttcatggcttctcatgatagggtcaggagctcaaggcaactcagccatgctcccttgctggctaaacacagagagaggacaccttttctgttccctcaattacaaatacttaaatcatggataatccaggctcctctcttccttcagttgcccctcatggcaaagcacacacagatttgtttccctcaactagtctgcctattttcaagactagctgttctctcctgcctttctttttgggttttagttttgttttggttttgactttgaattccagatgaaacactctcaggtaacatttgaagatttgcaggacttaggataacaaagaaagtctcaggaaagagccttctatcccaggggcatagctttttcttgccttctttgaaagcttttgcatgtgtgtttgtgtagttgtttttttctttttttttcttttttcattttgccactgaacatagatgtcccagaaatagacaaccagaagcta

SEQ ID NO: 234642 - DNA, 370 bp, Homo sapiens
atacccctcgctgtgaaaaagagtcaggggaggtcaagacaggcctgggatgccaggtgaggccagaaaccaaggagacagtcaaagagcaaaggccctgtccaaaaggcagagcctgcacaagggttccccccatcccactcggggctatcactggtaacagcacattggaagaatattcctattgtggaatcagaaaaccccaagccccttattctttaattgagccttatctttaaaaagcatcagaagccagaggctacagatttcaattagctatgtaataagaaatcttggaagaatgagatactgttgacacaggggctctggaaagacaagagaccatgccagccaattaccttgtgagaga

SEQ ID NO: 234643 - DNA, 360 bp, Homo sapiens
gttcattcatccgaagtgaatgtggattaattggtttctcaggtagattatagagattaagagaaacagggcctcaaatcagaaacctatatactaacaatatttttcagtatacaatttttataatagacagaagggatacccccatgtagttattcattttttaaacattaacttatctcttactgtttacttggatggtattacagatgtaagtttgtgtataatacttcagcatcatatttgagttaaagcatcatcattaccttgttttgaaacttgctatctaggcgcgctggacatatgctacctattttttcccttgaaggttatattgctggcttaagcattccctgggtg

SEQ ID NO: 234644 - DNA, 311 bp, Homo sapiens
gttccaagtctttgctattgtgaatagtgccacaataaacacatgtgtgcatgtgtctttatagcagcatgatttataatcctttgggtatatacccagtaatgggatggctgggtcaaatggtatttctagttctccatgctcacgggtaggaagaatcaatatcgtgaaaatggccttacttcactctttgaacacaaacagagtgtgttgttcctgagtttatacttcctttaactacataaagtgaatattatgcttgctttgattgctgaaaggtaaactcaagtgtattcacttagaaaattaaa

SEQ ID NO: 234645 - DNA, 457 bp, Homo sapiens
gagtatttgcaggtgtcattccacttttttaggggctcatttttaattatgtcttgcttcttacatgatgttgatgtagttgggatttttttatatttgtctatgagttcatatgtcttggaactttaggtacagtaatactttgaggtttatgttaaagttgcatttttgttggcctggtgtggtggctcacgcctgtaatctgagcactttgagaggctgaggcaggtggatcacctgagatcaggagttcgagatcagcctggccaacatggtgaaaccccatctctactaaaaataccaaaagtagccaggcgtggtggtgcatgcctgtaatcccagctacttgggaggctgaggcaggagaatcacttgaacctgggaggtgaaggttgcagtgggccaagattgcgccattgcactccagcctgggtgacacaagaaaaacgccatctca

SEQ ID NO: 234646 - DNA, 517 bp, Homo sapiens
ttagacaaaatgtggttgataatttaagaaacgtgatttccgtacacatgctactattggtatccctaggctgaaatcatgttgccatgagccaggatggatatactagttgttctatagccagcatctgttctgattggatggcatccagattgtgcagattgataaatattttgaacatcgttcccagttatcatgggcttgtggttgagaaataccaccataaacacaagaagaaaggtcgttgtgttctctgccttggaaaacacagttgctttctggagagactggctgctccgttgatattattttcttctgctcaccagtgactgttgaaaaatattctgtgtgattagaatctagaacgctattgatttttgtctggtctttcatgatatttataatttcctcatttatgtttgagattaaaaaatctttagctaacatcaataaaatacattattgctattaaaatactactgtgaaaatcttgaaataaaaataactttgaaactct

SEQ ID NO: 234647 - DNA, 219 bp, Homo sapiens
gaaaggaggctggggaaagaggttctgttgccaagggtccatggggccactggggtgacatcaggagctggcactgcagcatcagaaggatccagaacagtaatggcagtggtgacaccgagtgcacctgggtgcaggggttgtgcatgctttagggggtgtgccctgggatggagcctgtttgtaggtgaggtcggatacagcttggttcctccttca

SEQ ID NO: 234648 - DNA, 489 bp, Homo sapiens
ctctaaacttatatattaaagtcctttatttagagcagaaaagccggccttgacctccactgtctcagaaccgcgagaaggagccccggacgccgcagcggaggcagcacgagcacccctcccgccgagcgcaagagcgggccctttcggcttccggggtcactggaaggcaaaatgtgtcacaaatacggccagtacaaaccaacgcaacaaactattccacaaaaaaactgaaaaccagcgcggggaggtaaggacacactcttcagaaaagcgaatccgggctcttcgcgcttcctgcagcgccagccgcccctgcagtgccggaatcccccgaaggcacgccagaagctaagccggccaccccgaccgcacccaaggcccgggaggaagcgccgaggtccccgagaatgcctagggaaaccagctgcgcttacaagccagctacgcagcccccgagccccgggccgcactcgcccaggccagccc

SEQ ID NO: 234649 - DNA, 371 bp, Homo sapiens
tatgtattttcctgagcatgctcataattgcaattgtgcaataatttattttctcatcattcttcagacattactaaatccttttacatactcaaataacagaacttagacatcacttcatgtggcttctgcaaagggaaaaatgggaataaaatgcacttacatcattttgtttgagaattaattctcaacatctaaaccttttagtaaggtgtttaaatacattttttctttttctatatatgcatttgtaaataaagaatcctagtgctgagtaacattaaaacaaaagtaataatcctttatacacaggtctgtttcaccaacaacaaagtaatgtcgaataaattgtcctttatatttactttacc

SEQ ID NO: 234650 - DNA, 405 bp, Homo sapiens
tcaggtctgttcgcccttcaccaggcctggggatgaggtcatgctggtgcttgggccatctctgaccaggccagtttcctatttctagggcccaagagccaacagaacatctgtaggaaccagagccggaatcaagctctctgtggagtctgctaatgtggatgtgttggctcaaagtatctggactaaacacagtcttaaaaacctcctgcttagggcaaggttttgaaagaagcagtcgggggaaaagatacccacgcccacaatacggatgtgaggaataagtaaatgtacacagatgtggccaggcagggcgggatctgaaagataaaccagagttggctcagtgggaagggatgagctaacttcctacatcagctccccctggttcctttctccggagca

SEQ ID NO: 234651 - DNA, 373 bp, Homo sapiens
aggttgcagtagctgagatcgcaccactgccactccagctgggtaatagagccagaccttgtctcaaaaaatgaaataataaagtgttcaggctgggcacggtggctcacgcctgtaatcccagcactttgggaggctgaggcaggtggatcacctgaggtctggatttggagaccagcctgaccaacatggagaaaccctgtctctactaaaaatacaaaattatccggacgtggtggcacatgcctgtaatcccagccactcgggaagctgaggcaggaaaattgcttgaatccaggaggtggaggttgccgtgagctgagattccaccattgcactccagcctgggcaacaagagcaaaactctgtctca

SEQ ID NO: 234652 - DNA, 555 bp, Homo sapiens
  misc_feature (23)..(23): n is a, c, g, or t
  misc_feature (430)..(431): n is a, c, g, or t
tacggagaggaagtatggggctnctaaaaaaaaaaaataccttttaggcagacgtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacaaaaaaaaatggacttattggcctcgttcggctaactgtgnnagctctgccgctcgagtacctggtaaagaggggatattcattatctgagttcatggactcggttggctgggtggtgcgagcgcgactagcggaatcaaatgcctcaatggggggtattcccgtg

SEQ ID NO: 234653 - DNA, 796 bp, Homo sapiens
  misc_feature (671)..(672): n is a, c, g, or t
atttgattgtggagagcatatctgatgatggggatttgtaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttgccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacaaaaaaaaatggacttattggcctcgttcggctaactgtgnnagctctgccgctcgagtacctggtaaagaggggatattcattatctgagttcatggactcggttggctgggtggtgcgagcgcgactagcggaatcaaatgcctcaatggggggtattcccgtg

SEQ ID NO: 234654 - DNA, 631 bp, Homo sapiens
tgattttcatgtgggaactctggaagtccgtccgccttagtgatttcacatgtggctaaattgagctaatgacaagctgttcgaagtatggcaaaatggaactttaaaacagtatcttgtcaacaaccaagaggacctttttcacataaagcccacgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccactttgacctcctctccaagacaaaacaaacaaaattagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcag

SEQ ID NO: 234655 - DNA, 278 bp, Homo sapiens
gtgttttctttctttctttctttttttttcctggcactgcaaagacatcagagttggtagaaagcaaaatgtgcctgagtttaatgggatcaactttaaaaacaaaaacaaaaaacctttgagttagccatctgaggtagatgctggcaggtttgctgtaggcccaatggcacagtaagaagtacgacgtggaaatatgtcaactgtagcatagcgagaaattgccttttgtaaaatagtccttcgatatcttaaataaacgtgatgtttgatcaaat

SEQ ID NO: 234656 - DNA, 587 bp, Homo sapiens
ttagggctgtctttttctccccatctcctacttattacaccccttggcactttgcttcttagagttctgggtaaggtcctcaaatgccttctacatgacaaaatcgagaggcttcttctcagtgtttctcacacccaaacatccagctgcttttactgttaaaattctccccctctggactttttttcagcatttcccttgatgtaacctttctgggtcttttccactttctcttctttttcctcttcttactggacattctctcctaatttcactaaaactcatgccttacacttccatttctatttgaatgacttccaaattttcacctgtagtctcttacctttctctcaggcaacaaaccagatttcaagtgcttatcagatgcctccatataattggctcattattaccctaaacacaatatgttgacctgaaatttaagttgcataacctccatttggccttcaaaactcaagtcatattgctctttcccctggcatcctctgggtcctcaggctgcatggagtggtttggagttggggcggggggaagtttttctctgggatccctgtgttcctccatca

SEQ ID NO: 234657 - DNA, 367 bp, Homo sapiens
acttatcagagagtagttagtgggagcgggcttaactaggagcctgtacatctgtccacattttaatgttttaaaggagtgtctttttttcttgaacactgtgtttacagataagagagcggatctcactctgagcatgggaacatgatggcaattaggaggctttcctcctcagaggcctcttgtggctttccacaacttattgtcccatatttttagggcaagtttatacaggcaccccacagtcctttttcccaacaatgtcctaacctatttaaaattatagtggtatcctaacacaccagtacctcagaggactaaacttttaattcaagtaatataaaatgcattttattttgcacatgtt

SEQ ID NO: 234658 - DNA, 300 bp, Homo sapiens
ctgatgaaaatagcaccacataaaagcaggggaatattagaaataaaaataattgtctctaaagacccatacaaccctttttcccataaaaaaaaagatgcactgtaatacatgaaaagataagatctcttgtcaaaagtgtgagagaatgtccggtggttccaaatgacagttacctcttgccccccttctctgccagagttcctttttatctttgcaatcttccagttcttccgatcagcctgcctttagagggctacaaagcatttctttcaagccaccatagctaacacggtgaca

SEQ ID NO: 234659 - DNA, 137 bp, Homo sapiens
atttttggagataaatttttacataaaatgaatcatccaaaattaaatgtttaatgtactttcaagggatcttaagtagctttgctactatatatgtgaccctggtttataaaatatgtctgagcagcaaaatggtt

SEQ ID NO: 234660 - DNA, 1923 bp, Homo sapiens
  misc_feature (792)..(792): n is a, c, g, or t
tcaccaatttggctggtctcgactcctggctggtctcgactcctgacctcaggtgatccacctacctcggcctctcaaagtgttggagttacaagcatgggccaccgcacccggcctatttataattttttgaggaaactttgtactttttcccatagctgtaccattttgcatttccacctacagtgttcaagagttccagtttctccacatccttaccaatacttgtctttttttttttttaatggccatcctggcagatgtaaggtgatatttcatcacagttttgatttgcatttccctgataactaatgacattggacttttttttatatatctgctggccacctgtatgtcttctttggagaaacatctattcaagtttctagttcatttttaaattggattatttgctttttgctattgagttgtttgagttccttatctattttgaagcttaaccctatatcaaatgggattcttatatttttgtttcatattttgtagtatatcaggtccatgaaattagctatcttaagtaagttgcttttgtgttgtttcttatgacaattctgattagaatattaatacaaacgtgaaatgcagcttttaccaacaaatgggctagtttttattgaatcaataaaacccatattttgagagttttactcaaaagaacctaaaattcagttgaatataaagaaatggggttgtttgtttttttcttgtaaatttgtttgagttcattgtagattctggatattagccctttgtcagatgagtaggttgcgnaaattttctcccattttgtaggttgcctgttcactctgatggtagtttcttttgctgtgcagaagctctttagtttaattagatcccatttgtcaattttggcttttgtttccattgcttttggtgttttagacatgaagtccttgcccatgcctatgtcctgaatggtaatgcctaggttttcttctagggtttttatggttttaggtctaacgtttaagtctttaatccattttgaattaatttttgtataaggtgggcgaaggacatgaacagacacttctcaaaagaagacatttatgcagccaaaaaatacatgaaaaaatgcttaccatcactggccatcagagaaatgcaaatcaaaaccacaatgagataccatcccacaccagttagaatggcaatcattaaaaagtcaggaaacaacaggtgctggagaggatgtggagaactaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgtggcactattcacaatagcaaagacttggaaccaacccacatgtccaacaatgatagactggattaagaaaatgtggcacatatacaccatggaatactatgcagccataacaaaggatgagttcatgtcctttgtagggacatggatgaaattggaaatcatcattctcagtaaactatcgcaaggacaaaaaaccaaacaccgcatgttctcactcgtaagtgggaattgaacaatgagaacacatggacacaggaaggggaacatcacactctggggactgttgtgggggggggagatgggggagggatagcattaggagatatacctaatgctaaatgacgagttaatgggtgcagcacaccagcatggcacaggtatacatatgtcactaacctgcacattctgcacatgtaccctaaaacttaaagtataataataataaaataaataattttaaaaaaaaggccaacttgtgaagctaaaaccagc

SEQ ID NO: 234661 - DNA, 659 bp, Homo sapiens
gaataacactactcacttcacagaattaagattattgtggccaggtgaggtggttcaagtctgtaaccacagtactttgggaggacaaggcaggaggatcccctgagccgaggagttcgagatcaaatgatcagcaagaccctgactctacaaaaaaaattttttttcatttggccaagtatggtggtgtgtgcctacagtcccagctactcggaagctgagatggcaggatagcttgagtccaggaggtggaagctgcagtgggccatgcttacacccttgtactccagccagggcaacaaagcaagaccctgtctccaaaaaaaaaaaaaaaaatactctgattgtatctgtattgatcctaatatgatgcctaacacactgtggttggttgctcaatatacggtgggtggttattttgattgccttctcatttccacaaagcaaacacccttgttttttaggaataaattacatgttcaaacacgattaccaaaacctctttcagccaagaagtacaatgaaaggaattcctgaatatcatttatagatcctgaagttgcgtccctaaaattaatataagcagatcaaatccaaagagtttaaaggtcatccctccttcatcctgtcccttattacctgctaatatgtacagttac

SEQ ID NO: 234662 - DNA, 254 bp, Homo sapiens
cattcatcctctggctctttatgtggctggtttctaatatttgaggtctcagctcaaacgttatctcctcacagaagaatctgagctgtttgatcacattatgtgtaaaaatgctcaattacatactgatttcctcttaagtagcttctttccagaactgctgcatggctgtgctccagcaaaataaaaaaggacccaggaaagaggaacatgcaacatttaagatacgcaaaactaaaccaaaagtatcgtat

SEQ ID NO: 234663 - DNA, 318 bp, Homo sapiens
agagaaaactcccataaatagtgaacataccaataaacatagagcagcactgcctgatcctttcccagttttactcctcaaggatgctctgaaagatgagttagctgttgctttttcttagaagggttctttctatgtaaacttatttccagagtgtagaatgggtggttcagcctgtcttcagctgtctgctgtaatggagaggagagggagagcataaataataaaaacccaaagttaatcccaaagatcccattttagtcacttgtgtcaatctcacactccagcagacctctttagaaacaaccacatcataga

SEQ ID NO: 234664 - DNA, 540 bp, Homo sapiens
agaggtttaactacactagtatagagcatcgtttagtaaaggtttgttgaggtttgttgttgatttgtttctacttacacgagatgtcttcatttttaccctcggtcttgaaataaaattttggtgcatgttcaaaaaaaaaaaaaaaaaactcgagtttttttttttttttttttttttttttttttttttttttttttttttccaattttaaaaaatttattttcccatttgtagagaaacatttttgtaaaatttacagttttcgcaatacctgctttgtttaaaaaaattcctaaaaattttgttaaagcattttttttttaaaaaactgacccaaaataatgtccattttatctttaaacattgggtcattaaagcccatataacattttccgtaaaatcaaggggaggttacaattatatacatgacctgatttttctcctaaaggcttttttgaccatgtttgatttccaagatagatccaatgcctttaatatcagactgtagagacaattttgatcctaaacaaaagaggg

SEQ ID NO: 234665 - DNA, 514 bp, Homo sapiens
gggaggaagagagaggggagagagatattgatttattattgattcttcctaaaggtcatctgaacaatcctcttcaggccctcctaggctaccatcaacttcccagagagaggcagcttcaaacctgttgtgtcacatcagttttaaggaaaaagggagacttccaaatgatgactccctttagaagctctaaagagagagtcaaaacagactggtcccaaggagaaacaaccccttgtgacaccagagttcagtccttttccttaaaggtcaccatctctatcaagccctctttcacctagaaagaagtaaggaggagcaaagaagagtcttttctccccagagatcagccattatctggatgattcagaaaaatggaaaagtgcgtagatgaaattctccctctataggtaaaagacctgtttgtctgaaatgtgtggaacctgtcttatccaaattaatatttatggaatccaaataatcttaacttctaaaaattataataatgattgaa

SEQ ID NO: 234666 - DNA, 996 bp, Homo sapiens
caaatattttttcaacacccaccaggtaaaaaggagtgtgccttcatggcgcaaacacaaggggtgacccttcctcctgcaataatctctgagcttatgcctctcgaggtaaaaatgaactttttacaagagaactttttactagtcttaacaagagaactaggtgtagacattgacagaaatccttaactttctggcatggtttgaagtataaataaatttggacagctaccataaacaccactgctataccagggaaaatcctccaaagtactgggatacctgaagtatgcgtaaaaaatcttgactataatcaagtaagcttttttcataaccagtttctttgaaatgatcttctgcagcttaaaaccttaacacatgaaactttagttctggtctcacatttttaaaagtctacttgaaaacaatattatcctaaagtaactgatcaagacatgagaaattaaacaacacaaaagctaaaggtaattcccctgagttattaaaacacctcaaaatcaaaatgctaaatatattcattaatactttggacacataaactataaaagggtcacagaggaacccttaagcattcaaagaataactaaaaataactttacacaaaactttcttatgactcatcaatactcaaaaaatgactataatcaaaattgtttgaagtacaaaacacatcaaggaatatctttaattcctttcattcaaaaattgactacatagttttcttggggggggaaaggcctgaaaagtttattaacaggcctcatcaccattaccttaccttttggcctcggcaagccacaaaggtaattccacgctaaaaaccttacggggacacatctctaggttagaaccctgagtcattaaacacgaatcactccaaaatttgccagtatttctaataatgagttacaccctaatgattcacaactccagactggctacagccttctggctcctggagtcccagctgtatga

SEQ ID NO: 234667 - DNA, 341 bp, Homo sapiens
atgccatggcttacacctgtaatcccagctactctggagttgggggcagagggcccaggacgggagtgtgtgtggggggtgttgcttgagcccaagatgttgagactgtagtgagccatgatcgtaccactgcactgcagcctaggtgacagagcaagaacctatcctaaaataaataattaagatccactcagtgttcagatttcctcaatttactttgttcaaattaggcaaaataaggagtatgtgtttaaaaaactttttttaaagcggaagaagaggccgaggcaagtttcagagcaggagtgaaagtttatcagaatgctttagaacaggaagga

SEQ ID NO: 234668 - DNA, 986 bp, Homo sapiens
ggagtgtggagtgtagagcacctgctgggccagtctctgtagtagcaatcattgaacatgtgggcagggggtggtggggacagtgtccaaagattcctgggaccagaattggcaggaagaactgcctgatttccgtttgccagggtaagcaaagcaccctcggggaggccagaaacccagccctgactggtgctgctgcaagccgggaggatgagttgtgcctggttccctgggcaacctcacccgggctgggctggacctcactatggacttcctgtgggttttcttcaggcatctctcccttcaggcttgttagccaagggaggccttcagtgggggaactgtgggccacagctggaggacctctaccccagggtctttattggacctggctctggtggatgaggggacaaggactccggcaaaaaggagggcaagtgccactctcaagaaccaaaggctcgaggccagcattgtatctgaggagcatgggcacccgctggggcccagctctgtgtgaccttgtgtgggtcacacacatcccataagagagagggtctcactgggttatctccaaggtcttccccaacacgggcattccatgtctaatcgcctaatattctcccaaatggtctattggccatttggctactgatggaaaatcgaattgtttactgtgacttgctcttacaagccaggttgtaggcaggaatagaaaaaacaggcaactgactctaatcccagcactttgggaagccgaggcgggcagatcacctgaggtcagaagttcaagaccagcctgaccaacatggcgaaaccccctctctactaaaaatacaaaaattagccggcgtggtgatgggcgcctgtaatcccagctacttgagaggctgaggcaggagaatcgcttgaatccgggaggcggaagctgcagtgagccaagatcgcaccactgcacttcagcctgggtgatggagtgagactca

SEQ ID NO: 234669 - DNA, 440 bp, Homo sapiens
agcattaattttaacaaagtttgtgagagaagaatgtaagctaagacatacttttaagtataagctgtgcacctaaatacaaatcacactcctaaatcccctcccaaattggagaataaaaaaaggccaagttctccattttaaaagttacaaagacgcccgggcgtggtgactcatgcctgtaatcccagcactttggaagcctgaggcaggcagatcacttgaggtcaggagttcaagaccagcctggctaatatggtgaaaccctgtctctactaaaaatataaaaattagccaggcatggtggcatgtgcctgtagtcccagctaatcgggaggctgaggcaggagaatcacttgaatctgggaggcagaggctgcagtgagcctagattgtgccattgcactgcagcctgggcatcacagcgagactccacctca

SEQ ID NO: 234670 - DNA, 1583 bp, Homo sapiens
  misc_feature (733)..(733): n is a, c, g, or t
  misc_feature (932)..(932): n is a, c, g, or t
agtgctccctatgaattgctgagggagagatacagcatagaaaaaaacaaggtgatgcgatggcgaggaagctcagtgtattggaagtccttctgatcatcttctgcttaattgtggtgaccatagatatcctcttgctgcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccacccttttcacagctgaatatcagacatccaatcggtttcattttaagatcactgactttaataacatacgctatgaagtttcccatgaaaatattaacctggttgatgggattgctgatgcctccaatttgagctattacgtggaggttactgataaacctttcagcatcaaaataatgaggacaagcaacagaagagtcttgttggacacgagcatcgggcccctccagtttgcccagcagtacctgcaactgtctttccgactgcccagtgccaatgtgtatgggctgggagagcatgngcaccagcagtaccgccacaatatgacctggaagacttggcccatcttcacccgggacgctacccccaccgagggcatgattaatctgtatggagctcatacattcttcttgtgccttgaagatgccaggggctcctcttttggagtatttctgatgaacagtaatgccatggaggttacccttcagccagctcctgcnatcacttatcgcacgattggaggcattcttgacttttacgtattcctaggaaacactccagaacaagtggttcaggaatacttggagcttgttggacggccattcttccctccctattggagtcttgggttccagcttagtcgcagggactatggtggcatcaataaattgaaagaagttgtaagccgaaatcgtttagctgagataccatatgatgtccagtactctgacatagactacatggatggaaagaaggatttcactgttgatgaagtcgcttactctggtctcccagattttgtcaaggagttacatgacaatggacagaaatatcttattattatgaatcctggcatctccaaaaactctaactacgagccctataataatggaagcctaaagagagtgtggatcttggggagcaatggctttgctgttggggagggatatccgggaccgacagtctttcccgattataccaatccagtatgcactgagtggtggacagatcaggtcgctaaatttcatgatcatctggagtttgatggagtgtggattgtaagttattattcctgactcaaatttcctttggaaacagataacgccaaattttcagatgagttttgaccttgatgtcaaataaatgtcaat

SEQ ID NO: 234671 - DNA, 560 bp, Homo sapiens
tgcaatatagcactttaattctggaggaaaggtggattattcagtaaatgattctgggacattggggacaaattagatacctacttcacactgataaataaaaccaaatagattaatgagaaaactgtgattaaacaaaacaacacccagactacactggagcaaatctgtgaatttgtttaattttgagtggagaaggactttataagcatgactaccagagcaaaaaaatcatgaagtaaaagatcgatacctttgattataaagagattaaagatttaggccgggtgtggtgctcacgcttgtaatcccagcactttgggaggccaaagcgggtggatcacttgaggtcaggagtttgagaccaacctggtcaacctggtgaaaccccatctctactaaaaatacaaaaaaattagtcaggcatggtagcacatgcctgtaatcccagctactcaggaggctaaggcaggagaattgcttgaatttgggaagtggaggttgcagtgagccgagattgtgccacatcactccagcttgggcgacagagtgactccatc

SEQ ID NO: 234672 - DNA, 602 bp, Homo sapiens
taggtctctgaggaatcgccacactgtcttccacaatgactgaactaatttacattcccaccaatagtgtataagtgttcctttttctctgcaacctcaccagcatctgttattttttgactttttaataatagcctgtaaggaacatggctgtggtttgttcaaggataggccaaggtaagatgtttgcattctgcatgacttgtgagtttagagtgcacacatataactccacttgttatcacagccatgtagccataacatgggaaggccatgccttgctctaagccagtattgtttgcaaaaggtataattgtcctgctgacactgtacaggtgcgctggcacccaaagagagagagagagccagaggggtctgtctttgtagatagacaggagggagccaggacacagctcagctcacttgtgcccagagagagagagttaagctgctgaccctgaaggcaagggagggctgtcggtgcagctgtgtgtttgggagctgctgaactaagcaactgagacagggcagacagtgtgagatagctagtgtgagaaagctgttaatgaaaactgctgctgaataaagccatgtctcatcta

SEQ ID NO: 234673 - DNA, 547 bp, Homo sapiens
tttttaaccacaaatggataatgtgcctcaacatgaagccccctttacactgcagtctaaatcctcttggaaagggtctgggacagccacaacataggcactttgtctccatggcagagaatgacagccgggctccaggtatgggtgcaatacaagttgcatctcacaccatctagtgacaaatccagtccaggtggattcattgagcagtccctatggggctccctgcatggtgccccattctgtccacgagcggagggtgtgtcttcaggctgtgctggtgcttgcctggccttgcccacgcgtactttattctctactcacctatgtcccaagcacagttgcttcaggctgtgctacgggcaaacacccggcttcctcgaagtgatgccagtgctacttccttctgccccctctgagcaaagatgccctcgagaccagctagaaggaagtttgcatacctgtggctgttaccccacctgtcacctgaaaatgaccccatgccccagctcagaagttagaaattgacctatactgcctaaaatta

SEQ ID NO: 234674 - DNA, 420 bp, Homo sapiens
  misc_feature (340)..(340): n is a, c, g, or t
  misc_feature (388)..(388): n is a, c, g, or t
  misc_feature (390)..(390): n is a, c, g, or t
tagtagagatggggtttcaccatgttggccaggctggtctcaaactcctgacctcaggtgatccacctacctcggcctcccaaagtgttgggattacaggcgtgagctactgcgcccagccaactatacatttttgaagccctcctgatcacttccttggttactctcatctttgtttgaagttcaatatattactttttttttttttttttttttttttttggagacagagtctcactctgtcccccaggctggagtgcaatggcatgattccggctcactgcacgccagcctgggcaacagagtgagcccctgtttcaggaaaagaaactgagagggnaggagtaaaggaatttcctaagctactgccatgtgtcaggcccactgntnggcaatttatatcatttagctcttgaatga

SEQ ID NO: 234675 - DNA, 339 bp, Homo sapiens
acagagaagaggatctctgcgtcctcccaggactgtaccctgtaacagaatccagagccatggccttctgtgcctcacgggcctcccgttcagtgctgctccaggtctcccgtggtatttacctttgcctgttgactttgagtgttcacagtcacttttttgaccataaccacatttaaagggcatctctaaagatcaaagttaaattctcctcccacagagaatgcttttactgctgaaaagcaaaaagtgctgaatatggaaactcacaggatgggagatagaacattcatctgaaccccacgaagagaacattttacagtgtgttttactttctgt

SEQ ID NO: 234676 - DNA, 466 bp, Homo sapiens
acaggtagtataaatttgaatcccaaactggtgaaaaggtaggtctatggtgacaaattcccaggaatgacttttattctctgtaccatgagtccaagctaacacaagcactagagggtggattttgttttttaatccttccattgagggtgaatgtctttaaaggtcctggctttgtatgtggatctcaatccaacttctcaccttgtaggggggcctaagactttacctcgagtgtccttgcgtgacctttaaaacccgagcatactggttacagaaactagggactgtctttacgcccaggcagtcacaaagcataaaccacacaccatactgttgttaaatttcctgtttagggctccgcccaggctggaatgcaatggcatgatctcagctcactgcaacctccatctcccaggttcaaatgattctgcctcagcctcccaagtagctgggattaccggca

SEQ ID NO: 234677 - DNA, 443 bp, Homo sapiens
  misc_feature (316)..(316): n is a, c, g, or t
  misc_feature (376)..(376): n is a, c, g, or t
  misc_feature (394)..(394): n is a, c, g, or t
  misc_feature (407)..(407): n is a, c, g, or t
  misc_feature (421)..(421): n is a, c, g, or t
  misc_feature (439)..(439): n is a, c, g, or t
catcttgtttttataatttctgcctcttcgtttttatggtctacactctgggaagttttttttcagatatagtcaccagttcactaacgttgcttaaatttatacatacacctggttttaaagtgaattgatacagtctctttttaaactcagtgatttcctatttgtaaaatttttctaacttctttttcaagtctgtcattttagtagcatcttactctttgcccacatttttattttttagcatttatgtatttatgtatttatttattcagccaataacaaccgagtgaggttgagtaacattttatatacnatccaagtgtcaatgatggggatgtgttctgacgaaaatgtaacactgggtggatttccncattgtgcaaacatcatnaagtggacctggnccaaacctagatgnggaaggtccactggcacngcta

SEQ ID NO: 234678 - DNA, 418 bp, Homo sapiens
gagcatactgagatttctttgcaaaaggagaaacagcaccagcaactaagcattttatcccattttattttacttcttctatgattctttgccacttagcaatgccaattaattgatttgggactggaaatacatttcttatacaatcttcaagttttctttcataagaacataactttcatctgatattgttccccacttctctcttttcaaatgtaatatttgggccagtccttgaaagtgaactgagttgagttctcatggcccataaaagaacatattcaaaatgtatcattttctttatgtcacagataaaagatcattaattgtatataaaatttccatataatttttaaaatttttattttgcaataatttattttagatttacattaaagttgcaaggaaggtacaaaga

SEQ ID NO: 234679 - DNA, 314 bp, Homo sapiens
ccacttgtagtacttaatttggggagaattctcttccagaagccttgttttctgcaattaatttctcacattattactaaaagaatcagccaatacaagatttgatccacattttgtccaattaaaaaattcttgtagcttatgattctgtagctcaagttcaaatcctacctacctcagacatttcacactatctccctgctggtgtcatcaatttcagtctatcttctcatgatttcctggatgaagtttttcagtgggaaatcctaagcctttgcctgaacctaaattggttccttcccatcccttaggta

SEQ ID NO: 234680 - DNA, 373 bp, Homo sapiens
cttgaagcaagtcagaggtgggagaaaaggacccttacagtattggacagcagaagcaaaacctgggagatgggaaggcatggggccgcgttcagggaactagagggcccagtcccgtgggcagggaggctccacaaggttacacacagggttggtaggggctgctgctgaattggcagggctcctttctcaagccctgctcacacatatcatagggtaaagaattttcttctaactcttgctgcaagggatactgtagtaacatatatgctagagcatcttgtagtatatacagtccagaacctgggctgctgaagatgctgtggttgttgtgtgtgcactctagcctgggcgacagagcgagactccatct

SEQ ID NO: 234681 - DNA, 555 bp, Homo sapiens
gtatttagctggggaataagatgtccatagggctttgaaaaacgctaacatattcctgagactgtagaaggtgcttagggtgtgcatatgtctagggttatgtgaacactcaagataggcctgagaaggccctgagctctaacctctgggtgaccttgaggcactacagaagcaagaagtgaaggctaaggcagaattatttggttggttggtgcaaaaaattgcggttttgtcatttcaacgaaattactttggtaccaacctaatgtaaagtgcttggctgattgttgaaggcttgtcccaacgtaagtactaaacccctcaggaaagactgggagattttttggttgaaggtgtttaagaaaacctgtctctctaatcattagttgaccactaagctaactgagcagaaacctgagtggtcacacacaataaacaatgcagactttaaagaattcattcataagctaggtgcggtggcacacgtgtagtcccagctactcggtaaactaaggccagaggatcccttgagtcaccaactcagaccctatctct

SEQ ID NO: 234682 - DNA, 440 bp, Homo sapiens
gcatagaccttgctggttcagtggcagtggctagatcatgagtgagcatctcttttagagcaagtctacacagagggagtggtttgtatgtcaataactctccagattgtgttgcaaacaccatcttcaactcagccatttttctcttggttttgaaaaaaccagagaataagcaagaggaggacaaagaaaatcacttagtgacactgtccaacaatcctgagagtgtttctggagaaaaaaagacaaaggttcctgatgaaagtggaattatacctccagattgccttggaagttgagctgcaacatcaacttttccctgaagctccagcctgctagcctaccagcacatgctgcagattttggacttgccagcccccacaattatgtgagcccattccttaaaaataaattcagttcaatctctctctctctctctc

SEQ ID NO: 234683 - DNA, 202 bp, Homo sapiens
gttttggcagatttttgacacctgtaaatattgtgcctatctgtccctcttttgggaatagtgtgttgtttgggtcttactattattcatttatctttttttaagaaaggcatttttggtgttttatcccagattttaaaatactacatttcactgaatccaggaaatcatcagttttaagacatatcatttgatgtgtcac

SEQ ID NO: 234684 - DNA, 541 bp, Homo sapiens
cttggtaccaagcctgctcattgttacattgtgttattgcttctaagccttcaacacacagaggccaaacctctagctctatctctacaaatgtatatgaagttatgggtttatactgatgcctctaacaccagttccacccatctaagattcctttgtattccctaattcatatttaaatctacttttttcctacagtgagaactctagcttccacattcttttatatgtcatttgcttaattctataatatgcacaatataatgtcataattgctattcccataccacttctccttcagtacagttttgttgttcatttgtaacatgagttaatttctgttttcattcagtttagggtctcctccaatcttggggatttcatttattgaatttatcattttatttccaaatattctattttcaggccaggcatggtggctcacacctgtaatcccagcgatttgggaggctgggtcaggaagatcacttgagctcaagattttgagaccagcctgggacacatagttcctgtttctgca

SEQ ID NO: 234685 - DNA, 430 bp, Homo sapiens
agggaagaggttggagcacctcagcagacacaggcaccagccaggatgctaaggacctttagccaagtctgccaactattctcctccatggggagaggaaacatccatttccagtggtagaaaggcagacccgaatgtaccagggagcttccaaatggagggtggtatgttgggttcttaggagctgtacccttcatgaacacccttctgagaagaggagcatgctgatcactgctgcaaaatatgcaaaacaaagggaaggggcaatgtcctgtgcaccctttattatcaggccacccccctccccagccccccaggtcagagtagacacagtgaaggactatgtggggactgttgttctagagacctggcagccaactcagggagggggctggtttccaccctcaagattaagacagcagcctaatta

SEQ ID NO: 234686 - DNA, 437 bp, Homo sapiens
atttttttcctatagatttcattttctgtctgatattttttttcacctgaagaacttttccttagcttttttttttaaacttttagtttccagaatacattattggttagatgttatatgggtaaattgcgtgttgagggggtttggtatacagattatttcgtcatccgggtaataagcatagtaccctataggtagttttaagatcctcacctttctcccaccctccaccctcaaaatacactctcagtgtatactctctaaagtacagtgtgtactcaaatgtgtactcaatgtgtacacaaagtacaccctcagcgtgttcttgaaacatcgagtatacattgtccatgtgtactcagtgtttacctcccatttacacgtgagaacatgtaatatttggttttctactccttcattagtttacttaggtaata

SEQ ID NO: 234687 - DNA, 368 bp, Homo sapiens
tttcctaaaaactcaaaggttttttttgtttgtttgttttgtttttttttttggtgtgtgttttgttttgttttctttttgggtggggtcggggagacagagtctcagtttgtcacactggctggtcttgaactcctggcctcaagcagttctcctgcctcagccttgcagagggttgagattacaggtgtgagccaccatccccagcctaaattagagatataattagaaattaccatctccctttttttttttcctgttaagcaggggacatttgtaacaatcattgctacctcgtctgcagtaaccataggttgtttttttgttttgttttattttgttttgagacagagtctcgctctgtcgcc

SEQ ID NO: 234688 - DNA, 483 bp, Homo sapiens
ctggggactcttgctgctttcgggataaggcccaaatcttcacactcctttgccggcctatgaagcgccttgtggtgttgccctcccacgcctctgcttttgtctcccacatgtatccacagccacactggtttgttgtctcacacctctgcttctcccagggtgctgaaattcctgcctggaatgccctcccccttgcctgacttcctaatccacccaccattcagtgtggctcaaatatcacctcctccaggaagatttggacttgtccaggctgggctaaaggtcgtccctcttttgtgttcctagcacgcttttatgtacattctggctgtctaatctatgcacttgttattacccgcttctaattgtgttagtttcaactcttagtctgaattcttactacttgaccttggccaagttacttaacctctcaatatactgatcaaaaaggggattaaaaacaatatcttcttcctaaat

SEQ ID NO: 234689 - DNA, 390 bp, Homo sapiens
ctaatttatataaaaattgcgtatgtcatacaatgaacaaaactaaacacatagaaactgaaaaaatgttcagaatcaatatggcaaatgctatctcttctcaaaacatcaggaatacacgaaaactgagaacactcaaatttcagctttaatgtagaaaggacagcttcctaaagaaagataaatggtaataaatacaaacaaatgtttaatctaactagaaaagtaatttttaagttaataagtctgaaagttacttttaagctggggcctgaaagataaattacatcaggcaaaaagcagggagcagtatttgagggcaaagatacacagagtaaaggccctgagatgggaagaaaattgctgcattcaaagaactgaaaggaggta

SEQ ID NO: 234690 - DNA, 303 bp, Homo sapiens
atttttcttccatcattctaggtttcctgtctggcccacacttcgagagtcctccctgctgcagggagcacatctgtgagccatgtgtttcctttctttcctcctgtacaatggtaatttttttcttagctactacaggaagcccagcagattcagatgtacaagaagccacaccaagacctaagatgatattcactgatgttatcagcaggttgatgccaacatctgcctagagagtggttaccctgagaagtttaccccagttctaagtttggttggtctgttctgaggtgatagcctcgt

SEQ ID NO: 234691 - DNA, 722 bp, Homo sapiens
ggcatttgtagaagtggtgtcctatagaaagtggaaagagaagacagcatctgatttctacattcattcaataactgtctagtgtcctgactatgatgtgggagaaataaagatgaatataactcccaccttgttcttgaagaccctataatctggtgggagaagcagaatataaaccagattcaaataaatattgtgataaaatatacaggctaagaatgcatgggaagaagtgattaacacactagttgtggagtacaaagggttttatggaggactggatattttaactgcaccttgaagattgagtacaattttgatagggaaggaaagagcatgtagctgaagaaaaaacacaaaagtacattgtatggcttggggaaataaagtagtctagagtggctctattaataaggtttgtaaagaggtgtagtggtatatgatgcaggaaaagtaggttagggcaaaaagaaaacagatcagtgcctgatatgaattatacactgggccaaaagtttttcatatttgctatttcatttaatttccatatagccatgcaaaataggtgttttgacatggggggaaaacagtctcagagagttttactaatttgttcaaagtctcacagataataagtaatggagctgaaatttcaaaccaggttgttacttaactccaaagctgaagctatttgtaatttggtaactatctctaaattaaaa

SEQ ID NO: 234692 - DNA, 367 bp, Homo sapiens
gcccgtggagcctcactgtaccttctgtctctgtgaatttgcctgttccagatgctgcgtagaagtggaatcactgagtatccttgtccgtctggcctgtttcccacagcctcgtgtttttatcatccacattgcagcgcttatccaaacttcattcattttcatggctggatactattccatcgtatgaatagaccacatttgtgtacccatttacttgtcgaagtttttaaaaatataaataatgggttgggcgcagtggctcacgtctgtcatcccagcactttgagaggccaaagtgggaggatggtttgagccttgggagtttgagaccagcctgggcaatatagcgagacctgttctctac

SEQ ID NO: 234693 - DNA, 630 bp, Homo sapiens
gtgtgtattttcttcacttatagcacatctcaattccatgcaacattcaagtgctcaatagtcacgtgtggctagtgattacagcattggaaaaagacagatacggttgaggaaacttaaaaaaatgtagcaaatgtagttgtagagacgtgctcaagatcactcaattatcatagctaggacgtgagtctccagcgaccttccaattgcctggttgaaccaaagccctggttcattctgctgcgcattaaaagcaggctttactcccctccaaacagtagaatcgcagttaaacttagtcaaacaaacttaatgtatccaatacaaaactcatctttctaaccctaacacctcctcttcctctctattttctatttcagttgatggtaccattatgtttctgctcactcaaattattattattttatccataaacgagcactttatctagaagatcatttaaattctaaatgatcttcaaaaacgcactttactctccaccctaactagctgaatcatctcccacatgggtcactatgagagccttctgatttgttcccttgcctcagtctctccccacccagcttcagcagtattccctaagactcttcatggctctccgtcctctac

SEQ ID NO: 234694 - DNA, 418 bp, Homo sapiens
aaaaaagaaaaaaaaaagaggatgaacagaactgctttggtttagggagacaatgacaggggtctaggcttgttaggggctgctgagtgctggtggttgtgggtagaagggaggtgctcagatatagaaggcaaaaggtgatcaagataaacctaacttaaggctgacttctcatggcatggagatctgagtagcagaatcaaaggcttttcccagtccaaataaggagttgggggtgtcctctcttcaccagtgggactttgctgaagatctaccagcgaacagccaccacacaagaaatgcacacagacccaaagtggaagtcgggctggtgaggtggggtgagaatgtgcctctaagctttttgtaagactttatgtttgattacacaataaaaagccctctgaataattaacag

SEQ ID NO: 234695 - DNA, 1095 bp, Homo sapiens
tttacaccttatctaaccatcgagacacgcccctgtggttcggtactcattatctcagtgtttgagcagggaaacgtcacttccctagaggacccacagccagtactcggcagagctggaaatcaaacccggtccatccaaagctaaagccatatgtctcttcactggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagcaagtctctctccttccctggtcctcagtttccccatctctattggggaagggttaggtatctattctagttgattaattgccagggcctgagctctgatggtccaggattctgtaagtctaacgttaggtcccacggcttgccctgctcagcacctaataaggccattagctctggctccttctctctggggtggcagcagggacagaaaacaacagagatacattctcttggcagcacagaactcagctcaagggttctggggatggggccttccctcctgccagggaggccatctcgagaggctgactgctcacacctgggcagcactctgtctcctcccctcctgcctgggtcccagctctgttcaccaccccaaagcacatcaccacaaggtcagttgcaaaggcccggtatcacaggcttaaatacagagggctaggagggaggtgggaggtgggagaggaaggtggagtactaacaaaggtgttgaattatcactgcccatcaggacacggttatttccccttactctgggacaccaaagattctacacaatcttcctataatcctgaaccacaaaagggaggcacagcctccaaaaaaaaaagtaggagaggggaggggggaagtacttttattttgaaatgtgttcatttttctttgttttattttctatcttgatgaaaagaatatatttttaaacctaaatacaaa

SEQ ID NO: 234696 - DNA, 452 bp, Homo sapiens
caaatgagagaattactaaaaatggactgttgtaatgttttgcgttatcaaaatgaaaactgccaaatgagattttgtttactttcttttcttgtgtgcttatgtcttttataaagttcttcatctaaaattatagagatagtgcatttgcacccaaattaatgaaacaataccattaaagagaaagaaaaggggctgggcacagtggcttacgcctgtaatcccagtgctttgggaggccaaggcagggggcagcctggccaatatggtgaaaccccatctctactaaaaatacaaaaattagctgggcgtggtggcatgtgcctgtagtcccggctgctcggaaggctgaggcaggagaatcgcttgaacccgggaggcggaggttgcagtgagctgagatcctgactgcactccagcctgcatgacagagtctcaaaaaatctgtctca

SEQ ID NO: 234697 - DNA, 338 bp, Homo sapiens
aagaaaagagaatactcagactacatatattctgggaaagttaaatactgtttatagtaaggatactgttcagtgaaaatacttgttttcagttgcatgtatagtatctcaggttatgattgaaaatatatttcatactatggattatattaaaaaatttgaagtggggtaagaaataaaaatgttctttattacagactcataattaaattttctgtcccttggatagaggttgattctagaccgtaaataatagtaaatcaataatatttaaactcatgattcagcagagtcaggtggtgtgctgtctttcatatttccttctcaatagtttgatg

SEQ ID NO: 234698 - DNA, 301 bp, Homo sapiens
tacaaactgaatccgcaagttctatttgtgtaataggcaatctatctacgacaagatttgatcgatggagtcgtatgatgcccttgccttgttttatattggctgtcagcgcttaactgggactgaagtatctgggtaacaaaaattgatataatgacttaatgcgccttattctctttgagctacatcagtttagagcacttctgagagaaaaatgtctggaaaatatcagggagtcatttatcaacctgttttcattagcatactgcctagctctggcaaggatttgaataaaaaaaag

SEQ ID NO: 234699 - DNA, 498 bp, Homo sapiens
gagaagggcattgggagaagggcattgctgggagaagggcattgctgggagaagaagggcattgctaggagaagggcattgctgggagaagaagggcattgtggggagaagggcattgcggggagaaaggcattgctgggagaagaagcgcactgtggggagaagggcattgctgggagaagggcattgctgggagaagggcattgcggggagaagggtattgctgggagaagaagggcattgcagagagaagggcattgtggggagaagggcattgcagggaaaagggcgttgctgggagaagggtgttgctggcagaagggtgttgctgggagaagggcattgctgggagaagggtgttgctgggagaatggcattgctgggagaggggacagccagcgagagggctggcgagtgggagggaagaggaagctgcggtagtaggtgtgtgcacactggcgaagctgagaggcttggaccttatcccaacagaaggat

SEQ ID NO: 234700 - DNA, 780 bp, Homo sapiens
ctcattaaataaattaattgtattaggtttatgaaagaataatggtagaaagggaaatatttagcagaagcatttttttgcttcattattttgaattattaagcacttgaaaatgagattatgataattaatgtaacatggatattctaattatacttttttttaaatcaggaaaatgagaacatatatgtatataaaataggctgtatgtggaaacattttatgttgaatattattgtccatctctaacaacaataactttgttcgaaactgtcttatgttgacttgacagaaatgaaagtcacatggtgtttggtgacctaaggtctagtttgaaatatttctgtgtctaattagttgtctacttgtattactatttatagaagagactagaggtaatatggtaatgagtaacatgaagcaaataaacaagtatctgctacttgaaaactagaaacaggatgtggtgcagatgtagaatttttttctaacagctttagtagtgattatacttgaagtcaatcttaccagttacatagcaggctcactatatctggaatatgtcactcttcacatacttttttctattttgaaagaagctgtttatcaaagcagcatactagttttacctgtaaaagctctacagaaacattactaggaaaataatgactacatgtatgtatagaatgagaatcacttgaacccctgaggcagagattgtagtgagccaagactgtgccactgtactccagcctggccacacagtgagactccatctca

SEQ ID NO: 234701 - DNA, 205 bp, Homo sapiens
gtattttactagagacaggatttcaccatgttgcccagagtggtctcgaactcctgagctcaggcgatccgcctgccttggcctcccacagtgctgggattataggcgtgagccaccacgcccagccaaattctatttttttaagaaacaactcaacccagaaatctacttttgtgtcccttctgtcgtcttctgtttcctttga

SEQ ID NO: 234702 - DNA, 283 bp, Homo sapiens
agcttttgggggaaggatttgaggcactgttgagcttgctcggccgaccctgttcccaaggatgccggggcatcattgttcaggacagagcaggggagcagcgtgctggaccctgcccacgtctctgcgttggggatagaggggaacctgctctccccagggctctgggcacagccacgcctgccagaggagagcttgaccaggcctaaggctggggtgccacttgcacctcagggtcttcagagcagctgctgaaagtggctccgacatctttactgacttt

SEQ ID NO: 234703 - DNA, 296 bp, Homo sapiens
ttttttatataacagagacctgtagaaaaaataaactaactttcatattaactcaacagttcattacaagaatcaagaaatcaaaggaaaaaaagtagtcaagagaacaagttaaaaacgaaacatttaaatgtacgctattgatttgactcataacattaatgatttatgattaatataattcaaagataaaagacaaaatgctgggtgcagtggtgtttgggtggctgaggtgaggggaatcacttgagcccagaagttagaaagcagccaacataacaagaccccattctcct

SEQ ID NO: 234704 - DNA, 474 bp, Homo sapiens
agttagccctccagagtttcccccaaagttttctccagtgaattacagtgccatatattctcattgctaccagcgctgctcccaaaatctatctgctgtttaatagtttttacctttcaaaaatgcaagctggctgggcgtggatttttgaaagcattcctcctgccttggcctctcaaagtgctgggattagagggtgccttctaatcccagcaatccagcacttggaaaggtcaaggcgggaggaatgcttgaagccaggagtgtgagaccagcctgggcaacatagtgagaccttgtctctacaaaaataaagtataaaaaaacagctaggtgtggtgatgtgtgcttgtagttgcgctactggggaggctgaagcaggaagacctcttgagcccagaaggttgaggctgcagtgagctaggatcgcaccacagcgctccagcctggtgacagagcaagaccctgtctcaa

SEQ ID NO: 234705 - DNA, 406 bp, Homo sapiens
gcatggatctgatgaaactgagaggaccctgcttcggcttcaggatctaaaccctcaagagttatttgtacaaaatgataagcagctaacctctgcaacacataaagcacttgtttaagaaaaggatcaaaactgccccaaacatacagacagaccgaaagaatcagcacacacggagaaaacagttcaaaccctgttggtcaccaaagcccaagttcctgtggcttcagcgtggctgccaggacgcagagcagttcttgcagagctgcggagacatgatgcagcccaggggcaaaaccacagctgtaatctactctggggaatcgccccaagaaacagccaggggcatcccttgctcaaggacattgtcaggtacaggttagctggaaagctgctgagacctcgg

SEQ ID NO: 234706 - DNA, 471 bp, Homo sapiens
ccagtaaccacattagtcccagagccaagcaagaaagcacgtggggtatttgggtacctgaaatgggccggtttggccaaattaagtgatgtaggtatgatccaggcctcaaagccacaataacggttttgtttttgtttttgatgaggtcccaactccagcctgggcaacagagcaagactctgtctcaaaaaaaaaaaaaaaaaaaaaaaaaaaaaaaaaaaaaataagaagcagaggaagattagaccggcacatacagaaaaggccacgtgaagacggaggcagagattggaatgatgcggccacagggccaggaaacaccagggcatggcagccaccacctgaagctgaagaggaaaggggcaggttttccccgacagtctccagagggagcgcggccttgccgtcatcgtgatcttggacatctggccttcagaaccatgagagattaaatttgtttgaagccac

SEQ ID NO: 234707 - DNA, 464 bp, Homo sapiens
tttaagaaaaacgtgattttaacatttatattatgtttataatctagatgggtatacttctttacactgctctagctgtgttcattgcaagataggaaattcttctgaaaacctttactgaactactgttgtcttagatcatttgtgtcatgatgaaattagcctcagagctatatttttgtgtattattcctccatttcccctgtagcatttgtactaagaaagatgttgaaaataagagttctggttctcatgttaatattatggccctgagacacagtgtcaaagtcatacaacgtccccaagctccatcctgtttccccaaacattaaatagggaagttaattcttaccttatcacacacggatgtttagagaatgaatgaaaaaaagtatttgaagcacgttgggggcaggtgtgtgtgtggaaaggctgcataaaaccaagatactgattttttcctg

SEQ ID NO: 234708 - DNA, 738 bp, Homo sapiens
ctgtctgttcacctaagtctaatgacactccacagcgtcagtccatcactgcttgaattaaataactttccctctatgcactcaaatacattcatgctccctgtgatttgtacaaaggcagggttaagaaataaacttttagcttggtgacataaatgcaagctaacattttctccctctttgaaggtggtaggaagtaaggagaaagtgagagaaaattgcttgacaagtaaataaatccccacctccttcataacttcctctctgtgctgtactcactctgaatgccaatttaattggtcagtttttctgcctcatctagacttacatacaagccgaaagtgatgctttttacatttttagctttttctaaataaaattatttctttacatttttgaggggctgggttgtgaatctcacctaagggagttcaaataaacatattttttcaaacccagtatattattaaaagttgtattagtgatccttgattaaactagaaggtaaaaacgataataaaaaggccctgcattatagcaaacacaatggttaatgtggcataaatcatggttatgagactctggcctaataatattcattttttttttcctccagccacattctcagcctcagctccttcatctccctctgacttcaaaggaatctctgcatgaagaaggagggcgcacaatagaagaattggcctcgttgacctcagcggtggagctcaaagaccg

SEQ ID NO: 234709 - DNA, 1237 bp, Homo sapiens
ctgtctgttcacctaagtctaatgacactccacagcgtcagtccatcactgcttgaattaaataactttccctctatgcactcaaatacattcatgctccctgtgatttgtacaaaggcagggttaagaaataaacttttagcttggtgacataaatgcaagctaacattttctccctctttgaaggtggtaggaagtaaggagaaagtgagagaaaattgcttgacaagtaaataaatccccacctccttcataacttcctctctgtgctgtactcactctgaatgccaatttaattggtcagtttttctgcctcatctagacttacatacaagccgaaagtgatgctttttacatttttagctttttctaaataaaattatttctttacatttttgaggggctgggttgtgaatctcacctaagggagttcaaataaacatattttttcaaacccagtatattattaaaagttgtattagtgatccttgattaaactagaaggtaaaaacgataataaaaaggccctgcattatagcaaacacaatggttaatgtggcataaatcatggttatgagactctggcctaataatattcattttttttttcctccagccacattctcagcctcagctccttcatctccctctgacttcaaaggaatctctgcatgaagaaggagggcgcacaatagaagaattggcccgattatccccttctgtttggaaatgggtgaagattacagatatgttttacttcttcctgtgctttggactatatgatgtcaactaccttaagcaaaaccctctaccctggctaatatatagatttggattataccaaaattgcctaaaattggaaacaagacattaataataatctgtaatggtgtaacataatagaatacatgtttattttcattggctttagctggtattaaaaaaaggtaaattagtttggagatgtaaattttatatttattatatcctgacctttttgctcatcctctaccactttatattatgaatgagataattaaaaagagtccacttattttttgttctgctatagcacatttttgcttccttaaatgtgtttgtgtgtatgtgaatgtgtgtgtgtgtgtgttgtgtgcatttattattttaaccaaagtgtgaaaatgaagttgtaatgctaaaggccaaaggaataaaacctggcctcgttgacctcagcggtggagctcaaagaccg

SEQ ID NO: 234710 - DNA, 812 bp, Homo sapiens
cgccccccgattggcttgtatagatacaacttctccgggatttccagggacccagccctgtgcataaccagaatcctgaagttgttgtgcctgaatggagtaaactaaatgtcagaagcaagtggttctgaggagtgcaaggggtggcctgcagtggctgctattggcatccttcttgttccccagcggctccacattctcagcctcagctccttcatctccctctgacttcaaaggaatctctgcatgaagaaggagggcgcacaatagaagaattggcccgattatccccttctgtttggaaatgggtgaagattacagatatgttttacttcttcctgtgctttggactatatgatgtcaactaccttaagcaaaaccctctaccctggctaatatatagatttggattataccaaaattgcctaaaattggaaacaagacattaataataatctgtaatggtgtaacataatagaatacatgtttattttcattggctttagctggtattaaaaaaaggtaaattagtttggagatgtaaattttatatttattatatcctgacctttttgctcatcctctaccactttatattatgaatgagataattaaaaagagtccacttattttttgttctgctatagcacatttttgcttccttaaatgtgtttgtgtgtatgtgaatgtgtgtgtgtgtgtgttgtgtgcatttattattttaaccaaagtgtgaaaatgaagttgtaatgctaaaggccaaaggaataaaacctggcctcgttgacctcagcggtggagctcaaagaccg

SEQ ID NO: 234711 - DNA, 396 bp, Homo sapiens
atgctggctaatacccacaggaacactgaactccactgtgtgggagcttgaggggcctgtgctgcccatgccgagtgtccaccatctcacactgcttctaacaccttcaagccatctcctgaatctggaatagtcatcatgagctggaggcttcctcagaagaaccctaaaatcaagggggattctggtgccaagaaaaatagcccaacccagcttcacagctgtgagcctccaatgcgccccaggaagctgccatcaccatgggtagcgcgacctggcttgattttgccaaaacaaaggaaaattcctccagcaatttctgtgaatttgttttgcaaaactgaattgtctgcttttaattcccctataccaattaaataaaaattggaatttaaa

SEQ ID NO: 234712 - DNA, 317 bp, Homo sapiens
aagaaaaccaaagataaatttctcatagttcttgctgcctactttagcaaaatctgagggagaatgttacacatttgttaacagatgaaaaataactcagattgtaaatttcccccatcacaccccttttttacatcttacaccatataccaagtttctgatccaaattgtagaggaaaagttatgttaaattgaactctattaaccaatgaatgtatttctgtaataagtatactgagaaagttttaaaaagaacaaaaggatctcattgcaatcagatgggcctgggcttcgctttgttttgcaattagtttata

SEQ ID NO: 234713 - DNA, 426 bp, Homo sapiens
gcagaatgaaatttctaatttgaagtgacattttcattaaatgtcatttcaaattccttgcctatatagtgggagaatgctataagaggatcataagtatttgtaatattatttgccataatttaataaattaatgaaattacaatgaattttagtgttactcatacttgtaaaattataaatattatacattgtatagaatagttactttagtaagtttcatcagggtactaataagcaggtggcaattgcttacacagggaattttataaattaaattgtaaaattacaacccttatcttagtaagttacttcacaagtgtactttattggaaaaaatatgatatggatgcttctctgtaatacatcgccatttctggaaaatgtaactcaaatttatacctagctaattgtaagtcatcattg

SEQ ID NO: 234714 - DNA, 570 bp, Homo sapiens
gacaaacaaatatgcacaaactgagagacattttacttattggagtttctcacgtagttgggtaagaaaagttatagctagataaggaggaacagtgttcaagtcaagaaagagttgctacatcttctgaaaaaaattctatgaattagaaagagaacattgttttaagataatttttaacattaaggtttaagaaattcatttaatctaaaagtagagaatttaaatgaaaatgagtttgagatattgttaaaatctctataaaaattacataaacatgggctgggtgcagtggcttacgcctgtaatcccagcactttgggaggccaaggcgggtggatcagctgacttcaggagttcaagaccagcctggccaacatagtgaaaccccatctctactaaaaatacaagagattagctgagtgtggtggtgggtgcctgtaatcccagctactcaagaggctgaggcaggagaatcacttgaacctgggaggcggaggttgcagtgagttatgatctcaccattgtactccagccagggcaacaagagcaaaactgtctccaacaaaa

SEQ ID NO: 234715 - DNA, 752 bp, Homo sapiens
tcatcttgctctgtggtctaaaaatggggcagcagtttggagcatgacagagtacagggctcattctctttttcgttcaacgagtaaaaataaatcttgaaatttgggcagaggagaggccgcggtgccaggagtcccagaaaccttcccttttcaagtagtgtctggagcaccgagccacgcccacacctactggccaagagaagtcaccagcgtgctcccagtgcctcccaaggtgccggcagctgcctggctgcggctggggaaatgcagactgcgcttgagggctcgcttgccgccgtcctggaggggctgttattaagccttgttctcaggtttcatattgcatagaaatgttaccttacagcttaggaattcggcgtttccctctaaaggtggcactgtcaagtcttcttaacataatcatcatttagtccattttcagtcatgcagtccacggggaagctttagaaacaaccgaggcacacgtgtttggactgcaggtaagaagagcaggcaggagggaaaacacaccctcaacgcagttaaagctctgcttctttaacacacaccgaactgtcccaaacccaggcacagccaagccagggcaggtcagagctccgcagaggtggaggccgaggtggctctgagcagctgcagcagctgggcgggaggggcctggggagaaggaagcctcagaatcgccttaaaagaggaaaccgtgatgtcactcccaaggctgcctacttggc

SEQ ID NO: 234716 - DNA, 338 bp, Homo sapiens
cctcagcctcccaagcagctgggactacaggtgcgtgccaccacgcctgcctaattttttgtatgtttagtagagacaagatttcactgtgttagccaggatggtctctatctcctggctcacacctgtaatgtcagcactttgagaggctaaggcaggagaactgcttgagcccgggagttcaagaccagcctgggtaacacagtgagaccctgtctctaaataaataaataaatgaataaataaatatgaatgacttgggaagaatagttgtagagtttatttaaacctctgaaagcaactcaacaaatttttaaattagatttttttaacaagat

SEQ ID NO: 234717 - DNA, 365 bp, Homo sapiens
caacatggagaaaccccatctctattaaaatgcaaaaagtagccaggcatggtgatggtgcacacctgtagtcccagccactctggaggctgagacaggagaatcacttgaacccagggaggcagagattgcagtgagggagatcgcgccactgcactccagcctgggcaacagagggagactccgtttcaaaaaataaaaaactatggtgactagaggcatctggcgttttatttttctccagtcccagttctataagtcaagcaagaagatgggcagtccctggaagagtattttgatgggacaggagtgggagagctcgtgggtttacattgctctcaactgtcacattgagcatgcttggc

SEQ ID NO: 234718 - DNA, 910 bp, Homo sapiens
gcgggagcgcggcccggggtcgctggggaggccgggtcaacggccactgacatcctcccggcgggctgccgagtcctcagttccgagaggaaacgagagggatgagggccttgagttgttccaccgactgcgagagggcagggagcgcacagtgtttgctccattactgcagatcgccctcgccctgttaaaagatgccctgcagagacagccgaagagcaagaaaggacttctgggcctgttctgcggctgaagttgtgccttcgctgcctttcatttatccagcatactacttgctaggtgttgagagcacatagtggaatgggacgctaaaattgcttgcagtctccgactgcttaaagctgggaaggtcgttaccactggttcaaacctattttacagatcaggcagctggggcttacagtgattagtgaggcgaccttcccacgatggcacagctcagtagtggaagagcggggactaggtcgaggttttgtggcttttagtcctgcatgtgtttggggtgactttctgctgacttatactgaactctgtagactgtaagctccaggtgagccaggagtatttctatctagaagactatatgactttactaccttacattctgtaaatgctcaataaaggtgctcaaaaaataaacacaaacaacacaacacaaaacacacacccacgcgggacaaccatgctgcaggatcgacaataaaaacagcgaatgcgcagcgaccaaacggggaccagacggtcgctacaagtccgctggatctacagtgcacgaccggacttttctcggagtacacaaagtggttacaacattggcgccggacccccacaccatagaggagagccgatcatagaagacaagacaaacacagagttaaccgcgctccag

SEQ ID NO: 234719 - DNA, 530 bp, Homo sapiens
tctattaaagcattagtggataacactgaaaccatgatatttaaggaaatattggctcctaaagacatccgtgtcaaatactgtacaatttgcatttgattcttacacacccaacattatttgaagtgaacaccataataagatcaggaatgctgatgaagtgtaaaacagtagctgtaaagtttacaagatgtctcagtaacatgaagcctctcaagtgatgtctatgcactaaaagaaagcaatctaagatatcagttcctcggaatatccttttcatggctgaaagtgaactctgctcatttcaggactgacccctaagcatactacagagatggcataatgctcttgaccccctagctggtccagtagtataatgtgataccacatcagacctcaacaggcataagaatagtatttcatgggagccagcctgcagaagaaaggacgctgttcatttctggaccctacctcttgctaactttgtaatgttggacaagttattaaactcatcaaatctgttaaaaaaa

SEQ ID NO: 234720 - DNA, 910 bp, Homo sapiens
tctgaagaatattatagaaaacttggaattcatccataatacaaatatgaagctaaactattaagagtagatggaatcaacaatgaaactagtattttgaaggcagagatcggacataagatatcctaaattcagcctacaaaagcggtactctagaaacatctcagataaggaaatacacagggcctttgtaattttttaaaataaaagtttaaaaggcttcattactactttggtactgtgagttgaatatccccgtttcaaaaatccaaaatgcagctgggtgctacttgagggactgaggcgggaggatcagttgagccatggaggtcacagctgtagtgagccctgatggcgccactgcactccagcctgggtgacagaacgagaccctgtctcaaaaaaaaaaagaaagaaaagaaaatctgaaatgcttcaaaatcccaaactttttgagtatcaatgtgacactcaaaggaactgctcactggggcacttcagattttcagatatgggatactcagctatgtaagtataatgcaaatattgcaaaatctgaaatctgaaacactgctggtaccaagcatttaagataagggatactcaaccagtaatagcattgctcgatggagaatctcgttttgaatcagagctctttattaattactctgtaaactagaataaatcacttaatttccattttttgtctagagagctttgagatatgtgataagtacaaaaggaatataaatctgaaaaacattataatgctttgtgtttgttggttaagctggattttagatgttcctgctaatggtatagtcccatgtgaataccacatcgataaatctaaatatacattaggtaaatatgttttttcttgtgggaaaaaatgggaatgtttccattc

SEQ ID NO: 234721 - DNA, 590 bp, Homo sapiens
gggttatctcttgaatgaacatacaggtatcccaatttctgtttttaagagcctgggtgacagaacgagaccctgtctcaaaaaaaaaaagaaagaaaagaaaatctgaaatgcttcaaaatcccaaactttttgagtatcaatgtgacactcaaaggaactgctcactggggcacttcagattttcagatatgggatactcagctatgtaagtataatgcaaatattgcaaaatctgaaatctgaaacactgctggtaccaagcatttaagataagggatactcaaccagtaatagcattgctcgatggagaatctcgttttgaatcagagctctttattaattactctgtaaactagaataaatcacttaatttccattttttgtctagagagctttgagatatgtgataagtacaaaaggaatataaatctgaaaaacattataatgctttgtgtttgttggttaagctggattttagatgttcctgctaatggtatagtcccatgtgaataccacatcgataaatctaaatatacattaggtaaatatgttttttcttgtgggaaaaaatgggaatgtttccattc

SEQ ID NO: 234722 - DNA, 973 bp, Homo sapiens
accaaaatgtaatttagtcaggagaataaagaagttacccctaattttcataatcatttaagaaaaaaataaaaggtctgtaacttaccctcccaggactacttttaactcatcatttttacatatattttatctcaagtatactgggaaaaactcttaggttttctttacagaatatttcccaacactcgctggaaatgactctagaacattcttctacactgtcaagacccaatcagaattacaaaccctaaaataaactaaaaagagggtgagtggtaaaattaaaataaaagcataaaaatgtgaaaaaaaagaaatcagtattagataaaatgaatttatggtatctctcattattggtaggaatttttggatccaccttctggctgtatgcaaacttcataagcaggtcttccatgggtggatccaagctattttctttcaatgttggaaagagtatgctctgacccagtcctgggaaaaatcccaagaaatttccttttgggtttatccgctaccccccaaccctgacacaatccactgctcagcagccttggtgtgtggttgctcagctatcatccatcgtgtaactgcagcactatttagtccctatttttctctctcatctacaaggacagtcaacgattcattcaagaatcatccactgaacacttacatgccaggccctgaaagtgctggaacaaatggcatttgaccctgacttccaggaaatccctctgaacccatccacaggccagcacacaattagtatagaaatgtgatgaatgcagcatgatgcgtcatcacgcagcccgatttcacctgtgccgccttttgctggaaattcaatataactgcatgcccattatttttctggatttagcaatctaattagcaggtaaaaaagcaaaagcctgcggccttttctttctttttttttttttttattctgagaaagggtctcactctg

SEQ ID NO: 234723 - DNA, 374 bp, Homo sapiens
aatgaatgtatacatttattgagtatttactatacagtaggcacctggggataccacatcaaatatattatagtccccatccacttggagctaacgcaagtgatgaaattatgcctttttgcccccttaacaattcagtccaaaagctcttatgtcgggccaagcaaagtaggcaacggtgaggaggaacggctacaggtggagagacacccgtacaggggctgggagccaccaaaagggcctgctcttcggagaaatgctgaattcagagcagggacaagaagtacaaaatgaacttgacatatctttttatagaaaaaggttaaaaagtatgcaaagaaaccaggttaaaggggctcccactggccaagtca

SEQ ID NO: 234724 - DNA, 575 bp, Homo sapiens
gtggtacatgcttatatttaagatcatggaaggcctgcaatagaaataactggagaagcccagggctcaattcttagaccgtctttttcctccttcctttgctaggtgatctcatccagccttgaggccctgcaaatcatcaataggcaggtgtatttcaaatttataactccagcctggacctctatcctgaaatacagcccccttctcaacatcttgataaaattggatatctaagaggcatgagactttcaaaaaactctggacttttcccacagacctggtacttccatggtttcacccatcttaatagatggcagccctgctcttttggtatctcaagccaaaaccttcagagccatcctttaggcttccatttcaaatgtaatatctaattaatcagcaaatcctacaccatcagaatatacccctctctccatgtccattactatttactttggattactgtagcaccttccaatttgtctccctgtgcccatgcttgtcctcacaaatagttcctcaatatggtagccctggtgtgctttttaaaatttaacccaatttattttctc

SEQ ID NO: 234725 - DNA, 355 bp, Homo sapiens
ggtccagactcctgtcaccagcatgagactttcaaaaaactctggacttttcccacagacctggtacttccatggtttcacccatcttaatagatggcagccctgctcttttggtatctcaagccaaaaccttcagagccatcctttaggcttccatttcaaatgtaatatctaattaatcagcaaatcctacaccatcagaatatacccctctctccatgtccattactatttactttggattactgtagcaccttccaatttgtctccctgtgcccatgcttgtcctcacaaatagttcctcaatatggtagccctggtgtgctttttaaaatttaacccaatttattttctc

SEQ ID NO: 234726 - DNA, 1249 bp, Homo sapiens
ccaagctcttcgcgcccgcctactgcctctcggtggcctgtacaggccagctctggcggtagaacagcctctgcaggtcccgctcttgcctcccaggggcctctccaggccaagctctcgcccccacggcggcctcccggcagcccgcgtgcggcccagttcctccctcacggtggcctgttgatgcccaactcatgccgctggcaccctgcgcagaggcgtgagtccctgcctcacactggctcctcccacgctgagagaggtcggcgtgagccctttgcctcacaccggcccctcccacactgaccccttggctcacaccggcccctcccacgcagagagaggtcagcgtgagccccttgcctcacaccggcccctctcacgccgagagaggtcagcgtgagccccttgcctcacaccggcccctcccacgccgagagaggtcagcgtgagcccttgcctcacaccggcccctcccacgccgagagaggtcagcgtgagccctgcctcaacaggccaccgtgagggaggagcagggccgtacgcaggctgccgggagcaggcagggacttggccgcgggaggcgtggtggggcgagagctgggcctggagacgcccctgggaggcaacagcggggcctgctgacgctcttctgctgccagagctgggactgtacaggccaccgggaggcaggatgtgggcctgaagagcttggctgcagaaacttcggggtctacaaaacgctggagggagctgagccaaaagagcttgcctgctgggaggcaggagctgggccgagagatgcagccaggaggaacagctgggcctgcagaggccgccatgagggaggcagaggccgggcctcctcaagtcggcctctccagacccacatgcagcctcccggcgtcctctccgggcccagctcttcctcccggctgcgtctccaggcccgactgctgcctcccaacaacctctttggactcagcgcctgcccatctcctggcggccttggtcggcccacagcttcctcaagccaagctccccaggcccaggtcaggcctcacggtggcctctccaggatcagctcctgccctccgatggcgtctccaggccccaaacggtctccggtcggtgggctcctccgcgcccagcttgggcctcctggcgacctctgcaggcccaagtcgtcctgaagtcggcgtctcccggccctgcctcccagcaagtaagcaagctctttgggctcaag

SEQ ID NO: 234727 - DNA, 949 bp, Homo sapiens
ggcaccctgcgcagaggcgtgagtccctgcctcacactggctcctcccacgctgagagaggtcggcgtgagccccttgcctcacaccggcccctcccacactgaccccttggctcacaccggcccctcccacgcagagagaggtcagcgtgagcccttgcctcacaccggcccctcccacgccgagagaggtcagcgtgagccctgcctcaacaggccaccgtgagggaggagcagggccgtacgcaggctgccgggagcaggcagggacttggccgcgggaggcgtggtggggcgagagctgggcctggagacgcccctgggaggcaacagcggggcctgctgacgctcttctgctgccagagctgggactgtacaggccaccgggaggcaggatgtgggcctgaagagcttggctgcagaaacttcggggtctacaaaacgctggagggagctgagccaaaagagcttgcctgctgggaggcaggagctgggccgagagatgcagccaggaggaacagctgggcctgcagaggccgccatgagggaggcagaggccgggcctcctcaagtcggcctctccagacccacatgcagcctcccggcgtcctctccgggcccagctcttcctcccggctgcgtctccaggcccgactgctgcctcccaacaacctctttggactcagcgcctgcccatctcctggcggccttggtcggcccacagcttcctcaagccaagctccccaggcccaggtcaggcctcacggtggcctctccaggatcagctcctgccctccgatggcgtctccaggccccaaacggtctccggtcggtgggctcctccgcgcccagcttgggcctcctggcgacctctgcaggcccaagtcgtcctgaagtcggcgtctcccggccctgcctcccagcaagtaagcaagctctttgggctcaag

SEQ ID NO: 234728 - DNA, 209 bp, Homo sapiens
aggcaaaagatttctcatctttattgggtgttctcaccccaacctgggttgtttctgctatggaacgagtccaagaaggtgaaggtttctgagccttcaggatgttgacaagggtttcctctatgttgtctctctgacatttagtgaagttgggattctggtaaaagctttcattatattcatagggttgctcccttgtgtgtgttctc

SEQ ID NO: 234729 - DNA, 670 bp, Homo sapiens
tgagactgagttgctcactttatatttatgttcagtgttcttcctgtaaataatactactttacatttaaaagtatgtaaattatggttttttgtttttgagacaaggtcttgctctgttgcccaggctggagtgcagtggcataatcatggctcactgcaacctccaccttctggactcaggcgattctctcacctcagcttcctagctgaggcttacaggcgctagctaccatgaccgactaatttttttttgtatttttggtagaggcggggtttcaccatattgcccagggtggtcttgaactcatggggtggtcttgaactcatgggctcaagtgttctgtctgcctcggcctcccaaagtgcttggattacagttgtgagccactgcggctggcctgtaaattatgtatcttttaagaaaagaaaaaatacccagaagatagctgtgaatggaataccctccacctggtggattccattcctcacttaaaactcttattactttctgtgggaaaaatgaccagatctgtttctaccccactcccattttcccaacctagttcatcatccctctctgctcccaaagtactgtgtaacttcctctattaaaacattttcaggttgcattatgttttggttccatatctgcccattagtctatctaa

SEQ ID NO: 234730 - DNA, 350 bp, Homo sapiens
gccaggtcataggagaggaggctaatattgtggacaaaagcaaggggctaatatttggagtctaggaaaaggaaaacaaagaaccagcttcagtccctaaaaagttattctttatggtaaaaggacttgtatctcctctgacagacattctggctcctggaatgggtgagagcagtaggccatggattttttgataaaggggatttggaacccgaagggagatcctcacctgcccagctgaagtgggcagtggctctccctgcctggaggatgcattgatgagataacttcctgagctttgatttcataatccgcagccccctgcatagactggacacaggaaggactgc

SEQ ID NO: 234731 - DNA, 470 bp, Homo sapiens
cgctttgttttttgaacagatcaattactcacagaaacagcaaccttgagttgatggtggttttttcattaaatcacctacatcttgacccttaaacaggcttctctatgtgtgatctaatatatatagtgtttatcagtcagcaggagaagatatggctgtgttcctggaataaattttggaagcaaaaaaaaaaacattctacaaattaagcatagtttattaaccggtgaataattgaaatgagtgaaactttttttcattttaagcctgactgataaatgtagacttaaattggtttatttttgagcacagtgttggacaagattcaaaactttaattatatccctgtaacatgaagacatttgagagtaatcagataattttctctagattttatgttctttacccaaagtggtttggaatgctatttgagagacatgaaaaatatgacaaagaccatcaaaaat

SEQ ID NO: 234732 - DNA, 572 bp, Homo sapiens
aggtgaggagattttcaaacataaaacaaattgcagtggacaagaaagagatggagataatggtacttggacaatgataaggaagcttactggaaattttgagagaaacattttagtacagtaaactgggtggatgctaaaccacatggaatcgtgtgtgaagtaggtggaaagaatatggaaataccaggtaaagctgattagaatgtggtaactgtatgtggaaggggcagagaggtagtcaggaatgctttccagaagtttctaaaacttcagggaagaatgagtggacataaaaagagaatgaaatccaatatgatcttactaggttggttgattttaaattttttttctcttatctgcatttttcatgttttctacagtaaagatgagtccttggttatgagacaaaaaatattgttttgacatgaatatgtcacacgtttaacataaatacaaattatagcatttggttcatgttttacaaagtaaaaaggtcttaccctatctcatgtaagtaaaacaattggctgttaatatgtttctgaatcaaataataactctgaagtatg

SEQ ID NO: 234733 - DNA, 295 bp, Homo sapiens
cagcaaccatgtcatttctatgaacatatggacccaaggctcagaaggaccgagtcataaagtgtgaatggcatagaggccttttagtgctttcatactcaatatggccttttagctcccctttttctccctcttttttcaacccaagacctagtggagtactagagctgcttgtattctggttgttaatctttcaggaattttgcaagctgattgttaattaagtacagtcagtattaaaaatgatatacatttacaattaaataaattatatttaaagcaaaggtcaaaagta

SEQ ID NO: 234734 - DNA, 404 bp, Homo sapiens
atccagtattattattatatgtctgctacatttcagatattgtcaaagattgagggattggtgggtcaaagaaatgaggtgattaagacccaatccctgttttatatgaagtcaagctctacaagttgcatgttcttggtaatctcttactgactaccaattgactttctaaatatttgctgagtactttctccgtgtcaggcactgctgttaacagtggaatacaaagtgaataagattcatgcagagtacttcctgtaataccagctactcgggtggctgaggcacgagaatcacttgaaccggggttgggggcgggggggcgcggaggttgcagtgagcggagattgtgccactaccctccagcctgggcaacagagagagactcactctctctcaaaaaa

SEQ ID NO: 234735 - DNA, 521 bp, Homo sapiens
caaggccctgccaacatgggcctcattcgcaccaaaaccgtgaagaaggcggcctggggcatcatagaaaagtactacatgtgcctgggcaacgacttccacacgaacaagcgcgtgtgtgaggagatcgccattatccccagcaagaagctctgcaacaagatagcaggctatgtcacacatctgatgaagcggattcagagaggcccaggaagaggtatctccatcaatctgcaggaggaggagagagaaaggagagacagttatgtttctgaggtctcagccttggatcaggagataattgaagtagatcctgacactaaggaaatgctgaagcttttggacttcggcagtctgtccaacccgcaggtcactcagcctacagttgggatgaattataaaatgcctcggggacctgtttgaattttttctgcaatgctgtattattttcaataaatctgggatgcgcgccagccctaccaatactataatcgatcaaaagaaaatgagatatacgagaa

SEQ ID NO: 234736 - DNA, 107 bp, Homo sapiens
ctaaaccaggtcctctttctgtgcccccagcccggttgacaatgtgtgccttcactcacccaattagaaaccttggaggtatcctgtactcttctgtcacttaccct

SEQ ID NO: 234737 - DNA, 413 bp, Homo sapiens
cagtgaagcctgctggggaggtttttgggaggagtcttgtatccttagtctgcttctaagcatttgaaactactgataaccaaatgaatctgataattttgactggcaaaattgagttaggttaattcataacagtcaaggcctgagaaaattatcttgggccactggagccagtactgattaacattaagtaggcagtaggctgctatggatgggcgcttcttaccagttgctagtatgaaagactattgatgtcattctttggcacaagcgacatgattctcacttgaatggatccagaagttttagagtttctgacttagtatccgtggtgttcccatgggctgacagtataaagtgccactccagtgggggctggctgttccctggatgatgacttaccttcattctgc

SEQ ID NO: 234738 - DNA, 356 bp, Homo sapiens
aagtatgcttttgtgataaattttaattgtataggctgaggctcaggacatttagcttgtgtatctccacttttatattttatagattttctttagagccaaatatgagatcaatttttacaaagattctgaggacaaaataaaatgatgtttatttttcattggtaagacactgaattctacgtatgtacgaaatcaagctcgttaattgtaatattgagattctctatgtcgtttatttttgttttactagatctccgaaattcagaagtaattaagcccaggagggcgagactgcagtgagctgtgattgagccgctgcactccagcctgggtgacagagcaagaccctgtct

SEQ ID NO: 234739 - DNA, 687 bp, Homo sapiens
attgaaaaaacatatatttcaaagtttttttttttaatttaaggaattgaaagagcagaaaatatatactaatcattcttcttaagccctgtgctctgtttcattttccaaaggcgtctactctcagtggtttgtttttgctctttttgtggttatggttataactaaatatggtaatcatttacctcgctttgttgctgcatttacctgctatgaagtatgaggaatttagtttacttgcacttctactttcaaaattattgtttatagcctcaatattagttctccttgaatgatgcatttgaactccctatttgtattgaaatagctactatcttctactctgaaagatgaataaattaatgcacttactttggacttctttccatctctgttcttgattgtcttttagttatataattgttttacactgtcaagaattataattcttatatttttgctgaaactatttttcatatctcaaattataagtattgagtatttgacttcaatttgtataatcaacttatgtacaaagcatggaaggattaatccactgtagaattcatggtgtcatgtgattgatgtcaaagaaaagagaaaatatgataccatgtcatttaaactttaccacttgaagaaaaatttcacaagtgcctgaatataataaattttattttaataaat

SEQ ID NO: 234740 - DNA, 834 bp, Homo sapiens
tgaggtctttgagtccattggtataattttttattcctatagcaataccatactgtttcagtcactaaaaacttagtaagttttgatatccccccttccaatttgttttgctgcaagagtgtcttggccattttttggccctttgctcttccatataaatttttaaatcacctggtcaagctgcatgaaaaactatgttctacttgggaaatggggtcctattaaatgtataaatcaatttggggagtattgataccttagagtaaaagtacttctatcagtgttgtttatctcttcatttgtttagatctcctttgatgtcctataataaagttttataatgtttttataaatatctcgcacatcttttggctagatttattcccatgtacttgctatgttgtcctcttctctccttttttgaaacttcagtgcagaaaaattgtcctagtcacacttaatttatggcataccatcatcactgttccacatactcatttgttttctttttatccccatatccttctttctacttcactctcatcccatagccaaccattatattgggtttacttaatgtgtgtcattttgtgttcttatagaatgtatattgtttctgcacatatatttttaatttgtgaaaatggtcttatatattgcattgtttctctttcacctagcactgccctttagatccatccaagtggttatgcgtacctctaatctgtgacttctaattaatgctctactaaggtgtgcatttaccatattttgtctatctattcactttctagaatacttccaactctctgccacaataaaaacactctaatg

SEQ ID NO: 234741 - DNA, 384 bp, Homo sapiens
ggcatttcttcttgtgtttgttttcaaatttgttgacaaagcttatcacatcctcttataatccttttaacctctgaagcatttatagtcatgtttctccttttcattcccataaatgcagtatttaattgcctggtgatttttaaattttttttgtagagtggggtcttgctctgttgtccaggctggtcttgaactcctggcctcaagcaatcctcctgccttgggcctcccaaagtgctgggattatagacatgagccactgtgcctggccctatcccttgtttgtttttctctctttctttttttcttttttttaatgatgattcttgccagagatttgtcagttttattagtcttttctttctgtctttttctatcttt

SEQ ID NO: 234742 - DNA, 388 bp, Homo sapiens
gcggccgcggcagcatcacacacttacacactcacagggggcggagcctggacagctagaagccgcgacatggagcagcaggaggaccaagcagaagcagaaggagccagcaagaggcagcactatgaacagaagtgcctgcgggaaggagagaagagacaagtggtgccggctgctgcttcaaaagaggggcaggggctttcccttcctgagatcaaaaccaagcaggaaggttgggttgggtggaaggagcccccacttcctagccactctcctcaaacagagatgaggttaagacaggcaacactgaaggggccaggctgtccctgaggcctctttggccgggcctggcacctgctcactgagcatcagctactgagcaagatag

SEQ ID NO: 234743 - DNA, 2187 bp, Homo sapiens
acttgagtggcagaaaatcaccagtgcaggcttcccaggccgccatgctgcaggagcagatggcagcagccggaggagctggtgagcagagttggggactcctgtttctatgctccccgtgaaatgcggggctttctcgtggatacgcgtgagcagaacatcttactatggcaaggacatgtccttcctggagctgcctaatttgtggccactttttgtctgattccctcgttgggtcctcacctgtgagacttgccaacacccccagccctccaccccacacacagcccacatgccggtctccaggggccgtgactggagattccgaatcctagcggtcacttccctctgagcacactcccagcagaaggcgtgtggctggggctagatgcacttgggtgctttgttcccctttctccatttgccagcccatggcattgctgccaccctgatggagcgccctctcatctggcaccttcctggcctctttcccaggccccagttctgtccatgcagctgtgggtgcttcctgcattgcgggtctcacggggaggagacgagagtgcccctggttgagtcaggaaagaattctatcttcacgtcgctgccagcaaatgaccacagcagcttcacgacctctgcaggaacctatcttggtaaagaaacggggcctatgtggtggccgagcctcaggtgtggccgagcttcaggtgtggcccttatgcacagcacagcccaagcctgtgggcaccactcgccctgggctgcctggcacctggactccttcccatccttggccgaggtctgcgtggcccttcagggccgaatctgacactgtcttcctcctgagtctgccccccgggcttcctgcccacccccaggctgtttcatggcctctgcagggagcttcgtagaggtgaggctggtgccatctgtctgcttcagaccacctcaggctctgcgtgccctcacagtcccctctgcacttctctgtggggcagggaagcccttcccatcaggtctgctccagcctggctaccttgttcctgctgtcccctccccttcaggcccccggacaagacttcagtgtacttgctggtgccgggcagaatgggggaccttgcctctcacacacacctgctagtatctccgcaacctccaggcatcatctcagctgacagtgacgccatcctggggaagctcccctgactcctggctctcctggaagcctgtggtgctccttcacaatggcccgtggcccttcataggtcccgtaagccagtgtcacagggattcggcttttctcttctgtgtttgcctgctgcgggactgtgagcagcttcagggccaagacagtgcctttccatccgtgaatctcctgatccatcagaatactcgaaagagaaataccgactgagtgtattcattaaagaattaatgttccttacaggatcattgttgttgaactgacctgacatgtgtatagtaatctcatgaacaagaaagaatgtgttcacacgtttgcttaaattgaatttagcaatcgcattaggatactgatatttccacaatgtatatacactatccttttaaatttaacttatttgctttttagacggaagctcctcagtcttagagagttctgaaggtggatttctcagccacgttcaacctgatgagttcactgcttcttccccaaacattgcagagctgcaggaaatttgggctgtgaacttacgtgtgatgtttactattatgcaaatgctcagacgacacacacgacctaccctgatggtttggaagttgtgcagtttcttaacaagcagacagatcagaccctctagttgcaggaaaaaaagctcagggcggtcgagtgcagtggctcgcgcctgtaatcccagcactttgggaggccaaggtgggcagatcacgaggtgaggagttcgagaccaacctggtaaacatagggaaaccctatctcttctaaaaaaaaaaaaatacaaaaaattagttgggcgtggtggatggcacctgtagtcttagctactcaggaggctgaggcaggagaatcgtttgaacctgggaggtggaggttgcagtgagccaagatcatgccattgcactccagcccgggttacagtgtgaggctttctaaaaacaaaaacaaaacaacaacaacaacaaaac

SEQ ID NO: 234744 - DNA, 443 bp, Homo sapiens
tttttcacctaccctccaagcaacaatcagcgaggctatcgaggtcaactggacttgccccaagaacacttcatggtcaatgtctgggtcaggaattgactttagccaactgtgccctctgttgtgaagccatcctagaaaccagtgcctcccatctgtgtgtgctttctagctctgaaaactaccaaaaagtccctgtatctactggaatatagctttgggaaaccaagaatgcctgcagcccctcgttcagcaggtacttcaatgcagaggaccaatgtgggcagaactgcactaccagcttgtgaatgaatgttcagatgggaagtgagcatcttttcccttatgttttgtgctaagaatactgtgatgttgaagcccagatactttaagatacatagacatttggaaaataaagaaaaggataaatgagaaaataaaaa

SEQ ID NO: 234745 - DNA, 1745 bp, Homo sapiens
  misc_feature (737)..(737): n is a, c, g, or t
tgtaaaatgtggacaataataataatgctaacagtaaaaactacctcataggattgatgtgaggattaaatgagctatgaaaacctcttagaaggtacctgttagctagtactcagctcagtgagtattaactgttttgttattaagacgtgtgtgtctctgccatttgtatttaacacgtgtccttgtgcctggcttacctccctgttatactgtaacctccgtaaggacaggcatagtgcccccttcttccttatctctttactgcttgtattagtccatcttgcgctgctacaaaggtacacctgaagctaggtaatttataaagacatgagatttaattggcttatggttctgcaggctgtgcaggaagcatattgctggcatctgcttctggtgaagacctcaggaagttgccttatggcagaaggcacaggggaagcaggcagtcacatggtgagagagaaggagcaatagagagaaacaggaggttctttcaaccaaccagatctcacgtgagctcattaccacggggagttcaccaagacaaggatgaaggatccgcccctatgacccaatacctcccactaggccccacctccaacactggggatcacatttcaacacaaggatttggaggggagaaacatccgaacagtatcactgcttttcggtgctgtatatacaatttgggccccatggttttggcatcctggatattccagtactgttcaganttcagagattcagctgtactttctaagctcagttattatgacctcagttcataattacttttgcaccaacataatatcagatcacgtatcccaatatggggttcagaaaaaaagtccctatcaataggtatcattggcagcctctagcagctttgctttctcttggcagagtgctctagcaatgcccaggagcccttctgcagaggctggacaactctcctggtgtttggcagccagctctgttctgcatgccttcggcacaatatgctttcacctgtccccaccctaaccccacccacagaatcctttccttggttttaataaacttccagctgtcttcgtccattttctgctgctataacagaataccacagattgggtcattgataaagaacagaaatgtaattctcacagttccagaggctggtaaatccaagatcaaggcacgggcaggttggtgtctggtgagcatctggtctcttctgccaagatgacacctagaatgctgcatcctctggagaagaagaacacgtgtcctcacatggcagaaggcaggagggcaaaaaggagccaaactccccacctctcaatactgttgcattggggattaagtctccaacacatgaatttgggggaaacattcagaccatagcatcaggcatggccaagttaagtaacttgccacctactgccaagcaacccaaactcaaaggtctgcgacctgcaagttcagataaggaaactgtctcaagcttccaagataataactggtgaagacagagtcagactgacccaagcaaaggggtgacagagctgcatgaacagaaattctctaaagatcagggatggaaaatgaaaaatcaaaatgaactataaaaacatgaacctgggttgggtacagtggcatgtgcctgtaatcccagcactttgggaggttgaggcaggaagactgcttgagcccagtagttcaagaccagccctggcaacagagtgagaccctgtccctac

SEQ ID NO: 234746 - DNA, 622 bp, Homo sapiens
cgaggttatatcatgttgtctagactgggagcacccttttttaatacccgaataatgattattgcacatatgtcccatgtatatttagccagtctccaggaggtgacttggagctttctataatcatgtagagtcattgatatcaagtcagaaaaattgctatggatttagaaacagaatagtcttatttacatattccctcgacttatcacaaaatagtttaaagttgtttctaacaattgtgcgtacaacacaatattataaacacatgagtagtgaaggggctgggatggtggtggcaggaggctcaaggaacagaatcccaaaggcttggtggcctggatctaatttgaactgctgctctgatctgtggtcttacaagtgatgtctttcatagcccattgccacggcaggccatgcaggctctttccacctcactctcagcggtcttatacttctgtggtcagctggtatttaagaactcaccttggcctccattctcacctgactgtgcactctctctggctatacatagagagatggactatataggtagagatatatattcttcacatctgtatctacttcctctgtctgtgtggatatagccatgcaattgtgt

SEQ ID NO: 234747 - DNA, 623 bp, Homo sapiens
cgaggttatatcatgttgtctagactgggagcacccttttttaatacccgaataatgattattgcacatatgtcccatgtatatttagccagtctccaggaggtgacttggagctttctataatcatgtagagtcattgatatcaagtcagattatcacaaaatagtttaaagttgtttctaacaattgtgcgtacaacacaatattataaacacatgagtagaaaaccaggagcagtgaaagtgaggcgccagtcctgcgacagagattaagcagatgaaggggctgggatggtggtggcaggaggctcaaggaacagaatcccaaaggcttggtggcctggatctaatttgaactgctgctctgatctgtggtcttacaagtgatgtctttcatagcccattgccacggcaggccatgcaggctctttccacctcactctcagcggtcttatacttctgtggtcagctggtatttaagaactcaccttggcctccattctcacctgactgtgcactctctctggctatacatagagagatggactatataggtagagatatatattcttcacatctgtatctacttcctctgtctgtgtggatatagccatgcaattgtgt

SEQ ID NO: 234748 - DNA, 1513 bp, Homo sapiens
aaggatatggaaaaactgaacaatgccatcagacttgctaattgacatttataaagtgttcctccctcaaatagcagaatatacattcctttaaaatcctcagggagcattcagaaaaatagatgacagccagagacataaaacaaacctaaaaatgattaaaagaattgaaataatcaaaagtagttatcttaccataatgagatttaactagaaatcaacaaaagaaagataattgataaatctctaaatactaggaaattaaacaacctacttctaagtgatctgtgaatcaaagtctcagagaaagcagaaaatattttgaagtgaacaaaattgaaaatgcaatatatcataattcatatgaagtagctaaatcagggcttagagggaaatatggaggattaaaccctcatattagaaaagaaaaaaagaactgcaatgagcaatctaagcttctacctaaagaaactagaaaaagaagagcaaaacaagtctaaagcaagcagaaagaaggaattttataaagataagagtagatatcaatgaatttgaaaacaatagtggagaaaaccaataaaattaaaaatctggttttttaagtatatcaagagctgataaacctctagccagattgacaaggaaatatgacataaattaccattgtaaggcatgaaagagggcatatcactatagtccccacaaaaatataataagcaaacaccatcaagagctctgtgcacataaattcaacaatatagatgaaatggaccaaatcctagaaagaagaggctgccaaaactcaccccaaaatatccctttatatctcaataaattcaatgtataattagatctttaccaaaaactcaaaaatcaaaacctaaaaaactacaggtttggatggtttcactggtagaattctctgccaaacatttgtggaagaaatgacatcaattctgtaagatctttttcaaaaaacaaaagaggaggcaacatttcccaactcgttttgtgaagccagcattatcctggttaccaaaccagacaaagttagtacagtaaaagaaaactgcagaccaatgtctcttaggaacatagatgcagaaatccttcacaaaatattagtacattgaattaggcaataataaaaataataacaagtcatgaccgagtggatttaggcttggaatataaggcagcatttgaaaatcagtcaatgtagggctgggcacagtggctcacagctgtaatcccagcactttgggaggccaaggcaggcagatcatgaagtcaagaaatcgagaacatcctggccaacatggtgaaaccttgtctctactaaaaaatacaaaaattagctgagcgtggtggcacatgcctgtagtcccagctacgcaggaggctgaggcaggagaattgttttaacccaggaggtggaggttgcagtgagccaagattgcgccactgcactccagcctgggcaacagagcgagactgcgtctcaaaaacaaac

SEQ ID NO: 234749 - DNA, 633 bp, Homo sapiens
gatccggcaacatctacctcattctctccaggcctctccacttgcccgagctctcagccaccaggagacagaaggaagggacttctgggctgcgttgggagcgggcactgtcccctatctactcctgctcggtttcccaaagtccagcgacatccgaccctcctggggggaaaaataccagtacccagacacctctgcaccctgttatatgactgggcttgcttcaggaatatcttacaaagaagaagaagaagaagaagaaagaacagcttggagtcatgtttacatctagttctactgaccggttcccatctggagagtttatttataactccctctataactctctgtttggaggcactggtggctctattgacagactgatgtctaggaaatattgctctatgtctaaccgtacctaaatgtgctgtggttgtatttacagatttatgtttgagggaaatataattatttccattgtatttgtgcatatacagtagttataggagcagatttatatatgggaaaatatacgactctcttacagccatccggctttatgtacatgtgatatcctgacagatttatatctctgaacagctatatagataaaaacgtatattgttagaatta

SEQ ID NO: 234750 - DNA, 588 bp, Homo sapiens
ttaaaccgtatcactcatcctgtcttagcttcaaacttctgcagcttcctcatctctcacccttcatagcattgaagagttaggtccctgctcaggcaggattagactttggcttaaggagatgttatggctggtttgatcttttctccagatcattaaactttcttcatatcagcaataagtctgttttgcctcattgctgtttgagtgttcactggagtgaacttctaatttatttcaagaactttactttgcaatcacagctttgactgtttggtgtaagaggcctagctttcagcctgtctgtagctttctacttggtttctttactaagcttaatcattttagatttgtaggaccttttctttcacttgaacacttagaggccattgtagggttactaagtggcctgattaacaccaaagatcacttgtcacagatcagcacaccagataaaataataatgaaaagtttgaaatactgcaaaaattatcaaagtgtgacacagagacagtatgggcttttggaaaaatgacaccagtagatttggttgatgcagtattgccacaaatcttcaatttcttaaaa

SEQ ID NO: 234751 - DNA, 1206 bp, Homo sapiens
cttgcaggaggttgacccgaaacagccctccgtcttcctgcccatgaggatgaggacaggaagccagacccgggagagaaagcccagatcagacagatgggggttgggagggcctagtggctgaaactgccctgcttggggacaatgctcaggcaggaccaatccaaacgagggcactgcttatgtggtccttccggagcatcctccaaggcagagcctggcttcgggccctccctgcaaggacacctgcctccactccctgccagaccaggcctggctgcagaggcggaggggcggcagggctgcctgtctccactgtttggcggtgtttacacgtgtcgctgtcagggtgtctggacagtgggggtcgggggcctcccgggcccagacttccccaggcctattctcacactggtgggagggccctaggggaagggtgtgggctgggtggcggggccaggccagctgagacctacaggaccgtggagcatttaggtctcccacccaactccacccggtcctctgagcatcagttacagagcccaggcagcaggagggcagggcccagccccttatcacccatcctcaaggcaggcaggaaccctgaaggcagcttccaccaggggttcccttagcccccaccctccaaaagccccagaccctgccaggcctcaccctgccagcatcgtggccccagctgacggctcccaagggcaggtgctggcaacacaagcaggagccctcggggcatcccgcagggcacacaccaggtcgccctgggctccccaagcacctcccagacccagcccttgggtgggtcctggcccacaaacccccacgccctgcccctgagatgagccccaccgcccacctgccctccagccctggagacctttctcccccttggccatggctcccatggggaggctgcaggccctccctgggctggaccagaggggacagactgtctctcccctgcgacttctgggggcactggagtccttggcctggttaccttcagcatttatagccctccagtgagttattcctcggagttctcacagagcagcatgcgcctgcggcaaagccctcacctccagcccctggaccacctgactgctgcctcccgcctggcgccaaacacggccaccgcctcttttgttaacaggacagttgatccattaaattaaaaatcattcaatagat

SEQ ID NO: 234752 - DNA, 846 bp, Homo sapiens
attatggaatgtatcctaatcatgggaagggcaccttgggagaagttgcagatggctgacgtgctttctctagcattcagctaaaaaatgggatggtccatgattctgcgttctctgtgttctgcaaaacaacattaagtagaaaacaaacagaagcagaggcacatttccttcttttgccacagaaacaatgccactgttgagtgcaagtcacactttgtctcatagataagaggtggccccaaagaagctgggatgaatgagtcactacctgtcttgtggctgtactgcacttcatgttcttaccttcggcttctccaggtctcgccctagtgagccaagaactttctctcacatgctgcctttatttaagcctggccttcaagaccttccatgatttatcaccaacctaccttttcagctttgtttcctagcacacctcattgatcagctgctcaggctgttgcatgaagaacatggactttgcacacagatcctgggttgagttctgagtcagctgtgtattagccatgtaaccttggccttggtatgcccttgctggacctacattttctcacgtaacagcatctatgtcatagaattcctgtgaaaattaaattggccaaggatgtcagggcttctcagatcttttccttcgttgccctaatgaccacaagagaacacatacactgaaggcctcctggggggcagttgcaatttcactgaagttgtatttttttatcttaaatgaaatctatgtgtattttccattctgttctttttttcatgtttattaatatagaaatgtgtttttgcaaaaggattaagaatacttaaaacaaggaa

SEQ ID NO: 234753 - DNA, 230 bp, Homo sapiens
gcaagtggtaaagtcaccaagcctaattggaatgaattgatttatcctctttggcagccctgatcagtaccctctcaagagactggactacatatgggaggtaatcatgatgatatacatatttctttggatgctgcttggctcatccagtccattttccatagatattatcacttaagacagctgctattctatcactggtcttggattttttatttaatcccgtactt

SEQ ID NO: 234754 - DNA, 465 bp, Homo sapiens
cttcctttgttcctttctgcctgtcttccttctctctgctagtatgttctaatttgttgctttttgttttgaatgaagctattataggtttttgtattgtgattatttacttatttattgagacgggatctcattctgtgacctagactgaagtacagtggcaagatcacagctcactgcagcttcgacctcctaggctcaatcaaccttccctcatcagcctcccaagtagctagctgggactacaggtgggcatgggcaccactgtacccagctgattggttttgtttgggtttttttttgtagagatgaggtctatgttgctcaaactggtctcaaactcccagactcaagcaatcttcccacctcagcctcccaaagtgctgggattataggcataagccccagcacccagccctaaaacaagttattttaaagagataacaacttaccttagaatacaaa

SEQ ID NO: 234755 - DNA, 268 bp, Homo sapiens
ctctctccctttttgcctcaagctgaatgtctatgcctccatccaatctcactcaatttcagaaacactaggtccggccttccctcccctcccttcctgtcctggcttcccctctgccccccatctccctatctgtcattctcactccctactcaccccctccagcaaacaactggaatcaagatgaggatcagagctgggcgtggtggcatgtgcctgtagtcttagctactctggttatcaaggcaggaggatcgcttgaactcag

SEQ ID NO: 234756 - DNA, 1722 bp, Homo sapiens
  misc_feature (92)..(92): n is a, c, g, or t
  misc_feature (226)..(226): n is a, c, g, or t
  misc_feature (306)..(306): n is a, c, g, or t
  misc_feature (356)..(356): n is a, c, g, or t
  misc_feature (412)..(412): n is a, c, g, or t
  misc_feature (536)..(536): n is a, c, g, or t
  misc_feature (629)..(629): n is a, c, g, or t
  misc_feature (640)..(640): n is a, c, g, or t
  misc_feature (653)..(653): n is a, c, g, or t
  misc_feature (711)..(711): n is a, c, g, or t
  misc_feature (713)..(713): n is a, c, g, or t
  misc_feature (769)..(769): n is a, c, g, or t
  misc_feature (881)..(881): n is a, c, g, or t
  misc_feature (915)..(915): n is a, c, g, or t
  misc_feature (917)..(917): n is a, c, g, or t
  misc_feature (969)..(969): n is a, c, g, or t
  misc_feature (985)..(985): n is a, c, g, or t
  misc_feature (1021)..(1021): n is a, c, g, or t
  misc_feature (1042)..(1042): n is a, c, g, or t
  misc_feature (1049)..(1049): n is a, c, g, or t
  misc_feature (1068)..(1068): n is a, c, g, or t
  misc_feature (1229)..(1229): n is a, c, g, or t
tttattaaatagggtatcctttcccattgcttgtttttgtcaggtttgtcaaagatcagatgcttttagatgtgtggtgtcatttctgaggnctctgttctgttccattggtctatagatctgatttgttaccagccccatgctgttttggttactgtagccttgtagaataatttgaagtcaggtactgtgatgcctctagctttgctgtttttgcttaggattntcttggctatgtgggctcttttttggttccatatgaaatttaaagtagtttttctaattctgtgaagaaagtaatggtancttgatggggacagcaatgagtctataaattactttgggtggtatagcantcaggcacagaaatgtccttgtgttaggcaataccattcaggacatagccatgggnagagtcttcatcactagaacaccaaaagcaatggctacaaaaaccaaaatttacaaatgggatctaactaaacttaagagtatctgcagcgcaaaagaaactattatcagagtgaacaggcaanccacagaatgggagaacattgttgcaatctatccatctgacaaagggctaatatgcagaatctacaaagaacaaatttacaagaaaaaaaaancatcaaaaagngagcaaagggtangaacagacacttaccaaagaagacatttatacagccaacgaacatgtgaagcaaagcncntcatcactggtcattagagaaatggaaatcaaaaccacaatgagatacaatctcanaccacttagaatggtcatcgttaaaaaatcaggaaagaacagatgctagagaggatgtggagaaataggaaagcttttacacagttggtgggaatataaattacttcaaccnttgtggaagacagtgtgacaattcctcaaggatntncaaccagaaatatcatttgacccagcaatcccattactgggtatataccccnaaaattataaatcatnctaatataaagacacatgcacctgtctgtttattgnggcactgttcacaacagcaangacttgnaaccaacccaaatgcccancaatgatagactggataaagaaaatgtggcatatatacaccacgaaatactatgcagccatagaattcacgtcatttgctgggacatgaatgaagctggaaaccatcattttcagctaactaacagaagaacagaaaaccaaacaccacatgttctcactnataactgggagttgaacaatgggaacacatggacacaggaaggggaacatcacacactagggcctgtcagggtggggggctaggagagggatggcattaggagaaataactaatgtagatcatgggttgatggatgcagcaagccaccatggcatgtgtatacctatgtaacctgcatgttctgcacatgtaccccagaacttaaagtacaattaaaaaaaaaaagaaatttgcttttaattaagcttttaatcatagaacttgtgaagaaaatccttttgaatcttttattaccacatcatagctgggacaaactgctgacgctttaaaagtaacacaaatatcaaacaggaagaactagacttaggaaccaaactcaggtttctgtagtgaacagggcacaatcttcacattgggtcaccaccactactccttcagtttagccttggctagcaaaagggtggccttgttatgtagatgagaccacttatgt

SEQ ID NO: 234757 - DNA, 514 bp, Homo sapiens
aagaaaggcataattcttcctcatgctaaatcttagtaaggtgcaatacccggttatgcaaaaacctccaggacaccaaagaaaggcacaattgactggtgaataagaatggggtaacacatcctttcacaagtcaggtggttttcagttgcttgctttcaacaagttgaaagagaacctaatcagagttgtcagctgacagatcattaaaagtattttttctttgttagatctttatgcgatttttgggcatataatgcgaaaggcattcaaagaattgtgtggcattactataacaaaactccattcattctcatctgctttttttatgcgaacaagttttctcaacacttatatccatggaattgaaaacttggaatagaactgatgctgaactatttctcaaaaaaatccatccactgaaggtcataatgtatattagaaaaaagtccacccaagttcatttctgcaagatgcattgccaataaaattttgcttttgtgtttagtactta

SEQ ID NO: 234758 - DNA, 509 bp, Homo sapiens
atatacgtgtattccatggtgaggtttaataaattttaacattttccaaatttggttgacttgaaatacatatccactcacacatccatgtccatctgaagcttgtatctccctgaacccaccccaaaataattactatatctaaagcatgttaccttcatttgtatttacactatgaccttatatttaccatttatagagagtacagcatattgttttgcagacttttaaatttgacgtaaagaatatcacataagttttgctttggcttttgtttgtacacaattttagatttattcatgttgtatcaaatggctctaatttaatcaactatcttgttatactgtgcaaatatgcaacttatttatcctttctcctatggtcatttagattgttgccaatctttcaactgtaaaaatttttttcttttttgagacaggatctccctgtgttgcccaggctggagtgcagtggcgagatcttggctcactgcaaccttcacttcctgg

SEQ ID NO: 234759 - DNA, 640 bp, Homo sapiens
tagatctgatactcattcatttattcaaccaactttggcagttgaatacctacaatgggccaactgcttgtcttgagtgtaaggaatataaatccaagtaagatatggttcttattcctaagatatttacagtctagtctagtaagtgtcagacggtctcactctgtcacccaggctagagtgtggtggcatgatcatggctcactgcagcctcaaactacttgggtcaagtgaccttcccaccctaaccttccaagcagctgagactacaagtcagtaccacaatgcccagctaatttttttttctttcctagagacaggatctcactattcttaccaggatacaggaattcacttttaatgttatacagcagcactaatagaaatagaacatgagcaacagatgcaagtcacgtaggtaactttaaaatttctaaccactttaaaaaaagtaaaaagaaacaaaattccaaaaatttattttactttacctatatatgtaaaatattataatatctcaacatgtaactaacaaaaaaatgagagttcttttttcttttttcttttttcttttttgagacagagtctccctctgtcacccaggctggagtccagtggcatgatcttggcttactgcaac

SEQ ID NO: 234760 - DNA, 694 bp, Homo sapiens
tagatctgatactcattcatttattcaaccaactttggcagttgaatacctacaatgggccaactgcttgtcttgagtgtaaggaatataaatccaagtaagatatggttcttattcctaagatatttacagtctagtctagtaagtgagatatctagacttccacaatgtgttctgtaaaaacaggagctcactattcttttcagacggtctcactctgtcacccaggctagagtgtggtggcatgatcatggctcactgcagcctcaaactacttgggtcaagtgaccttcccaccctaaccttccaagcagctgagactacaagtcagtaccacaatgcccagctaatttttttttctttcctagagacaggatctcactattcttaccaggatacaggaattcacttttaatgttatacagcagcactaatagaaatagaacatgagcaacagatgcaagtcacgtaggtaactttaaaatttctaaccactttaaaaaaagtaaaaagaaacaaaattccaaaaatttattttactttacctatatatgtaaaatattataatatctcaacatgtaactaacaaaaaaatgagagttcttttttcttttttcttttttcttttttgagacagagtctccctctgtcacccaggctggagtccagtggcatgatcttggcttactgcaac

SEQ ID NO: 234761 - DNA, 622 bp, Homo sapiens
gctggatggtaagtacataggagttctttatattctattatatacatttgtgaatgtttgaaatttcccataataaaatgttaaacaaaaatttaagaagcatatggaagaggaaaaaaatattctcctctaccctcacaggttctgtaactggagactgccaatgaaactgccaaaaggcagattaacaggagaaaagacatacagacttcatctgatgttaacagtttaatttttacatgcatggaggccttcatagaaaagaagtgaaggcctaaagaagtgattataacctgggacttatatatcattttaacaaagagtaataaattgtgaaaaggggtttgtcttctaagagctgttaattgtgagaaggaaaatatatgggggaaactaatggaggataagggttattttagtaaagtttgtgcagatccatttcagtgctttctatctccagtgatgttattctcctgctggtatggaaaaagggagggagaataccttcacaaagggaaatttatgccctattttaggaagataggaggacaaagaactctttttgtgtttgctgcttcttaattgccttcagctcaaaataaatccttatgccaaagtagca

SEQ ID NO: 234762 - DNA, 466 bp, Homo sapiens
ttacactgcataacctaatagtgcatttaagggcttggccaccacaaggtaaactgacaacaacgctgaccaaagtagcagcaaaagacattcaggagactaacccgggacccacgcagttgttggactcaacaaaccgctaagcaaagtggcaagcacgtagtgtttctggtgagtcactgcagttttgatattggtacctgttactttcatctgttctctgggcggattcctgcaaacccaagaaccatcagtttcctgattcgtgtgctggaccttgggcttaccgctgagccactacggagaggaacaagaaatgaagctcccggaaggagagaagctgcgggcggggcaatcacctcggaggtccaagaggcctcagcggcccaaagaaaggggaggtgtgtgcgggagaatctcaatggagatgaggagagcagcggtgactggtccttgcgcagagtgg

SEQ ID NO: 234763 - DNA, 336 bp, Homo sapiens
tcatcatggggcctccatgtagtactgtaggtgctgacctactggacaattccccaaggacacagaaagcaccttgagctgtgtctttcgtctccatattcccagcaccttgtacagcacctctcacatttaaagcacctaagtgtttaatgaccaactgactgaacaaataaatcaattcagaaatgaactatctctgtccactttgaatagaattgagtgacggaatgctaaggagagatgatgatggttaaggctccaaaaacaaacacgaaaaaaactgtcttaaaagtgcgtaatcaaaaggtgtttatttgaatgtgatttaaactaaaa

SEQ ID NO: 234764 - DNA, 438 bp, Homo sapiens
cacaagtagaaacatattcaccaacaggaagtcctggaacacagccagtgcaacagcagtgaagttattctttgctacaatactgctccactggactaaacaagtataaaaaatggatgacagcaggaggacacctggccagctgttgtatggtgagctgaactgaggagatctcaaatagggcaggctgaaggaacatgccacagacacattgaagaacaatttcaagtaatggaagcatggctgcagaagactgggaaataatatcaggaggaagactgacccaatgtggagcaattggagcagcaaaggtgtgcagccaggtgaagctgcagcatttcagcttgcaacagcttttgtaaagagcagtccctctcccaatcaaagagccccatccacctgtattatctgagtaaacatggcagatttcttaccata

SEQ ID NO: 234765 - DNA, 399 bp, Homo sapiens
tcaggtgttcttccagctccctgccctgtgtccacccattgtcctgtgggctggggatgcaaaaggacacaagatcatgaacatgtgggaaggacctgggactgggagctaaacaaactggactcaaattctggattcaccaattcctagcagtgtgatctctctgagcatctgtttcctcatctgtgaaatgagaagcaaaataccatccttcaggattgtcaatgaggcattgtatgtatatcactcagcacagcctgaaagtagtagcttaagcccctctacttgggagaacactggattaggtccacgtgactgacagctaggaacacagagtgagaaaaatcaagactgaggggtgagccaagggataacagaagagaccgaagcatcatgagg

SEQ ID NO: 234766 - DNA, 555 bp, Homo sapiens
caggtctgggagcttaccgcactggttggcagcagagcagaattggaaacagggcacgtctttctgggatgtaagtcctgatgtttccccattaagaaaaaaggccaggcatcccaacactttggaaggctgaggcggacagatcatgaggtcaggatattgagaccatcctggctaacaggtgaaacccggtctctactaaaaatacgaaaaattagctgggcatggtggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaaaaagtgtagaaaaacttgactttaacttcaaagtttaatttgaaagtttaaacaggccaggcgcggtggctcacacctgtaatcccagcactttgggaggctgaggcaggtggatcacaaggtcaggagatcgagaccatcctggctaacatggtgaaaccccgactctactaaaaataca

SEQ ID NO: 234767 - DNA, 2134 bp, Homo sapiens
  misc_feature (711)..(711): n is a, c, g, or t
  misc_feature (718)..(718): n is a, c, g, or t
  misc_feature (775)..(775): n is a, c, g, or t
  misc_feature (798)..(799): n is a, c, g, or t
  misc_feature (840)..(841): n is a, c, g, or t
  misc_feature (1077)..(1077): n is a, c, g, or t
  misc_feature (1086)..(1086): n is a, c, g, or t
  misc_feature (1089)..(1089): n is a, c, g, or t
  misc_feature (1222)..(1222): n is a, c, g, or t
atggctcggtgcagccttgaactcctggggctcggggaatccttccacctcagcctcccgagtagctgggactgcaggcgtgcactaccatgcctggctaatgacattgcttttatgaagcaaaacataggatgttgtcgggcatggtggctcacgcatgtgatcccagtgctttgggagcctggggcgggcagatcacctaaggtcaggagttcaagaccagcctgagcaacatggtgaaaccccgtctctactaaaaatacacaagttagccgggcgtcgtggtgtgcacctgtagtcccaactactcgggaggctgagacagaaaaatcgcttgaacccaggaggcggaggttgcagtaagccaagattgtaccgctacactccagtctgggtgacagagctagactccctctcaaaagaaaaaaaaaagatgctgtttatgtacattccaagaacaaaagaaacctggccattccaacaagtgatcccaacgatcagatgctgtcctccccaagtccagagtccttacacctaccttctcagggacctgccaagctttcagcctgggggctaaaattccaataaaattgtttcagtttacattattttaaaaaattatttatttgagacagggagtctctctgtcgccaggctggagtgaagtggcgcgatctcagctcactgcaaccgccgcctcccgggtagctnggattanaggcgtgtgccaccacggccaggtaatttttgtatttttggtagagatggggtttcnccatgttggccaggatggtctcnntctcttgaccttgtgatccacccaccttggcttggcctccnnagtgctgggattacaggtgtgagccaccgtggttacattaatggagagttcaggattggaaggaaactaatgtcaagggctagatgtactttaaagttctttgaagtgggtggcggtgcctccatgtcaaaggtaaggaaacacagccgggtgtagtggtgtgcacctgtggtcccagctactcaggagaccgaggtggaagaatcgtttgaggccaggagtttgagaccagcctnggcatcatngcnagatcccatctctacaaatttaaaaaaattagctggatggggcagtccctagctgcttgggagcctgaggtgggaggatcacttgagcccaggaggttgaggcagctgtgagccatgatcctgccaccacacnccagcctgggggacagagccagaccctatctcttaaaaaagaaaaaataaggaaacaagtcccaaagcggtaaagatgaacaccaagtaagagcagggccaggatttacccttctggtctggaagcacatgttttgtgtatgtgggaggggaggggggttttgctctgttggggatactaacccccctattcccacatccctcagagtgctggctatggccacttgtctgagaaccatccaacaacatggcaaaaatgcagaattcttgcacttcaaacagactctggggggtaggacctaagtatcaatgtgtttaaccagcttcccaggggcatttgagaggcaaatgctaaagcagatgaagttcctgccctcaagaggtttagattctagttagggaaacagacaataaaccaatgtaaggtaagtcaagttccaggaagaaaaagcaggataagaaaacatgccaagagtgttgttttagacttggtgccaaggcagtggttcccttttggacaccacggactggttttgtggaaggcaatttttctacggatagaggggtgcgggggtggggggaatggtttggggataattcaagcacattccacttattgtgtactttattatcgcattgtaatggataatgaaacaattctataactcaccatcatgtagaatcagtgggagccctgagcttgttttcctgcaactaggtggtcccatctggaggtgatgggagacagtgacagatcatcaggcattagattctcataaggaggccaggcacggtggctcatgactgtagtcctagcactttgggaggccaaggtgggcggatcacctgaggtcaggaattcgagaccagcctggccggcatggtggaaccctgtctctactaaaaatgcaac

SEQ ID NO: 234768 - DNA, 316 bp, Homo sapiens
tagggcaatattgagtagtaaaacatttatgtaactggagtcccagaaaaggaggagaaaagggagaaaaaaatatttgaagcaataataactgaaaattttccttaaattttatgaaaatgataaacctaaaggtccaagaagctacatgaagcccaagcgggaaaagcatgaagaaaaccatcccaaacacatcataatcacatttctggctgagtgcctataatcccagcattttgggaggctgagatgggaggatcacttgagccaggagtttcagactaccctgggaaacatagtgagaccttgtttctac

SEQ ID NO: 234769 - DNA, 551 bp, Homo sapiens
ggaaagtcatctgtactagattttcaagtgtctttaacgttaccaggtgaaaaagggggagaaaaatattccagacaaaggaaacagtatttgcagaggtaccaagatatgaaaaagcttggcatgttagaaaaactacaagcatttagtgttcttagagggtgaagcgtaagggaggataaatggatacttaagtacagtgtataacctcttgctgaggcctgaaaaatccagtcaaagttggcttgaagaacattaagaggaagggctagtggccagccatagtaagtcttttcttccctttctaccccatttgctttccaatgcagttgtacttatgagtcaagattgaatgttgtcccctaatgaaatgtaatgacaaacagtttgaacgtgttaatagagtatggataggcataatgcatttgagatcatgaggaaacatcagtaaagaatattcagtgtttttttttgttgttgttgttgttccaagtgttttctgacatattcaaaaagaaaaagagtaaaaattatttgaaaagcaagttgga

SEQ ID NO: 234770 - DNA, 327 bp, Homo sapiens
tggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaaaggttgtggtgagccaagatcgcaccaatgcactccagcctgtgggatagggcgagactacgtcca

SEQ ID NO: 234771 - DNA, 361 bp, Homo sapiens
ccccacccgtgccagctcagcttcctcttcctcatcctctcccagggaggtcacacggtgcctcctcctctccccggacagaagaacgtgtttttctgcacagccctggccgtggcgccagggtcccccccgcggagatcccactcgcgtaaatggggaacgtgccacaggtgcccgggaggcgctgctggagcaggcaagcacccccagatccgaacctcagtcagagcgcgcgagtccaacacaaaactcggcgtgcttcgggaaggaaaaagggccctgcaggaatcgtttatcccaacagataatacccatcccataaaaacaccaggccaggcctctcctggatcgtgggccaccc

SEQ ID NO: 234772 - DNA, 251 bp, Homo sapiens
agaagggtgggcaggtgggccagcccagaggaagtgtcactcatgccaccatctgcagaggaggaggagtttcctgggaagggaagagaatcaaaggggacaaaggagtgcacagccaggagcaggtgggggtcagcacctccagggacaggaggaggccaggggaccacatcccgggagaaggggaccagttctaggtcatgagagcctcaggagcctggtgaggagttggacctttatcctgtgtaggg

SEQ ID NO: 234773 - DNA, 466 bp, Homo sapiens
ggagtttggagtatgtgtaattttagagacatgtgacatgatcagatgtactcttaaagagggtctttggggcttcgcccatgactctctttggttcttcttccttacagtctgcaacagtgaaagactgtttcctacatgaagtctgtgagagagagaacaggtttgcatgttgccaagttatcaaagaaaatacatttccttcaaaaccaacttatcccctgaagctgctagtaagaaaaatatgagcaaaatataccacagaataaacttaagctgcattttaaaaagactattatcttgtatgaaaataattcataagttaaaatgttaaaaggccagggaccacacctgtaataccagcactttgggaggaaggggtgggcagatcacttgaggtcaggggtttgagaccagtctggctaacatggcaaaaccccatctccacaaaaaataaaaaaaaaat

SEQ ID NO: 234774 - DNA, 415 bp, Homo sapiens
catgggttgacctgcctgagccctgacattaattaaattgggtcagatgaacttcagatgagagacttccaggtaatcattatgataataattatgaataataagaatggtttgggctcttttcatgataaggaaaagactccctgggttacttcaaccctgaggtgacagtggaggtgagagccacgtgaatagtctccagagtattgagaggagccaggcataggctttctagctcgagtctggatcaagatgggccacgactgtcacagatgctgtgccaaggggtcccggatgcaggaagccatctgccctctgcgcaaacctctcctgcccccactgccaccttctgcccaagtcctcctctcctccgtggctctttcttacggctcccagatgccacttgtagctcttc

SEQ ID NO: 234775 - DNA, 370 bp, Homo sapiens
aagattctcctgctgatcctggacagagctcccttccctcagccctcaaccaacattgcgagcccctaggtcactgttccctgtggtttcctataacctgtccacaccttcattcctaatacctcctcaggtttcccagttgaagtgtatcctctaaagtggtgtgctggcaaaacagctctccaaaaagacaaaagccctgatgtcagctcctgatggttgaacacttggcttgcaaaggctctcacggtgccagtgtgagccagctgcagcacacctagggacaccgattcacacaggagtctacctttgctgcagctattttagatgataatgatggccattatctgtcagggccactgcccaaggc

SEQ ID NO: 234776 - DNA, 422 bp, Homo sapiens
ggaaagacttgctggccctggggccttctttgccttggcagcgacccagtgtggcagaatgcaatgttctggtttggggtctcaagctaagggctggtgaggaaggctgcggaagtataaatcttcaaagtgaatatgtcccaaaggggctggagagttgcaccaacctttagggtcttgatttccctcagtggttcctacatttcatgtaactgttttctataattttttttgcacttttaagagactttttatgtaaatgaatttataggttaatgaaaaatttttgtcataacatatatcccaacttttggttcagaaaatgtggccaccatgcccactgggaaatgttgggatctccatgaaagaggtggctggatgaaaaagctcatggcttgaaggtgggaaagaaaaaaaaagaa

SEQ ID NO: 234777 - DNA, 480 bp, Homo sapiens
aaatttgaacttctgagctataaatctgagaaattgcaaaaggaaaactttatctcaagaaatgaaattattattgtaaaaaaaaagggcagcattttaaatttgaaactaaaaaaattaaatacatctcagcaaaaaatgtggcaaaaataaaaactgtctgcagtttaaaaaatggctttaaaaaaacagattttaaaataaaaaatcaaaacctgttggcaaatttattaaaagcaggtcaatacttcaagaaaactttgtttgcagtatatacgaacaggccctggtactataacagtgcttccttgccaccaatgtttaatttttagaaaaacacataaataatttctttttagtctcagcttatcgaagcacacataaaacttcctttataaggcccatcctttacaaatcctctttgacttgtttagactgtttatattttcttaacctctaagtcattcatttaaaaaaaat

SEQ ID NO: 234778 - DNA, 354 bp, Homo sapiens
aataacttataaatatgtaaataaatggtatctgtttttatcagaaaaatccctgacgagaagacaggaaggagttctagggattactgtgcatgaacacagcaatattctcagatagcagaggattactgtaaaataatcaaatgctacagagaatgtgaaagcttcccaatcttgctcttcagagctaatgcacccaggaacaagagacaaatatatcatggacatcaatcaatgatgtcatctttctttgaaaggttgtgagttatttaaccaattcccaatttctaaaaattataaacaatgtaaccttatatgtaacttttgtattttttctagaataaattctgagaa

SEQ ID NO: 234779 - DNA, 434 bp, Homo sapiens
cactgctagagccagggggctcttcaccaggctccacgcagaaaccagggtgtactaaccagatggagcctggaaactccagctgggaacaggaggggctgggaggggctcacgtgagaaacactagatgttgacagagacttgccctgggcctggggtgaggatggatgaggggtgggtggccccacagttcccagcaaatgttacccgggactccctggggtcagcggaggccaggatcaggggtcagtcagagcccccagttgatagagactcgccctgggcctggggtgaggatggatgaggggtgggtggtcccacagttcccagcaaatggcacctggggctccctggagtcagcagaggccaggatcaggggtcagccagagcccccagctgagtcagattcagtcccaaggacgtttctccatggg

SEQ ID NO: 234780 - DNA, 220 bp, Homo sapiens
acacaggtttatctcatccacttctcggaatgaaaacaagtgtccggctgacccagggccaccaggatccacgtgcccccggagactgtgcccaccggctcttatgcgaagggtgacttcgggctggggctggtggataggtcagtcaacctcatcatcattggccacttgccaactttttaccagtcagctcatgccatgaccccttgcagctctcgta

SEQ ID NO: 234781 - DNA, 585 bp, Homo sapiens
gacaaggtcttgttctgcactccagtctgggcaatagaacgagatgatagatagatagatagatagatagatagatagatagatagatagataaaagaaaaatagccaactaaaagttctattcttcctatgcattttagataatttagccaaataaggaagccccttgtcccaggtaaatacttataccatcactatcatgatttttattcttcctatcaatagccaattagtaactcctcctatttatagctactttattgaggaattagtaaatgccagcactgatcttcgtgctttccatgcagcatctcatccatttgtcactgtaatactatgaggtatatactattattagttccaactttaacaaatgagaaaacagcttcagagaggttaagtaagctatccaaggtaatacaaccagtaaatgggcaaagccagaattcactaccaagtctttctgggtctacagccaggaagcttaaccatcaagctaggctagatttacacacaatgcctggctggtcatacatttgctaaaatatgtcacttatcaaaagcctgggcatcagcctgttgttc

SEQ ID NO: 234782 - DNA, 431 bp, Homo sapiens
atgctggactctgtgccaatgcaaacttcttggctctaagaaaaagagttcatagtgtccttttgctaggacctagaaaggaaaggcaagctgagagagacgacattgcagggagagcttggaacactatagatcttgatactagacctaaattaaagtcaaagcatagcagaaagctacgcagtgagattttcagtgaaattgaattactgtgaacacccaacgaagtcacgatgtcttgctccttagaaatttctgttcttaaagttgaaagtcttttaacatttactattttattgatgcgtctgcacaaggcctttcttttctgttctatacatgcagacatacactacatgcaatttgatcgcagctctaggcaaagattaaattgggccgaggaataatgaaacctcatacttcctggtgtcata

SEQ ID NO: 234783 - DNA, 908 bp, Homo sapiens
ccttggagaatccggaccaatacagtgcacctagaagaagagaaaacagaagtctcactctgtccccgcgtgtgcaaaaagacgaggccgtgctgagagcagctagaagttggccgtctacgagccaggaagaactctcactgggagcctgattgtaccgcaccttgatcttggacgcccagtccccagaatgtgagcacacacacatttctgctgtcatagccgcagccgtggtattctgtgatggcggcagagctgactaatgcaccccctgccagcgacatcaggaatccctggaggacgaggaccatcgcatttcctaaagctctcgtgatttgatatgcatgaaggtctgacccttgtcctgggagaaatagctgcttcctcctggcacctgggagcgtcccagctccttgcctctttggagacccctttgagcgtgggctctgccgtgaccttggaggtcgggaacaggcaacacatccctcagtgcccacctcttgccagccggtccctactatttggggtctgggcaaggagcaccagcggaagcccacatgacgtgtttcctatttgaaagttaggtacacacccagctagcacattagatcatagtttcttctgctttcacagacatcccttcatgatggcaaaatgtaaatcatgtgggaattgactatttcatgagattgaaagctggtgatacaccagacacggctgagtttaattgttctgttacacacttaggcatctcattgatgcatagtgacatttggataagtgattgttccccgctagcggggaaacaatcacttgaacaatcacttgaacaatcacttgaacaatcagattgaacaatcacattgaacaatcacattgaacaatcacattgaacaatcatgaacgta

SEQ ID NO: 234784 - DNA, 1132 bp, Homo sapiens
ccttggagaatccggaccaatacagtgcacctagaagaagagaaaacagaagtctcactctgtccccgcgtgtgcaaaaagacgaggccgtgctgagagcagctagaagttggccgtctacgagccaggaagaactctcactgggagcctgattgtaccgcaccttgatcttggacgcccagtccccagaatgtgagcacacacacatttctgctgtcatagccgcagccgtggtattctgtgatggcggcagagctgactaatgcaccccctgccagcgacatcaggaatccctggaggacgaggaccatcgcatttcctaaagctctcgtgatttgatatgcatgaaggtctgacccttgtcctgggagaaatagctgcttcctcctggcacctgggagcgtcccagctccttgcctctttggagacccctttgagcgtgggctctgccgtgaccttggaggtcgggaacaggcaacacatccctcagtgcccacctcttgccagccggtccctactatttggggtctgggcaaggagcaccagcggaagcccacatgacgtgtttcctatttgaaagttaggtacacacccagctagcacattagatcatagtttcttctgctttcacagacatcccttcatgatggcaaaatgtaaatcatgtgggaattgactatttcatgagattgaaagctggtgatacaccagacacggctgagtttaattgttctgttacacacttaggcatctcattgatgcatagtgacatttggataagtgataaatataaatgtcattcattattatatatgccagaaaatatatttgtcctgctagtctgttcagcaaaattaccactacgttgttctagtctagcattttgcacaatctgtgttccattgagagtaatattctaaatgattagaaatttaatatattcaatgtatacaaaatttggatgtctatgaaaatggactaatacagaaaaaaaatttggatgtattttgataaaagtattaattgaaataaatttagcattaaacatttttcatgattccaaaaatgatatctgctaaaatattccaaattaactgctcaaaggcaaaatacaagttaaaattaatgaata

SEQ ID NO: 234785 - DNA, 591 bp, Homo sapiens
atcttaataatattttttctcaggggcggttcgaagatggccgaataggaacagctccagtctgcagctcccagcttgagcgacacagaagacgggtgattcctgcatttccaactgaggactgccgaagctgagagtaactacccctggtttcatttccaactcatgaatttttcgccatccttctctgcccgcctttcctttactacacagtgagccgcactcctggaacaagcttcccttgaagttcaccctctgagcgccacggcccctctccagcctgcattccacttgttcctgtttggcaaaaccagcaacatctgggcccacactacaaaaggacccagaaaatatagtttatagcttcctagcccctttgatacagaaaagcatgcaagaaaggtggaccagtcatctgcatctgtcacaaaattgctctaagaaccagcttgtcagccatagaagaaaactgtatctcattattttatgttcacattttgctttttgagagaaagcactgtgagtagatttgatcagatactttatttgtgttgttggttctgaaaatctttttaatccccaaaaaataaa

SEQ ID NO: 234786 - DNA, 795 bp, Homo sapiens
gatcccgcacccagcttgaattcagcaagaatcggaaaacaggtgtgcccccgtgggcggttcgaagatggccgaataggaacagctccagtctgcagctcccagcttgagcgacacagaagacgggtgattcctgcatttccaactgaggactgccgaagctgagagtaactacccctggtttcatttccaactcatgaatttttcgccatccttctctgcccgcctttcctttactacacagtgagccgcactcctggaacaagcttcccttgaagttcaccctctgagcgccacggcccctctccagcctgcattccactgtaaggttgagaaatatctgattgttagtgatgagagagaaaacctagcctcattctctggtggcctgtcttgcaaaagagagatgaaatcaaacctggcttcctgagattccaaatcacaaacatcacatactagtttttttttttaataaaatcatggggccagatgtggtagctcacacctgtaataccagcactttgggaggctgaggcagaacaatcacttgaggccaggagttcaagaccagcctggaaaacaaagggaaacgcacttctacaaaaaatttaaaaattagtcacatgtggtagcatgaacttgtagttccagctacttgggaggctggggcaggaggatcgcttgagcccaggagctggaggctacaatgagccaggattgcactactgcactccagcctgggtgacagagggagaccttgtctaaataaatatcatagaaaggtggggaactcac

SEQ ID NO: 234787 - DNA, 102 bp, Homo sapiens
gggcaaagaattatggaatctttacctcttcgttgtattttacctttcacttacaaacaagctcatgccactgttctaaaaatccacacactggatgatata

SEQ ID NO: 234788 - DNA, 358 bp, Homo sapiens
aagtttaaccttaattactttttaaaggcagttttcattttgtgattacttttttttttcttccggtgcctagcatagttgaggattttatcttcttgtctattttaggatactctaatgaataacggaattttgacgtgctctttcaaaggaagagtctagttgcatcctcccagccatcggctggttgagctgtcctacccacttcgtttcagctcatggaggccaccgtgaggggctggggcatgtcagtggcccacagctattctgaatggtagttatatctatgtgggggctcagaagggaaccgactttccattcattaatgttcagtacccacgaaagaaaccgatattta

SEQ ID NO: 234789 - DNA, 900 bp, Homo sapiens
agctttcaatcaaaatccctggagcgctgtttgcaggaaaggtataatccagtggcagactaaaccaaattaaaatggcagtctagccccacccagctcaatcgctaattagattaaggggagcttctctctatctacctggtaaaggtaggaaaggtcaaatactctggggagagcattatttgcaagatctttatgagtgaattttacataatgtacaaaacatatggcatacaataaaagctgtatgacatgaaaatgcaggaaaatttgagaaagaaaagaatggacaataacagaagcagaccaacagatgatccagacattagaactgccacacagaagactttaaagtaactattataaatatattaaggaaatagacaaaatggagaatttcaacagatttggggtctataatatcaaaggaacatactataactgaaggatatatttgaaattaagaacttacgtaggcttaacagactgaatacagcacaaaaacaggatcagtaaactcaaaagtagatcaacagaaaatatctaaattgaaaaagagaaaaagaaaaaaaaggaaatgaaaacaacagaactgtaagagacgttctgattttagcccaagtacaacagaagatttaaagcaagatatcctaaactgctgttttactattatctcacctctctccatagtccatgtgtgggtattgtctatctcaggcactttggatagtgatacatttacttatattgccagtgaggaccacacaggcctggaaggactctactacaagacaggaaggggaaggagtaaacagtatggtttttcccagaatgtagtcacataagaatgtcctgggtatgacattttgggctggatggtaaatactttaaaaaaaaaaa

SEQ ID NO: 234790 - DNA, 308 bp, Homo sapiens
agaatcacttgaacctgggaggcggaggttgcggtgagctaagattgtgccatggtactccagcctgggcaacaagagcagaactccatctcaaaaaaaaaaaaaatatggacactaaaggccattacaatgaggtttcagatggaactgagaaacaaggtattggaaacatgtgtaaaggcccttcttgttataaactgacaacttggctgcattgtgtccatgtctaaggatattatggaatgtagaacttaatacacctactgtatatccacaaaaattaaaaattttaaaaattaaaatgaaaa

SEQ ID NO: 234791 - DNA, 556 bp, Homo sapiens
ctcagcaggtacaacctatccaacagcatgcaatggccctggcccctgaaagaggggaactctgctctgctcaggaccaagtttgtcacccaggggtatggacccagtgttgctgcagcttctggtttttggttttgtttttcaaaagaaactgaacatttgatttcatgtgtgtaaaatatcccaattttgagtgctgggattacaggcatgagccaccgtgcccagccacagtcagctcttctcaagaagggcctggaatcggtattcctcaaagctccttggagatttggatacccagccaggtgcagcagccagtgctcaatctgattctcggaaagacccttgccccagctcatggttttggtgtaattatcagtctctccatactgcattcctctgaccagtcttgctcactcctggactagttgtaaatccctggctcagaaatgccgttgctatggaaagggttttatgctgtgattctctttgggtttgctattcttatgccaattgtttttgttgtcattgttattgtcgctgttgttgtggcaaa

SEQ ID NO: 234792 - DNA, 367 bp, Homo sapiens
tagtgcttatccctcaaaatgtgattcatacttaaagtaggtcaggaatgatgtgggtcatagcagttagacagtaaatccataataggttatttttaaaaataggggtgcgtgtgtgtatgcatgtgcatgtgtgtgcatctgtggtggaataatgtgcgaggatggctattcatatccacagcattttgaagatggtgacgtagaagatacctctgcattttcattgtggccttttgtgttggtaccattcagatcattgagcctttcaagttcattactatattaatataaaacattcatctataaagttgtgtttttaaagattcttgtggttgtctaagcattttattcaaactaaaactgt

SEQ ID NO: 234793 - DNA, 532 bp, Homo sapiens
aagatgacctggacatggactccagtgaaggcagcagccccaatgcatctccacatgacagggaggaagcttgttccccacaacaggaacctcagggctgcaggtgcccgctggaccgcttccaagactttgccctgattgatgccccaacgttggaggatgagccccaagaggggcagcagtgggaaatagccctgcccaacaactggcagcggtacccaaggacaaaggtggaggagaaggaggcttcggacacaggtggggaggaacctgagaaggaagaggaagacctgtactatgggctgccagatggagccggggacctcctcccggacaaggagctgggttttgagcctgacacccaaggctgagatgtttgtgctccgtagcttctagtctggaactgctgctgacccctgtgtgacatcacagggcctcagtttccctatctgcaaaatgggatgatatggaggttcaatgagatggtggcattttgagaatggtaaagaaatacacaagaaagggatgatga

SEQ ID NO: 234794 - DNA, 484 bp, Homo sapiens
acaattactgtgcagtgttctgagtcctgttagggaatgatgtaagagtacactgacagcaaagatgtttgaagtggggggaaattccatataagagatgatacttcaaaagcagtttgtagtgcacagcagagtcaggaaagacattggaataatatatgtagaagcacagactgaaagaacaaggtatgttagaggaagtctagtggtttgctgagtctacagggatggttagtagggagtgatgaaagataagaccgaattataaatggcatggtgtggtcaagcaaaatgaggagcttaagtatttgctttgcagtttggaaactacaagaataatttcagcattattggagtaaaaaagccagattgcttgcaattgcaagcagttctctctagaagtatagtagtaaggtagcttgagggaggagtctgaggaaaggatttttttttttttttagaatagagaaacttgagtattgga

SEQ ID NO: 234795 - DNA, 506 bp, Homo sapiens
gtgaagactgtgattgatgatctcatccagaagttatttgatctgcttgttctttctttgaagaagtccatacaggctcatttacatgaaattgatacatttgttactgaggctatggaagtcttaacaattatgccccagtctgtggaagaaattggtgatgcaaatctacaatatagtaagttacaagaacggaagccagagattttgcccttatttcaagaagctgaagacaaaaacagacttttacgaactgtggctggtggaggtttagaaacaattagtaatttgaaagccaagtgggataaatttgagttaatgatggaaagtcaccaacttatgattaaagaccagattgaagtgatgaaaggaaatgtgaaatcacgtcttcagatctattatcaagaactggaaaaatttaaagctcgttgggaccaactaaagcctggtgatgatgttattgaaactggccaacataatactcttgataaaagtgcaaagttaat

SEQ ID NO: 234796 - DNA, 552 bp, Homo sapiens
ttttttacacagaactatatatatttttaaattagtaatccacataagttatacacaaaattaagtgactagattgttcagtaaaactctacattgctttcttattatggactaatgagcttataattcactgtcacttttaagaaattctagtctatagacatgttcgaattgtttggtcttattagtttcagtagcaaaaaccaccacttcttttatatttaattcttttgaatatcatctttaaagagcctgacttgaattttgtcaaaataaatcacaccttaaccctccagtctctagtctgtgtgttcttcatgagcttcagttcagtgtaagctagcacacggacctccccatgaattttctacaactttaacactttccacaaagtgtcatgtccttctctaggcttttggtagaatgtgaagttaataatggcatgtgatgttccttagcataatctatcaaaaagtaatgatctccttgtaaaaaaagccatgggctgcaatcacacatctgagttgacagacatccacatcaactcttcat

SEQ ID NO: 234797 - DNA, 518 bp, Homo sapiens
gcatgtgggcacccaggagaagggatggaaagaaacccaggctgcacaacagcgggggtgcaggcatgacccggagctggggacggctggggctggggaggcagggaggccgggcctgtcagaggacttatccttgcctaccaggcaggggaggtcaggaacaagagggagctcgtgcaggggcgtgcacagcaggcatggttttgcatgcacctggatctgtgggtacacaggccagcatatgccatggtggctttgctgattgataccttctgtcttcctcatccatctgtcctctgcctcacgtggctgtggtcatcctcccttcaggcacttagccacttctgctgggaaaagatctataagaagtctccagggatggctggctggctggcaatcgttgccttcttttctctatggttttaggacagagtgaagttttttcctaaaactcccctttctctaagcctgggtccggggtcaggggggtggccacttaagttgcatttttatttcaa

SEQ ID NO: 234798 - DNA, 361 bp, Homo sapiens
ggttctcagggacaggtggcttcataagataatcctttcctagctcaagaacctttctttagagtgttagagaaagaaaaattcttagtcctttgtttctcaccacctagagatgctagaattctacttcttggcactaaaagctatatcatcctgcacgcttgtgttctgaagcaggtgctaactctcttctgggccttaatacctctcgttttttctcttttcctctcaacaactgtcctcactacacaacttggccagggcctcccgtccaagtgagagctcttctctaaggcaacagtctgcaaactttatcacaaattccattaataaagttaagcatgtatcctctttagatgta

SEQ ID NO: 234799 - DNA, 361 bp, Homo sapiens
aatttacactgtgtattagttaatagtaccgtatgtgaaattccctggatgtgattatggtattatggttatacaggataatgtccctgttgctagagataaaggctaaagtattaacggataaaaggacctgatgtctttaacttaattgtcaaatgactcaaatgatttaaccttaattgtcgaataaaataaaacatctgtgtatgaagagaagctacaagcaaatgaggcgaaatgttaacaacttgtgaagctgggtgaatggtatttggttattcattgtatcattcttttaacttttctgtaggattggaaattttcaaaataaaataaaagttgtggctgtttgttgagtata

SEQ ID NO: 234800 - DNA, 610 bp, Homo sapiens
  misc_feature (13)..(13): n is a, c, g, or t
agagaaaaaaagngaccaaaagcccaaacactgccagtggctcctgttactcctgacaagctccccagggggatgctgccttggcctcacagctcctcacacagtgacagggctggggtgccggcctgctgatgaatgcagcccacacgggagtcgggagctgcctctcctggcccattcacaggggttcagttcccaggaactgtgggacctttatcaggggacctctgctagacaaggctctgttctgcagtttccaaaggagttttctgccttatgctcccagtgcaggcactcagcatgtgtgtgtgcgcgcatgtctgtgcgtgtgcgtgtgtgcatatgggggatggctgcgaggccagccagggctccttgtctgtgaaatgcccaaggtcctcgggggcagagatgcacctccatggagcagaaaaatttcaaggagggcagagtcattcaaggatggagcccatcctcactgcagcctcattgtcctgctcctgacaacccaatctgtcagccctggggtcgccacagctgctccgacccgccgtcggggggcagcatcgtgttgcaggtggagtgcgcaggctggtttgccagcggccgc

SEQ ID NO: 234801 - DNA, 342 bp, Homo sapiens
taaaagcatttggtgaaagaaactgcagaaataggatagtaacctctcctccaccaaactagaagaaacaagtcaacacttcaatattatgatctttttcagtgttgttaaaagttctcttcatgtctacatttttaaacattttgtttttttctggagaagtcctacctcacccagtagcttcccacttagtgatctccacctctcctctcctgcagtgtcaaaggaagaagcaaccctcctccttcctgtccaagcacaattccctctcctctcctctgagcctccatcttgtcctaaaactcctggagcccctttagttcatccccgagtgtctgacat

SEQ ID NO: 234802 - DNA, 534 bp, Homo sapiens
ttttattttgctcctcctgttattgggagggattagcagcagagcgaatgtttggatctttgctgagcagtcccatcggatttttctttattaaataggattgtgttttattgtaagaaggtttccctaagacaaataacgaaggaaattctgggtccaggagtacagactgtagcttctgtcatctcttgccaagttcgtagccctcagatggtgtctgtctttcccctttgcttgcggggccttttaccacagcactttggtgttcttttagctgctgcgataggactagctgttaaaatctgagattttacatttttgccagtcgcaataaattttgttagttctttcttgatgtgttctttaaaataataatgctttttttttttgggtgggggacagagtcttgtgctgtcgcccaggctggagtgcagtgacgcgatctcggctcactgcaagctccgcctcccgggttcacgccattcccctgcctcagcctcccgagtagctgggactacaggcgcccgccaccac

SEQ ID NO: 234803 - DNA, 739 bp, Homo sapiens
cggcttaaaataccgaaactttattttggtcacgttgcccatgtgacccgcggagcggatgactcatggttgcctgtcccaggatgaggccgccggccgaaagcagagaagcgccagccccggccgcccgggtggagcgctgggcagccgagtttcccaccctcctcaatccggagagtccgcgcggggcttttcctaataaatagccaggcacccgctgccctcgcgctgcgtacgggagcacgtgccccccgggaggtgggcgcccgccaggtgccccgggaacgagcctaggaaccgggtccgccgagtgcggctctcggggcggctaggcgtgcgggtggctgggcagcgctcccagggaccggcctctctccggagaaagtaaggaattctgctcctgggcaggtaataccggaaacaaaaggagaggctgcaatcgcaaattgtttaaaaagaagaaaaaggaaagaaaagttgaatgtaagagctccagcccctcaatgtgatcttgtacggtttgcagtaagaacatttcattcttccgcattttatttttccttttgctactgttggtgacaactagcaaaataagtgaaaaatcctcgttcaagtgttctggcattaagattgactgtcacactgaattctgtgccaatcctaacaacatgtgttctttttctggtcttcacaagtaagaatgtcttaggttttccagaaataaagatgtcccaaaaga

SEQ ID NO: 234804 - DNA, 421 bp, Homo sapiens
ggtactgcacatttgccaaactacagtgtattgtaaacataactttaacttttatatgtactaggaaatgaaaaaagtttgcgactagctttgagatattcactttgttttggtggtctggaactgaacctgcagtatctctgagtgtgcctgtacatatacatataaaaaattgtatcataaggaattaactcatgagattatggaggctgacaagtccaaatctgcagtggggttggcaggcacaagacccaggacagccaatgatgcaaaacaagtccaaaggccatttgctggggaatttgctcttgcttgggaggctggtctctgttctgttcaggcctttaactgattggatgaggaccactcaccttatggagggcagtctgctttgctcaaagctcactgatttaatgttatc

SEQ ID NO: 234805 - DNA, 297 bp, Homo sapiens
ggtattgcacatttgcaactacagtgatttcaatatacatataaaaaattgtatcataaggaattaactcatgagattatggaggctgacaagtccaaatctgcagtggggttggcaggcacaagacccaggacagccaatgatgcaaaacaagtccaaaggccatttgctggggaatttgctcttgcttgggaggctggtctctgttctgttcaggcctttaactgattggatgaggaccactcaccttatggagggcagtctgctttgctcaaagctcactgatttaatgttatc

SEQ ID NO: 234806 - DNA, 773 bp, Homo sapiens
ggcactcactccatcctgccaccctgtgaagaggtgcctgtttctcttttgccttctgtcatgattattctcactgtgttacctaggctgcagtgcagtggtgcgatctcaactcactgcaacctctacctcctgggttcaagcaattctcctgcctcagcctcccaagtagctgggattacagagctcatggtttttaaacaacttgtggtaaaaatctggtggaaaagataacaacagtatatgatatggcagagttgcacagaagaatcagaacattgttttagagaaacgttgggcaattaattaagccagctgattaagttttaaagaagctaaaccatatcatgtcgaaatcagaggagcgatgaaagtgtgagtggtggtatttctgctgttctcccccctgaaggcttctgcgattagcttctatgccttccttcccttatgggcattcagatccaaactacttgcaactgtagacaaggaggaagatggaacttggagaagacatacaggctgaagaaaaaaaaatattttggaagtgatcagcacattctaattgaccatggatgctctctgcattcatgtggtaacccagggagagtatggagtgaaaagaggatcaccaaagaaacttggggtatctcaacatttaggaaagtgtgcagagaagatgagatccttaaaatgttccaagaggttatatttaaatgttagaaggaaatcacaaagaatggcaccacaaaaatcaagggttggacttctttata

SEQ ID NO: 234807 - DNA, 897 bp, Homo sapiens
cttgaccgcagcacatccgttttccttacagtatgtagtacgcattctaccttttcctacaatgaatccaccagcagaaattcctgtacacatcttatcaacaaagaatttgaacctcaaagagtggctcaaagaggtcaggaggcaccttcaacacttttattggagatctccttgtctagatcatcagattctcactgtgttacctaggctgcagtgcagtggtgcgatctcaactcactgcaacctctacctcctgggttcaagcaattctcctgcctcagcctcccaagtagctgggattacagagctcatggtttttaaacaacttgtggtaaaaatctggtggaaaagataacaacagtatatgatatggcagagttgcacagaagaatcagaacattgttttagagaaacgttgggcaattaattaagccagctgattaagttttaaagaagctaaaccatatcatgtcgaaatcagaggagcgatgaaagtgtgagtggtggtatttctgctgttctcccccctgaaggcttctgcgattagcttctatgccttccttcccttatgggcattcagatccaaactacttgcaactgtagacaaggaggaagatggaacttggagaagacatacaggctgaagaaaaaaaaatattttggaagtgatcagcacattctaattgaccatggatgctctctgcattcatgtggtaacccagggagagtatggagtgaaaagaggatcaccaaagaaacttggggtatctcaacatttaggaaagtgtgcagagaagatgagatccttaaaatgttccaagaggttatatttaaatgttagaaggaaatcacaaagaatggcaccacaaaaatcaagggttggacttctttata

SEQ ID NO: 234808 - DNA, 428 bp, Homo sapiens
ataagtcatattgctctgtttatctttcaacataactgtcttttcaactgcacttcattttttccacccttagagctcatggtttttaaacaacttgtggtaaaaatctggtggaaaagataacaacagtatatgatatggcagagttgcacagaagaatcagaacattgttttagagaaacgttgggcaattaattaagccagctgattaagttttaaaggtaaggaaacaaaacaccatctgtgagagtatatgattgttaaaaaataaagttaagactacagaccccaaatttgtgtgaaagtttcaaagtaacaaacaaatacactaaaatgctagaaaagtaaaacaactacttttcacgaatgtatctgaaagcatacaagtttaccacagttgaataaaacagattcattttgaaaaaatt

SEQ ID NO: 234809 - DNA, 830 bp, Homo sapiens
cttgaccgcagcacatccgttttccttacagtatgtagtacgcattctaccttttcctacaatgaatccaccagcagaaattcctgtacacatcttatcaacaaagaatttgaacctcaaagaattctcactgtgttacctaggctgcagtgcagtggtgcgatctcaactcactgcaacctctacctcctgggttcaagcaattctcctgcctcagcctcccaagtagctgggattacagagctcatggtttttaaacaacttgtggtaaaaatctggtggaaaagataacaacagtatatgatatggcagagttgcacagaagaatcagaacattgttttagagaaacgttgggcaattaattaagccagctgattaagttttaaagaagctaaaccatatcatgtcgaaatcagaggagcgatgaaagtgtgagtggtggtatttctgctgttctcccccctgaaggcttctgcgattagcttctatgccttccttcccttatgggcattcagatccaaactacttgcaactgtagacaaggaggaagatggaacttggagaagacatacaggctgaagaaaaaaaaatattttggaagtgatcagcacattctaattgaccatggatgctctctgcattcatgtggtaacccagggagagtatggagtgaaaagaggatcaccaaagaaacttggggtatctcaacatttaggaaagtgtgcagagaagatgagatccttaaaatgttccaagaggttatatttaaatgttagaaggaaatcacaaagaatggcaccacaaaaatcaagggttggacttctttata

SEQ ID NO: 234810 - DNA, 797 bp, Homo sapiens
cttgaccgcagcacatccgttttccttacagtatgtagtacgcattctaccttttcctacaatgaatccaccagcagaaattcctgtacacatcttatcaacaaagaatttgaacctcaaagagtggctcaaagaggtcaggaggcaccttcaacacttttattggagatctccttgtctagatcatcagattctcactgtgttacctaggctgcagtgcagtggtgcgatctcaactcactgcaacctctacctcctgggttcaagcaattctcctgcctcagcctcccaagtagctgggattacaggaattacacactaatagtgaagaacaggtggcacctgaaatcacagaaaatttatttgtcctcaatgcaaagatgaactatgaagagcactttattgcgtttgaagaatataggaatgatgagtgaaatggtgaaggaagtggataaacaatgatgtaacgactgagcgtcatcttgcaactgaataagccagtgaggaacttggtaaatttgttgattatatttagttttacaatgtttaattctttattattttgaagtgatttattttattattaggaatgatcaatagtaatgcatcctccaaaactgtggaaagatcatattgcgcaaactagagcaaaaaatcacattcctcttgcatgggcatgaaatctttatcaaatgacatcaggcactgaagcagctatctgataccttcctcgcttccaccaaatggaaaggttattttaggattctctctttgtctgtctcttatgctgcaaacat

SEQ ID NO: 234811 - DNA, 763 bp, Homo sapiens
cttgaccgcagcacatccgttttccttacagtatgtagtacgcattctaccttttcctacaatgaatccaccagcagaaattcctgtacacatcttatcaacaaagaatttgaacctcaaagagactagcaagtacacaggaccactgtacagtaacagatcagttacactgagacaacagagtttacagcagagaaagagtttaatgctcaccggataccaagtggctcaaagaggtcaggaggcaccttcaacacttttattggagatctccttgtctagatcatcagattctcactgtgttacctaggctgcagtgcagtggtgcgatctcaactcactgcaacctctacctcctgggttcaagcaattctcctgcctcagcctcccaagtagctgggattacagagctcatggtttttaaacaacttgtggtaaaaatctggtggaaaagataacaacagtatatgatatggcagagttgcacagaagaatcagaacattgttttagagaaacgttgggcaattaattaagccagctgattaagttttaaaggtaaggaaacaaaacaccatctgtgagagtatatgattgttaaaaaataaagttaagactacagaccccaaatttgtgtgaaagtttcaaagtaacaaacaaatacactaaaatgctagaaaagtaaaacaactacttttcacgaatgtatctgaaagcatacaagtttaccacagttgaataaaacagattcattttgaaaaaatt

SEQ ID NO: 234812 - DNA, 472 bp, Homo sapiens
cttgaccgcagcacatccgttttccttacagtatgtagtacgcattctaccttttcctacaatgaatccaccagcagaaattcctgtacacatcttatcaacaaagaatttgaacctcaaagagtggctcaaagaggtcaggaggcaccttcaacacttttattggagatctccttgtctagatcatcagattctcactgtgttacctaggctgcagtgcagtggtgcgatctcaactcactgcaacctctacctcctgggttcaagcaattctcctgcctcagcctcccaagtagctgggattacaggtgaggagactggtgttaagtaactcgcccatccatgaccgcatcagtggttgaaatgggattggaatctggtcttaatcactcttccataatgcctccatggcaagggtggcagagaggaagaattatgctgaggaagtagaactgactagaagtcatgaaca

SEQ ID NO: 234813 - DNA, 808 bp, Homo sapiens
cattctcataaactgatttactagaagaaaggctgccaaaccataagtcttatgatatattctattgctaagttactctacagaaaagatggctgcaatgtatacccttaataatagagtacccccttcccttcacctttgtggatactgagagtcactgagaaacaagaatgctgccaccaccatcagcgaaaatagttattgtactttacatttctatatgtattaatgactaatagtagaagttgccccatatagtgaccatttgtgattttttaaaacatggatcatgtcttcatggcctctcaatttttcctgtgttaatctgtgaaatttcattaaatactaagattgttgatgctatccaatttcttgatttataatttgtttttaatgtttagtgttgtatttcagcattatgcatctagatgctgttacttgtgcatcttttcttgcattttatccttctacaaagcctttccacacactgacatcagttacttatcaatattttccactagttcttttatactcttacattttttaaaaaacatttaaccacttttaaatttagtttcatagttgtgaggaagacatcaaacctccccccaccatagtcaactcactgttttagctcagtttattcttgcaccattttttgtgggaggggggaaatgagatatgtgtgtttaaaataacagcctcctttggggctgggcgcggtggctcacgcctgaaatcccagtacttggggagactgaggtgagcggatcgcttgagtccaggagtttgagaccaccctggccaa

SEQ ID NO: 234814 - DNA, 772 bp, Homo sapiens
gaaaagagaagaaagaaaagtgggtgttacaggtaatgtgatcgtttatctaaaaacccaagagatcaactgaaaactatttaagctactaagaaggtccattaaggtgaccagatacaagctaaacatacaaaaaaaaaaaatcaggccttcggaaagcaggcttcaagttgtatttgatttagagctgcaagataatgcttattttaattggctaacattatagtaattgttggaaaaggaatggaaaagatcaacacgacattctaataataaaattctttctcaccctagagacaaagcacgtggatttttatagtgaaataagacctgtgaaaaatacagctttggcagtttttgttttcaaatttaaaatcatcttgagattgtctcattcaaggataataagccttgtgatgaaatagctacatgtcttgggaagcccttatacttcttatgaattctgttcccatcttaatacagacccctgtattaatttgctggggctaccataacaaagaaccacagagtgcgtggtttaaagaacagaaatgtattctcttatagttctgaatggcagaaatctgagagcaaggtggcagaagaatgggtattctctgaggcctctctcctttgcttttatttatttatttattatttatttattttgagacagtctctctctgtcgcccaggctggagtgcagtggtgccatctcagctcactgcaacctcgcttcccaggctcaaatgactctctcgcctcagccccc

SEQ ID NO: 234815 - DNA, 180 bp, Homo sapiens
ggatcctggccaaggagccagaaagtacagtgagcaagagtccaggacatgtagcaaggaggaatgtgactgaaataaagactaatgtcttcagtgcttgaggggagtaaccaggagacaagtgggactaaatggggcagagggctagagaggtcctgaaagcaaaactcctggctcact

SEQ ID NO: 234816 - DNA, 420 bp, Homo sapiens
atggggcgatcttggctcaccgcaacctccgcctcccaggttcaagcaattctcctgcctcagtatttttagtagagatggggtttcaccatgttggccaggctggtctcgaactcctgacctcaggtgatccacccacctcggcatcccaaagtactgggattacaagcatgagccaccgcgcccagcccacaaatttcaaattcagcctacttgggatttggtccactgaaacatatccagttttataatggaaagggggagggtagaaatcattttaaagaaatttgcttagcatctgaatttacaagactcttaagaacagaaacgtatcccaaccctcaaagacttcaactttcgcctttaaaccttatttttaaccatagtatttttcagctggaaaaacaaatcctcccaaac

SEQ ID NO: 234817 - DNA, 1025 bp, Homo sapiens
aaatataaaatacaaagaaatgttattctctatttatttttatatagattatagtctttatctaactgttcttagttcatttgaactaaaccaatgaatttgtcaacagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaattatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctga

SEQ ID NO: 234818 - DNA, 387 bp, Homo sapiens
gtttatgttaaaggagggaaagccgaccacttttatgtttttaacgggctaaattgggaacttgtcagtgctcacaatccagttcttcaaaattataaaactaaacttgaaagcaccctggtcacctctgacccactgtggaacacggtgccccccattgaagaggaaaggggtgcagttcttttcaagtagagccacctgcagtcacaggtgttctccgcaagccttggcgcttcagagagctatggtatttttgcttctgccagccattgtgatgacagtacctctgaagttcctgggccatattcaaaccttgtctctcacaagccacattagaaatatatatgccaccccctttctcaaaaatggtgttctttttcctgtttt

SEQ ID NO: 234819 - DNA, 475 bp, Homo sapiens
gtgcagtgactgttcatgcttctgtgtgtgtgcaggagtagtttggttggagtgtgcatatgcgaatgtgtgtgtatggaagtctatctatctgtaatgtaaagcagttgcgtaatgcaaatgtgtgtgtatggacatctatctgtaatgcaaagcagttgcgtaatgcaaatgtgtgtgtatggacgtctatctgtaatgtaaagcagttgtgtaatgcaaatgtgtgtgtatggatgtctatctatctgtaatgtaaagttcccaagtattgtgtatatcattgtttgagtttttaaattctaagataatttctagagaaaaagatgtacgggtgattcctggtgaaaagcagggaccgtgggcctcatattgagacacatttcacgctgtttagattgtaatggcaattatgtatgacttttgtacgttttttaaaaagccaataaaatacattttaaaatgtggaattatt

SEQ ID NO: 234820 - DNA, 2708 bp, Homo sapiens
  misc_feature (744)..(744): n is a, c, g, or t
  misc_feature (757)..(757): n is a, c, g, or t
  misc_feature (845)..(845): n is a, c, g, or t
  misc_feature (850)..(850): n is a, c, g, or t
  misc_feature (882)..(882): n is a, c, g, or t
  misc_feature (891)..(891): n is a, c, g, or t
  misc_feature (893)..(893): n is a, c, g, or t
  misc_feature (1107)..(1107): n is a, c, g, or t
  misc_feature (1109)..(1110): n is a, c, g, or t
  misc_feature (1117)..(1118): n is a, c, g, or t
  misc_feature (1129)..(1130): n is a, c, g, or t
  misc_feature (1147)..(1147): n is a, c, g, or t
  misc_feature (1151)..(1151): n is a, c, g, or t
  misc_feature (1161)..(1161): n is a, c, g, or t
  misc_feature (1187)..(1189): n is a, c, g, or t
  misc_feature (1229)..(1230): n is a, c, g, or t
  misc_feature (1233)..(1233): n is a, c, g, or t
  misc_feature (1241)..(1241): n is a, c, g, or t
  misc_feature (1250)..(1250): n is a, c, g, or t
  misc_feature (1257)..(1257): n is a, c, g, or t
  misc_feature (1261)..(1262): n is a, c, g, or t
  misc_feature (1267)..(1267): n is a, c, g, or t
cgcatggtgcgccgcacccactgtcccgcacccactgtccggcactgcccagtgagatgaacccggtacctcagttggaaatgcagaaatcacccatcttctgcgacactcatgctgggagctatagactggagctgttcctattcggccatcttggctccaccctcatgagacttattcacaatcatgagaacagcacaggaaatacccgccttcatgattcagtcacctcccacggggttccttctgcgacacgtggggattattacagttcaaggtgatatttgggttcagacacagagccaaaccatatcagctaggaaatgaccgtagagatgaaaagatattgatgatataaataatttcaataaatatatagggttggtttgatcagcttgaattttaattgttgaagatcacaaaggttacagacagcatttttgagagttaaagtgacatttttcagagattaccatgaacagtaacaactgtgaatagccaaaattaagctgaaacataagatttgtgttgggttctaagatagttagtgctgcaaagtcatgttgaggtgatgatctcagggatttttaggtgtatcctctgtgtatcttcaggcctgcctcttacttcgttggttccctaattgccattcatcctgcctgtatcagggaccactttacccgtcttctctgaagttcttggttattttatctgaagtttgttttttttttttttttttttttnggtaaatttctgngattattctgatttaccacatttggctttgaaatactgtatttaaatgttgagaatgtcatgccttaggaattcatagctagtctaanctaantaatgaaggaggaatatactgggaaaatccanccaacttangnggctccattacgtcttccagtttaattctttattactttctgagaccaattccttttggggatttggtttggtacagaggattagcttacttatctctgtatttttaatttaattttattttattttaagacgtagtctcgtggtgtcggccaggctagagtgcagtggcatgatgatcttggctcactgcaacctccacctcctgggttcaancnnttctccnncctcagcctcnngagtagctgggattacngggntaattttttntatttttagtagagacagggtttcannntgttggccaggctggtcttgaactcctgacctcgtgatcnnccngccttggnctcccaaantgctggnattnnaggcntgagccaccgcacctagccaggagcattcttcttactattgctgttctgctccttgacagattcacttagtgacagttgccactgccgcatcttagtcaagaaccttgtttctctctgggctatgacaatggtcttgctcactttctggctttcccaccccactccagtttggaaaatgctgtcactcttagaccattaggccaattaatccttcatcccctcacttaataacttttagttgcccttgtgggaggaagctcatattcttcagttttgcttttcaagttttccccaggttgaccccaaacttcctttccaacctcgacttttgctccgcctgactttaaaactgaacattagctgggatggttaatccactgttgcccaaaatgtttttcattgcctctttcttattctagcacattctgtggcctaaaatgtcctcttccttcctctgcctctatcctatcatcgaagcctcagttcagctctcaactcttctgaaaaatttaacttgatcacattagcctttagaaattctttataatccaaagttctctggcaaaattgcctccatctctcatttcattcaacattcattcattcattctacaaaggccacttgtcatagattgtcttgtattatcacctacgattgaagtgtttttttctttctgtttaattgcaaagaatagaaattcactcaagcttgtttgcataaagggaggtgaattgaagagatgtcccaggatgtcttgtcatcaagccacatttcccaagagttccagtgaatgggacccttccagttatcactcaccctggacctgcttagtgcaggagagggttgggggcacagttccttccaagggggcctgtggctggctgatgtagcagttgtgacctgcaattagcctacaatgggggcaaaatcatgtaacaaaaagcctattttgtattaaagcatcaaatatctcatgtagtttattgaatactgtattgaaagtgaaaaacagattggttgtataggcactcaaagagatctcagttctcttgcaagctccttaaagatgactggatgaggctttacaccattgtgtgtttgccaccgtgtttgtacacaggaagggctcaataaacaaatcattggtgactctttgacaacacagaaaacgattttgacttacagtgatttaaaggaattttagacccttttagcttgaagtcttaaaggaagttaagaagatagaaacttatttttaagagcttcccctacttgcattaataatgattaaatgttgaatcaaattagaatgaccaggctgcagtgcgtataccaatgtttgggaggtgaatgttctcaatgagggtcatgattctaacaaaattagttgttactcaaagcctgtttttcaacttccatttgcctcctactttgcccac

SEQ ID NO: 234821 - DNA, 903 bp, Homo sapiens
aagtttcccttcttggaaagaccccagcttctcccttgtacgtccacagagactctgaggccaagagtagtagcagctgctactatttattacttactatattccaggctgtgttctaagcactttatatttcttaacttcctccagttttcagtcactcagtagatgtctgtactatcatatccatcatatgaatatatcacatatgataggtaccaactatctgagtgaaaactggaagaaatgttctaaaatgacagtgttctcgttttatacttgaagaaacaaacagatttgcacaaggtcctcagctactaaatggtagagctgagactgaacccagacagtttggttccagagctgagagaggagtgaaagagttgggtaacagcaacaaccatcctgtacatggagatttgagtgattaaaatggattttcatatcttttatcttggacctcataatatttcaaattttttttaaaattatgaagtatatcatacatataggaaaatacccaaaacaagtatacagttcattaacacaaagcaaacgtgaataaccacattcagtaaagaaattggaacactgtcaacacttcacagcctcctttatactcctcccaatcactgctacttcctttcttcccacaggtaaccaccattctgacttctagcagtgtcatttaattttgtctgcatttgaactttatataaatggaatcatgtattcttttcatgttaacattgtgagattcgtcaatatttggaataggtgtagttttcattgctgtgtagtattcagtcatatgaatgtatcacaatttgtccatttactgttggtggactttgggatgtttgcagtttggggttattatgagtcatgccttttggagtacgtctg

SEQ ID NO: 234822 - DNA, 302 bp, Homo sapiens
tgaggtttagtcaagagtttgtacagctctaaatccttggatagaaggttttaataaaaatgccaacttttaattaaaaatctctctcttgattcagttatcttgcccaaacttggaaactcttcttactactgtatataataattcctgttaaccagatgttgtttgatagctcagtaataacaaatggagggtacttgtcctaacctgatttacattctttccttttgatgtgtagcatatgtggagcagtcagctaaataaaggtcttatcaataagatgcagtttgacacttggcttt

SEQ ID NO: 234823 - DNA, 458 bp, Homo sapiens
caggaccctagctttgcagagagtcctgtttccctttctgtccatttttgctcaaaaattccatttttttcaaccttcaaagtgtctgcgagtctaatatctcatggccatgtgacaagaaactggctcttagctgaactaaggaaaaagtcctacgacacaaggacacaaaaatgtacctgaagaacaattagaaagtctccaccactttcaaaaatcccgtaagagtgttaagaaaacttgctaatcagagtctatctatctcaggacttactccttttcctctataaaaccaaaacttccttcaaatacctttgaatcctgctgaaaagagcatggccacagatagtttcctttaaggctgcatgatcaggaataagtagcatttactaattttgtctcaaatttaattttatctttgacattattaaaataattattccttttcctactatatt

SEQ ID NO: 234824 - DNA, 1658 bp, Homo sapiens
  misc_feature (897)..(897): n is a, c, g, or t
tgttaaaagggttttaaataagtctctttttcaatggtgtaagtatgagatttgtgaagccctttccagatgcatgtgtgtttgcttatgtttaaaaaatcacttgagtgcaaacatttaaacacattttataaaactggcgggccaggcacggtggctcatgcctgtggtcccagcactttgggaggccgaggcgggtggatcacgaggtcaggagtttgagaccagcctgaccaacgtggtgaaaccccgtctctactgggggaaaaaaaaaattagccaggcgtggtggtgggtgcctgtagtcccagctactcgggaggctgaggcaggagaatcacttgaacccaggaggcggaggttgcaatgagccgagatcatgccattgtgctccggcctgggtgacaaagcgagactctttctcaaaaaaacaaaaacaaaaacaaacagacaaacaaacaaaactggcatggcattggacagtgacacataagaagctgatgtcatctttgccacttagagaaggcaaaatatcttgttagataacccctcttaaatgctctgcttggctagtactttttgggcttggtcagtgattagagtttaagttgtaaatggtattcataatttcttgtctctgtctcatcccaaacagattagaaaatctttgatttttgttggtaaggagctagcatcttattaatacaaagccttgtgcataaattatttccagtaattatttagtgcctaatgtggcatgctttgtgctgagtgctgaggataaaagaggaataaggtaagatctttatagtttagcagaggaggatgtgagtgggcagaaaaatgttatgagttctataataggaatatgtataggggaacttggttacagctcancttaattgagaaagggtgtgaaatgaaaagaccaaacattctttgcagaacagctaaacagttggaattatatactcagatgagttaatgattataaatagccatcatttattatctctccagaactccagaaccaaggttataaaaaatgaatagttctttatttagttcagaagcatttgtgaagtatctatagcatctgtaacatggcaggccctaaggacgctggcatgaatagtgggccgtcatctactgggagagtcagtatagcgtgtacgtgcgttagaggtgaaatgcataaaggggcatccaacatggctggtggctggccatgtgaacaagacatttgcatttgccacagcataaagaaggatatttctgagtcatggagtattttattatgtttatttggccccaatatttccaaataaaaagaggcctttgcttttgtgctacaggcgtttcttatctttaggaagaatgggccgggcgcggtggctcacacctgtaatcccagcactttgggaggtcaaggcaggcggatcacaaggtcaggagttcgagacaagcctgaccaatatggtgaaaccccatctctactaaaaatacaaaaattagctgggcttggtggcacacgcgtgtagtcccagctactcaggaggcgaggcaggagaattgcttgaacctggtaggtggaggttacagtgagccaagatcgtgccattgcactccagcctgggtgacagagtgagactccatct

SEQ ID NO: 234825 - DNA, 1514 bp, Homo sapiens
agtgcttttcatgtcttcaattatccaagtaccccaagcctgtggtttgcctcagtttgggtgggcatagccaagggggttccagggccgtccagccttcactcaaggatgactttccctaggctgagggcagtggacccttgacaaaatttaattaccgtctctgcttatggctggacctcagctggcagggtctcgggggctttaaacaaaagcaggagcctctccagaagtagattagggagatttgcattcaggccagggatttgtacatggtgttaattctcctccaggcagatatctgcttgggaaagggctgtgtgaccctatttagaaaaatggctacactttgttaacctttttcccttaagaaggaaaaatcattaatggcagaagttcaggccccagaggggattttctgggtgattctttgtttcaagagtcatgtttccccagatgtgattaaattgtccgtaacttttaactcttccctcccccgtgctttagttgaaaaataaaatctctgttcatatttcttgcatatcataggcttatgtctctttccagctctataagtcaaggctaaagattttttttttaagaaagaggaaaaaaaagacatttatttgagaagacatttttgtgtgtgccctgctcccaccatgcattcattcggtgctggaaagtggttaggggattctaagcagcccccttgctatagctggactgtgacgctgtcccttactgtcagtctgcttggctcctccagacctgatgcagatgctgcccgctccccacacagccctcctttttctctgttcccggaacactgtttgcttctgttactgagaaggcaatactgggtaaaggagaatgatgcacgatgtggagctggaagacccaggcccaaaggcagcttttaccacctcctagctgtgctaccctgggcccctgagcctagagttccttcactgcacttgcaattgcactgtgcaatgccttctcagtctcctggctagaaaatggaactcctggaggacaggatgtttttcatcctattatttccagtcatttatctagtcattcatttctttatataatgaccctcctaggacctaagaatagagagatgaacgcgatacatgtggtaggaattgtaagttgctgcttctttttgtttttgttttgagtgatccactgatggttgagaaagcctaggatctttctccccagagagaatgccactagagagggggcagaacatgaccctgcctgttgaccccaactgtgacacttctgaaaccaatcttaggaaagcctctcatgggaatggcatttccaagattaggggtaaagtgggacctccctgttgaaaagttgtcctgccctctgtcagctagacatgccataagcaagggaaagaatgacttttaatgacaggggtagaaattgggagcaagaggctgaacacatggaacagaattttttgaagtgccttgttaaatggaaagtag

SEQ ID NO: 234826 - DNA, 370 bp, Homo sapiens
attttaagacgtggaggagtaggatgagagcacgggcagctggacagagtggctccaacaggactgcaggggagacgtgcggtcacctgcggcgtgggaacagcagggcaagggcaggcgggctcggctcctggactcctcctgcggccacaaagctgccctgtttctccgcacctggacccccagtgtgtgactctgcatagagctcatcatgatttgtcgcccaaggtcataaccagtcacagccagcatcatttcaccaggcacacggggtagaagcagcgaagagaatcgcagcaccggcaaacacgaggaattccggcactaacacttatataatgaaaaccttctccgctctcactcaccgctg

SEQ ID NO: 234827 - DNA, 510 bp, Homo sapiens
tgtttggaacttgttttttgccccaccagctgagatcctttacaacaaacagtgcactgactcagggtcagtgagaatgttcaaccttcattaaatacattgcctagagaagaggccaaaagagatatgatcctaagatggcagtaaatccaacctttgtaaaaagatggaagccaatggccactgacgccagtgcagagttgccttcaatttaaagtgggttgttaatgtcgttccctggagctgacattttgtctttaggataaggcagaaaagcaggaaaagaagactgttattttgaagaagaaaacctgaaaacgcaacctcagttggtaactagtacttggcgaagaaggaaagccggtgcggttttaatgagagaaagtaactgccaggccttttgaccatcgccttcgctttgcaaatctggttttcatattcttgctcagtaatcacccaaagtcataactgtctctgaaattattcattaaagtcattttcagggattct

SEQ ID NO: 234828 - DNA, 319 bp, Homo sapiens
tctccgctccgactgcttgtaggcgatgcccaggcaaagaccgtgactgacactctcgctcacacgcacgcacggacccaggcccacgcccggaggtcgagccccgggctcgcaaccgttgtcgctcccggcgccgcggccagagcccggaccacggcttccgcgccgccgccgcctcgccgagaagggccgcgccggacctcgagcgcggcggcccccggccggcagggatggggaagcgggcgggaggaggagcaaccggagccaccaccgccgccgtctccacgtccgccggggccgggctggaacctgcggccgc

SEQ ID NO: 234829 - DNA, 529 bp, Homo sapiens
cagtttgctaagaactttatgtatagtaagttattcaatcctcagataagctcaccagttaagtgctattgtatgatgagttcagagagtttaagcattaagcccagcactgtccaataaaactctctacaatgctggaacagttctatatctgtactgcccaatatggtaaccacttagccacgtaagttattgagctcctgacttgtaggaagagcaaatgaagtgaatttttatttacttttagtttatataaatacaaatttaaataaccacatgtggttagtggctaccatattggatagcccaagttcatatggctagcaaagatcagaagtaaggatccaatcccaaaaattatctggctccaaaatcatgctttaaagattaaaataccaggatgggcatggcgactcacacctttaatcccagcggtttgacaggctgaggtgggaggatggtttgaactaaggagtttgagaccagcctggacaacaaagtgagactgcgcctctacaaaaaaacttta

SEQ ID NO: 234830 - DNA, 662 bp, Homo sapiens
tctatgtgtagaataaccttgatcagaaaacggattgaaagccaaacatgaaccttgctcagaacaaggagagtgttccactgattataactagttacctattttttcctttatctttaaaccctgatattattttctttatgttccaaacatgggaacatatggctgaaaaaatgaagactctgatggctaaaaaactattgcccagaacataaacatctaaatttagagaactcagtcttgcaacgattttttctactttgatttagctctgctatgcaacagtaaacctatgattcctttaccaacaaactctcccttcaaaccataaaatctctgagtatgctcattaactatggtccaaataaacaaataaaaaggattattccaaacacagattctattctaaaatagagactcagaggcaaaaaagaaaaaaaaagcgtagaagacaatgcatgttgtgaatataatgaaaacctcataaaagaaagagaggagagtaaaaaagagggagactttctaaaaatgcctagcacttctggacttgacttagaaatccattaagggcatataaaatgtggttcaaacacagaacctgagcttgagaaacagctctgattgtttgctgtatggcataaacagatggcatagcccctctg

SEQ ID NO: 234831 - DNA, 320 bp, Homo sapiens
gagaatgcaaagacaagccacagactgagacaaaatatttcaaagcatttttctgataaaggacttaaattcagaacacataaaatctcttaataaaccaacccagtggctcacgcctgtaatcccagcactttgggaggctgaggtaggtggatcacctgaggttaggagttcgagactagcctgaccaacatggtgaaacctcgtctctactaaaaatacgaggcaggagaatcgcttaaacctgggaagtggaggttgcagtgagctgagactgcaccactgcactgtagcctgggcaccaagagccagactctgtc

SEQ ID NO: 234832 - DNA, 325 bp, Homo sapiens
catcatcattattttatatacactttggcctacatagttataacatataaagttgtgaatagcattcgtgtatttatgtgtctaaaaaatgtgatgtagcaaacgtgcccaagtttaatgcaatcagactgtggcatttaacacaacctcactgagtgatgctcaataaaaataaaaaacaaagtgattttcatcactgctagctcatgggccccaaactcacatgaccagctcaaccatcaccacccaacgatagatctttgttgattctcatgcccccaccttcccagtttctcataataaagacagattgcttcttcacttg

SEQ ID NO: 234833 - DNA, 627 bp, Homo sapiens
agggagagagggacaaatcatgacatactacattaaatactataccttgcagaaatgagttctaattctagttgatcaggaataatttatcagactgccaaaacttttggctaaatacacattatctctatttattctcatatgaaacattatattcttccctaagtatgaggaatccataaattacagccaaacactccatactttttacatcttgtgtatagttctgatcctctagaatgggggtttctgcatcccagttatgctcaaattcacacagactttagagagacacagagctaatctcctatctaatgaggaatgaatgagggcttcactctgagagtcaacttatgccttgaggtaagtagctttaggacctagaacttgttcatgaatttaaagagaaaattcctgtgttttacttattaccaaattaagtagaggggacccaaggttcaggggagtgctaaaaatcacataccagccatacattaagccacttacttagctacagtacttaaaaggtttactttattacctgagaggaagacagtgccacaacataaactctgttgactggtaaatttgaggaattcaactactgaattaaaagcatggtagggt

SEQ ID NO: 234834 - DNA, 361 bp, Homo sapiens
tacaaggtctcactctgtcatgcatgatggactgcagtggtgcaatcatggctcactgtagcttcgaccaccctggctccggtcatcatcctacctcagcctcccaggtatgtgggattacagtggtgtcagtcatcaaccttgtgatcactgaggaaaagatacaataatccttgcctatcctttagaaaaagggtcttggatgttgcctaggctggccggaaactcctgaagtcaagtgattctcctgtctttgcctttagttctggaagtactgggagtgaacctctgcaccaggatttccctcaccattttctgtaaaatggcttactacaaagaacatttctgtagtatattttta

SEQ ID NO: 234835 - DNA, 497 bp, Homo sapiens
gtcttgtcaaggggtggtgcaagtcatgttcaggtttgtgaagcatgaacaaagtccaaagacatttttcagaccctcgtacgtgctgggcaatgtgcaggtagacaccgggctgtgaggcgcttgaacccaacaccaagaatcatgtcctcatggctctgcagcgaggtccaggagatgcttcatctgctggggcaggtggagactcctgcctgctacccagtgagccatggcctggtggctgctatctcacctccatgggacaagagcttgagcttggtcagcaactacagcagtgccagcagaggccgagggcctggcggcttccgcttaggtgcccagttgggtgttcagcagccatgcccaggctctacattgatcagcagaaatggctttaatcagagaattggtctttgacattttgagagcacctggctaatggatttgagtacattttgattactttaataaagcacccttgacagaatgcattttaa

SEQ ID NO: 234836 - DNA, 425 bp, Homo sapiens
caacagtgacaagtgagggcgacagtatgtacccttgaaggatgtgataagaggagcagtttgccccgtgatcttcctcccaacgtactcatcatagtaacatcaggcaaatcccaactgagggacattctacaaaacacctgaccagtactcctcaaaactgtcatggtggccaaaaacaaagtctgagaaactgtcccagctaggaggagcctcaggagacatgacagttaagtgaatctgggatcctggaatagaaaaaggacattgggtaaagtttatgaacacgtgaataaagtttggactttagttaataatagcatatcaatattggttaattaattatgacaaatataccttattaatgtaagatgctaataactcaagaaactgagtgtggaatatatagaaattctctgtgctgt

SEQ ID NO: 234837 - DNA, 463 bp, Homo sapiens
cacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcattttggctctagaacccatggtcttaagcactgcaatatatcacctttcagtataaaaatatttgaatcagagttgcaataaaaaaaaaaa

SEQ ID NO: 234838 - DNA, 520 bp, Homo sapiens
caaagtccacaaaattagcaagtgacacagcagagctttaaattataatattttagaacacacactcttaatagttataatgatactctcttggtagtgggttatgagtttggttaatgactagacctctctgagtggtatgttcctcgtggatacaaatggtgttgctgagatattgattactaaagcacttaactaataagatgatggttagtaaaacaacatggctgggggtgttggctcacacctgtaatccaagcagaattttttgggaggcagaggtgggaggatctcttgaggccaggagtttgaagccagtttgggcaacatgggaagaccctgtctctacaaaaatagacaaaaaaccaattagctgggcatggtgatgtgtgcctgtagtcccggctaactacaaggctgaggtgagatgatctcctgagctagggaggttgaggctgcagtgagcccatgattatgccactgcactccagcctctgggtgacagagcaagacctattaa

SEQ ID NO: 234839 - DNA, 319 bp, Homo sapiens
cctaaaccccactaataaagtcagtctgaagtacaaagacaatcctccccaagaaagcagagccaagaggaggtttctttggggcggctgccatttgctcttttaacacttaaacatttcaaaattactcgtcattttctacagtttcttagcgtgcaaaaagtctaaatggcaaaggcatgattgtgagtttagatagttttatcacaccttttttttttatagtttcaaaatgtgtgggcagtttcagatgtgaaactccatctcacaaaggaggaactacagtctgattctttaacatccaagagagcagccagga

SEQ ID NO: 234840 - DNA, 425 bp, Homo sapiens
agaggtgagagaaaagattttcataatatgcatgccctttcctacttcctactcttctttcttttcttcacccatccctgtctttcttattgctagtaatggctaatgtaaagcatatcactcttttgcatgtatcactcttctccctgactctactgctatgtcagaactgggacttctacttcacagaaaacatagagattatcttcagatacgtctcagttttatgatcattgtcttagatatcacttgccttggcattagattttactttgatttctgccatttcagaggataagctcacctgctctctttcctctctttatttgtatatctgtctctgtccctctttttgtacattctcggtggtattgaagtatcctcatatgtttcttatccttaaaaaaaccattccctagcctaga

SEQ ID NO: 234841 - DNA, 558 bp, Homo sapiens
cccagaatgtccagacaacttacttttgactgattgaccttatctagttggtgttctttaacatgttccccatcccctgtaaaccctaataactaaactgataagagtcatcctcaaaattgagcaggcatctgaatcatctggtatacttactaaaattccaattgctggtccccaatttctgacccaagattctgcatttttagcaatttgttgctgatgcttctggtctggggcccataccttgagaacccccggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttaatacttattcaaattacaaattcactgtctttaatttattctaacaaaagtaaacctaattttatagttat

SEQ ID NO: 234842 - DNA, 187 bp, Homo sapiens
tagaaaaagtgtgaaaatttgctcattgaacagtgaattcccaactgtaagttggtaatcacaaagagtttgaaacaaaaaaagcccctgaaggctgccctttgatctgcttgcctagtttgacaagaagcctgatctttcagaataggttagtgacacacaaaagcaggtttcagttaagcaacac

SEQ ID NO: 234843 - DNA, 558 bp, Homo sapiens
gagagggggtggccagcacggccccagcccgcatctcccacgctgggctcagtcctgggcacagtgggagacatggaggtagagacccgggtatatggcctgcgctcctctgactcgccagagagaggcttctctcattcagcagagctgcagccctgcggctgaagggcctgctgctgctcctgctggggttgtttgcctgcctgcaagaggcgctggggggcaggaaaagaaacctgggaggaggggatccagcagctcctcctgctcccagaggcggcttcttcctccaaccttggaggtctgccctcaactgggcttctgggctgtttgtccctgaggtgctgcccaggacaggctcttcttgacaggtgggcaggggtgtggaggccagggggcatctccaaagggtatcaaaaccgaagcttcaaaactcagcacttgtgcccccaaatcgccatgccatgccaccacctgccctagaattcatccatagtgttaaaattacaagtttctacaataacatttaaataaagtttgactttttgaaagttcgtg

SEQ ID NO: 234844 - DNA, 486 bp, Homo sapiens
aattcattgtcccaaattctgagaactcctgaggaaagatccaaaagtaatatggctcaagatttttgaactgcccaggctctactcaggctcttggacatcttgcccatctcaaaggtctctcctgcctactgccggccctacccacaagatgtgaacttcagagccttcttgcaactgcttcttggctattttcaccctctaaccctctggaagaagaatgaggactattatgaaggcaaaagcataaaaggggaaaagattagcctccagagtaggaagattgggttgttggaagccagcacaagtcttcccctgaaagagttaattcgcctccaatgggggtagggactgacctgggaggggcctcagcctacataggacaggcctaaaggccccattggggctgaaggtgacactgggtcagatccctaggattctgcaacttgaggtgggagtgtctataagctggaaacaaaagtttca

SEQ ID NO: 234845 - DNA, 350 bp, Homo sapiens
tgctctcgattaagtaggctttttccttttgtgacttgaatcaacaaaaaaatgcattgtcgccggccagtcgcagtggctcatgtctgtaatcccagcactttgggaggccgaggagggcagactacctgaggtcaggagtttgagactggcctggccaacatggtgaaaccccatctctactaaaaatacaaaaaatagccgggcatggtggcacacgcctctgtaatcccagctactcgggaggctgaggcaggataaaattgccagaacccgggatgcggaggttgcagtgagccaagattgtgccactgcactccagcctggccgacagagcgagactctgtctc

SEQ ID NO: 234846 - DNA, 415 bp, Homo sapiens
gacattgccaattttcgaataatctgatggtgggatgtcaaagtgtatatcttttatctaccctcaacttgcactttaaattccagccattctttgacaataatagagtagtgagaaaccaaaatatgtcagttgtctgtggaaataaaaaaggccatagatgtttaaaagttaaaccgtagaaacatttttaaaatgaacattttctacttaagctttccattaaataatagtttcatttaacgaatcaacttacctttgtgaagtgacatagcagataggtgttgtacagactgctttgaaagatgcagcccttatctggtgtccctacagtctaatatggataacattgatacgcaaacaaatgaagaaacattgtatgtaattattgtgcaaaacttttctaaatacatta

SEQ ID NO: 234847 - DNA, 425 bp, Homo sapiens
caaaaattactctcctacatttggtagtaaagtacaaagcttaatgtgtctaaattctcatggtcttgtcattccatgctcttgatccgcctcttccctcactccccagtccttactaccagtactgttagctacttgcatccagttttctcagcatttgctggtatctggctggccaggcttcaaccccacatttgctacctattttcaagccaacatttactatttattccaacagcgggccaccattagtgtcattaaaatttgtaatcctacccttacgcattgacttgtttaattaagggcctactgtttagctgcctctttatagattgagaatgacctaaagcaatataacttaagagggaaagacatcattttcccatgtagttttagccttgttttcttgatctatggagtggaaa

SEQ ID NO: 234848 - DNA, 549 bp, Homo sapiens
aatttgaggattctgtggacagtgaggaaattggagtccacaaggacagactgctttttcaagaaaaatggaagaagggaagtagagattcttaatgctgttgtttacctgtcacaggtgctgaggagaaagaccccataagaagaaaaagagtcaaaagatgactgggagtgaagtgatatatccacaagcatgggtggagccaatcagcatgaatgagggaagggagacaggagggagaaattgagggggtttcatctaagattgctcttttctccatatagtaagacacaagtaatatggtgagagtgagtgggaagagggcagaggtcatggtgtttaggagttgaaagacccataaaacatgaaacaggaatgggaaggaagccaactgctgatgtgtaaaaggcccatcaggttgtgtttgcagcctcctaaacttggtagcattccttgaggttgtatgatttcaacactgaattttgttcacgtgtgcttgaattagccatgcgtattactcacgtaatatgctgatccactttaagcaaa

SEQ ID NO: 234849 - DNA, 437 bp, Homo sapiens
cctatcaaattggcaaagattttgaaacgtcataatagcacatgttaaaaagaagaaatgagtactgatgggagtatgcaagctaaaactttgagaaaataatttaatcgtatgtatcaagattccttaaaaaaaaactgttcatgtcttctagtgattgtactctaaaaatttatcctaaggaaatactataaaatgattacaaaacattcagatgcaagtatattaattataataggatttgtaataatgaaattggatgcaatttaaatgtctaacaataaaaaatatttacatagataatagaacatccagaaaatgagatatgcaactattaaaattgtgttaagagaataatatggggaaatgtgaaaaagaaggatatatacagacgcacgtacacatccaaagtatgatcccattttaaatacaaacac

SEQ ID NO: 234850 - DNA, 626 bp, Homo sapiens
ttttttaggtacattttccctcaggtcttacatttgagtaaaaatagtttgtgagtctgtggagttgctattcagagtggtaacatgccgtagggagatgtaaatctgtattgctacctcgtgctcacttgactgactcttccgttggaacaggtgaattttcctcatcaaaatgttgtgtccatggtgatgagagtaatgaagatgataacgatgatcattccctttttatcttctcatctaaactatttgcaactcctctgtccctactttctaactagtcaaaacatggtcacttctcactaattccactgccatcaccttaattctaggccacaattaactctaacctggtcttttcaatagctttgtagatgaaatatgtgttgtctcttcatgatttgttctcattatgcaaccacagtaattcttcttaaatatgagtcaaatcatgttattctgcttcccgccctcttggcagtctagcaactcccttagaataaaaggcaaggaccttacagccatcaaccaggccccttgtggccaactcctgttcctttttcacttctctttccaatattcttgctcactctgcttcagacacaaggagtccatgctgccttttt

SEQ ID NO: 234851 - DNA, 428 bp, Homo sapiens
attctccttgctgtcatattgttagatccagagagttagactgtgcagtaaatgagctatttttttaccttagaaaagcagaagacttgaattttcataagtagactcttagaggttccttcgtgatgcttcagcacatttacttttctccaaagaaatgcttcagggccgagtgcagtcggacgcctgtaatcccagcactttgggagacccaggcgggcgaatcacgaggtcaggagatcaaaaccatcctggccagcatgatgaaacccagtctctaccaaaaataaaaaaattagacgggtgtggcagcacgtgcctgtagtcccagctacttgggtggctgaggcaggagaattgcttgaacccgggaggcagaggctgcagtgagccgagatcatgccactaacgacagagcaagactccgt

SEQ ID NO: 234852 - DNA, 552 bp, Homo sapiens
acacctgctccccagtgtccccctgagctctaacctctgtccatcctccctgcaggtcattccttctttcagagttgactctgctggttttccccagtagctgccacataccctttaaattctctttaaacgcttatccactgtcagctgctccctgaagtcttagcagatgatctcacctcccatgttactgagcagactgaagccattccaatataaatcctaatttcattcctcttatggacggcgtggcttagcctcatctctcttctcactcctgtttatgaagaaatgtctgttcccttataaagttgccccgttgccctgtgtgccggatcactctcctcctagctgtccaaaaaagctgctccacagttctcctttacgtgagcattccgtttcttccacatcatggtccccgttcttcctgtaaaaatatggtcaagtctactctggctttaaaaacaaagtcattccattactctggtatttactaagactcctgtccttctcctcacagccaattttctttaaaaaagttgtctgcatttc

SEQ ID NO: 234853 - DNA, 637 bp, Homo sapiens
aaaaaacaaaaaccaccaaaaaaaaactgccaaagtataggttatagaagagcagacttacttggtgtttgcaagaaagacaaagagatttagagtttccatcaagtttgttgtgagttactaggaggtagtgccagagaagcaacatggcattaggctgcatgggtagaagtatagtactgagaacacgggagagcatcggttttgttgtacttgggactaaacattctgagggtcctggacgttttatgagaggctttggtaaactgaagagtgatgtaggtacagatgcacagatgtagaacagtgagcccctgcgccagcccagcatcaatactttttttaaaaagtgccctgtattttcctcatgccctggagataatggagccgtcttttactcactgcccacttctcatctctgtctgctcctgcttcctcttgttggcttcctgtgcctccctccaaccttctcctacccccctgcagtgttttaaactctcttttcttcttaatttctgttcgcctcaaccaaccctaaagtgctcttgtactcacaggtaggcttttataattgcttgatcagtttatcagtcaatttcagtattttgttgagctttgacaaagatttttattctaa

SEQ ID NO: 234854 - DNA, 432 bp, Homo sapiens
aatagtagtgacggggtttcaccctgttagccaggatggtctcaatctcctgagctcatgattcacctgcctcagcctccgaaagtgctgggattacaggcgtgagcccctgcgccagcccagcatcaatactttttttaaaaagtgccctgtattttcctcatgccctggagataatggagccgtcttttactcactgcccacttctcatctctgtctgctcctgcttcctcttgttggcttcctgtgcctccctccaaccttctcctacccccctgcagtgttttaaactctcttttcttcttaatttctgttcgcctcaaccaaccctaaagtgctcttgtactcacaggtaggcttttataattgcttgatcagtttatcagtcaatttcagtattttgttgagctttgacaaagatttttattctaa

SEQ ID NO: 234855 - DNA, 356 bp, Homo sapiens
agacaaacaacattaaatcttgaggcttgagaataatcattgactccatatcccgtcttctgaacacactggggtggggattgggctcccaaggcttcaggcaggtccatccccatgacttcacaggatgcagcccacacagcttctctcggagttggagtcagatgcctgcagctctctcaggctgatgttgcatgctgatggctctacaggtctcaagggcagccctgatcccactatgcattaccccagtgggggctctctgtgatggccccaaccccatggctctctggacattgacctagtggggactgtctgctgtggccccactcccatggctcgactaggcattgcct

SEQ ID NO: 234856 - DNA, 226 bp, Homo sapiens
cgggtttctgggtgtgtgcctgtaggtgggctgggaatattgctgagaggccaagggaggttcctaaagcaacgaacccctgcctgacagattccccgctaaaaccaaagagcacgatccggaatttgttccctcctcttccctttaggcctgagaaaggggacagagtaatctctttcttgcctccttgtacatttccttcctcctgatttccccttctgtgttt

SEQ ID NO: 234857 - DNA, 370 bp, Homo sapiens
caattgaaaaaaattgaagataaaatgattctgtttttgttagtttatatgttctttgaacacttggttagaaaactcacagcataggccaggagccgtcgttcacctgaggccaggagtttgtgaccagcctggctaacatggtgaaaccccgtctctactaaaaatacaaaaattagctgagcatggtggtgctcacctgtaatcccagctacccaggaggctgagacaggagaattgcctgaacccaggaggtggaggttgcagtgagccgagatcatgccgctgcactccagcctgggcgacagaacaagatcctatctgtctcaaaaacaagcaaaccaaaaaaacaccaaaaaactcacagtat

SEQ ID NO: 234858 - DNA, 751 bp, Homo sapiens
agcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcgtggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttaga

SEQ ID NO: 234859 - DNA, 480 bp, Homo sapiens
tattcgacatgttttctcttcaggcacattttgctgatggccatgacataattgaatgatcgaagttttgggaagcacaggtacatgcaaatcatttacacatgaaaaagaaaggatgaagcagtgcaggagagtaagagaacacacagactccatatgtagaaaggggatgtttcagggcctccatttccagtaacgaggaagaattagttacccagacacactgtaccattcaaaacaactaaaactgctaaattaaatataatatcttcttaaaagtcatcaacaaactggcaaagaaacaagaaatactaaggactaaggacaaaatctaaatgagggtggcaagctaagtaaacattaaccttttgctggcttgacgtatattaagaatctgaccttcacaatcctattgttggcaaagaaagatagaaaaaaagagtcaagaagcccaaaaaacttcaagccagtccacacatg

SEQ ID NO: 234860 - DNA, 406 bp, Homo sapiens
cattttctgcccttccactatgggatgaccctttccaattgccaacaccaaatgataagaaactcttggacttcccagccctcaaaagcattggccaaataaacttctgttctttataagttgcctagtctgtagtgttcttttatagcagcagaaaacaggctgagatggctacattccaatataatattatttacacaaacagtcagtgtgtcagatttaagctacagaccatcactggtgacccttggcctaagctaaaatgtcctgtaatgtgtaccccatagaactacagatctttatttataaaatataaatctgataatgttgttttcctatttgaaatacctcagtggtttttcatatacacaatagtggacaaaataaagcctcttctatttctacc

SEQ ID NO: 234861 - DNA, 457 bp, Homo sapiens
aagacagggtctctgtcgctcaggctggagtacagtgaagccatcttggctcacttcagcctcgacctcccgggctcaagcaatcctcccacctcagcctcccaagtagctgggatacagacacacatcaccatgcccggctaatttttaaaattttctttggaaaagggatctcgctatattgcccagactggtctggaactcctgggctcaagggatcttcccaccttggcctcccaaagtgctggatttacaggcatgacgcccagctgtttctctattcccaaaagagaagtttcagcatgtcttcaccttcattgtcgcagcagcttccttcactggtctcaaactcctaacctcaggtgatccacctgcctcggcctcccaaagtgctgggattatagggatgagccaccgtgcctggctggacttataatttttaaaaagacccctgata

SEQ ID NO: 234862 - DNA, 494 bp, Homo sapiens
tcagctcttacccgtcctacatagtgttggaaaagggatctcgctatattgcccagactggtctggaactcctgggctcaagggatcttcccaccttggcctcccaaagtgctggatttacaggcatgacgcccagctgtttctctattcccaaaagagaagtttcagcatgtcttcaccttcattgtcgcagcagcttccttcctggtctccccacttattccttccccttcctccaagccagtcttttctccatccatcagtcagagttgatggtttttaaaattaagttagaaaatatcacgcctgctccaaattacccatggttccccatttcaaacaaaataagcgcctaagtcctttctatgacttctgaggcttcactgatctgtcctttgactcatgtacctggggtcctcatctcttcccactcttctgcctcactgcttaactaaacctgtctgatttctggtgggagatgggtccgagctcga

SEQ ID NO: 234863 - DNA, 1574 bp, Homo sapiens
  misc_feature (853)..(853): n is a, c, g, or t
  misc_feature (1026)..(1026): n is a, c, g, or t
  misc_feature (1094)..(1094): n is a, c, g, or t
  misc_feature (1501)..(1501): n is a, c, g, or t
aaaaaggagaggaggggctcctgggaacagggctcagaggcaggcgaggtccctgattcactcactcactcactcattcattcgttcccacacacactaagcagacatgtgcccagcacctcctttgtgccaggccccatctggatgtccatgccaggagagaggcaggcagacctgggcctcccaggatggaggacggacgaagaccactgagcatgatgagaggggaaaagctgaaatgtgagtgggaagctcctgctcaccacggcagccccctggctagcacggcctggcagagtccatatggaaggaaggaaccaggttctatgggatcatagaggagcggacgtgatgcagcctggaaaaggcgccctggagctgagggtagggatgccaataggcattagccaggctgtgggtgggaggtggggagaggggatccctgcaagaggcaccaaggcacaaaaagcagcttcctggaggggaggttcggaggtctctgagcatcctatgaaatcccatagtgcttggccttggatcttcccaggaagcatgagacccagccaagctgaggacgaggctcagactctggcaggcgcatggtgaccccttcctgaggacttccagagggatgggtggagaaggacatgagaggtgccttcctcccatcctctgccatcttggtacttggtggacaccgcatagggtcccccagtccttcctgcactgctctgaccctgtgaaaggaccatgagttggttgtactctgaaaagtctcccaaccccaatataggctgacccagcaaagactccgcttatcctcattttaccaatggggaaactgaggctcccnaccgtcaggtgactgccttaaggcgtcacaacaaactcacaccagggccgattccagggtgttccacttttccagtgactatcatcttgggccatggcaggcccgtgattggaggagatgagaaggaagtggggaagaacttggtcttcaaaaatagcaggcaggaaggatcnggatcagcacaggggattggacttgggggcttggaccttgatggtaggggacaggaccatgatggggntgaacagccatccaacctagaccctttttgctcctaacactcccatcccactctcagcataatgtagtgggaagtcaggagggttctgcagtatctgtgggaaggacccatcacggcctgtggtcttcctcgcctactgttggctcctttctttgagtcagaagcagctggctcaggccaggcggggtggctcatgcctgtaattccagcactttaggaggccaaggcaggtggatcgcttgaggccaggaattcgagaccagcctggccaacatggtgaaaccccgtctctactaaaaatacaaaaaaattagcttgacatggtggctcacgcctgtaatcccttagctactcaggaggctgaggcaggagaatcacttgaacctggcaggtggaggttacagtgngccaagatcgtgccattgcactccagcctgggcaatagagtgagactctgtctcaaaacaaataaacaacaac

SEQ ID NO: 234864 - DNA, 441 bp, Homo sapiens
tattccagatagccactcacgtaagtttatctttttaatgctgatgggggccaagaaaggagttcatttgcttcctggctgggaaattcaggaattgcattttgggcagcatattttatagtatgtgtgtaagtatttcactgcttttcctcagtttattttttgtgagagttcattgaaaatgtccaaggctgggcacagtggctcatgcctataatcccagctctttaggaagccgaggtgggaggatcacttgaggccaggagtttgagaccagcctgaacaacatagcaagaccctgtctctacagaaataaagaaggaggcaaaggcaggaggatcacttgagtccaagagttcaaggctgcagtgagctgtgatcttgcagttgcactccagcctggatgacagaatgagactttgtctctcaaaatgtatatac

SEQ ID NO: 234865 - DNA, 341 bp, Homo sapiens
ttctgaggtagaattcatgagaaaggggagagtcaatgaagtatcacactggattttctcaagcacttgaaaattaacatgaagggaacataaggtcccagaagaaagatggcctgtctaggcggaggaaaaataagctgacatttttgttttgtgcaaaatagtggggtttctgcttctgggtaggatggagtgaataaagatgaaacaaaaaaagaaaaaaaaaacagattaatttaaagtgtaagctttagaggctagagaggaatatataagctaagattccataaatagcccttgtgagaagtgagaatattaaacatttacacacagaacagaaa

SEQ ID NO: 234866 - DNA, 432 bp, Homo sapiens
ccatgcgtggtggctcgtgcctgtaatcccagaactttgggaagctgaggcaggcggatcacttgaggtcaggagtttgagaccagcctggccaacaaggtgaaacctgtctctactaaaagtacaaaaaaaaaattagccgggtacagtgacttgcgcctgtaatcccagctacttgggacactgaggcaggagaatcgcttgtacccatgaggcacaggttgcagtgaggcaagattgcgccactacattccagcctgggtgacagagcgagactccatctcaaaaacaaaaaacaaacaagcataatgataaaagggtcatttcatcaagaagataaagacatttctattttgaaatatatttttatggatattttgatacctgccgtttctttgtgttgggaacattacaattcttctcttctggcta

SEQ ID NO: 234867 - DNA, 3081 bp, Homo sapiens
  misc_feature (1269)..(1269): n is a, c, g, or t
  misc_feature (1362)..(1362): n is a, c, g, or t
  misc_feature (1442)..(1442): n is a, c, g, or t
cggattcgagcgtcggtaccccctgggccttgggaagaagggccttggccttgggaaaaagggccttggccttgggaaaaggaaattgccgtggacccccggaggccgagctttcccgtgagcgcgagatctgcccccctgcacatcccgcccttggcgaccagagtgggactcccgtccttaaaaaaaaaaaaaaaaaaaaaagacctttagaatttcatttgggttaaatattgcccccttcctgcagctttttaagatgcgcattcctctaacgggaatccatagtaattccctactttctttgcgaaagttattggatcttttccctcattagaaaggcccgagtatgtctgggaattaaactgccactcaaccccacatttacttacatctttaccaccgcgtctattcctctctcaccccgcccccatggcccaagtctttagcctggcattcacgtaccctcactggcaatcttggggaaagcctcagaaaatggtacagcagaaagcccagcgtggaggagccagttgggagactcagcatgtgggcaccctgcttctctgcgcagagcctcctctgtcataggtagatccagcccatctcaggttacactacagtctgtaacccctagcctctccctcctcgcgcccctctggcctccatcactgtcgtgccggtcgtggggacagatgggagggaattacggtatttacagctgctcttcgccggctcttgctcccccgcgtgtcgacaaccgaaactgcagcgaggcccagaggcctctgcccactcccctcggagttccaggaggacgctaagcgcgagaagccaggctcagggaaactgaacgcccatacgctcctagtccctctcacctggatcctctgcgtcaggttacgtgcttgcgctatttttccttttgtttctttaaatttttttttgtagagacagtgagcgtgtgtgtgggggggtggaagggtaggtctcaccattttgcccaggccggtctcgaactcgtgggctcaagccttagccacctgccttagcctcccaaagtgctgggactacaggtgtgagccaccacgcccagcctgtttgcgctgttttctgaggctttccgccaaattgctttctttcctggcaagaaagtcaccccctagaattggggtgtcccagtggactggccgggtggttggattgaaggatgtcctccaacctcaccttcagctgtggcctggctggggacccagcacgtggttcaangccatgggaatcacctgtttctcctttggagcgagtcacacctggaggccattctcaactctccacagcttgttgtatgtccctgagtgaagnattaacctctctgaatctcaggtgcctcctccgtacagtggagcttccatattctagcatttgcctcacagagttgtcantatgattacatgggatagtataggttgcaggtggagagctggaggataatcaccgccaccacactagggcactcattgtgtgcctgggcctaggcattttgaaatagccctattaaaaaaggatcatccacagataaattgaaggtcagagagatttagtgattgcatggggtcacacagccgagctaggactggactcagaaagacatggatacacaagtgctgggagatgtgggtggagtctgaggtctgtgagtttatagcaggtgtccccaacccccgggcaggaccagtatgggtttgtggcctgttagcaatggggctgcacagcaggaggtgagcagcaggcattactgtctgagctctgcctcttgtcagatcagcagaggcattagattctcataggaacatgaaccctattgtccccacatgcgataggttgctgcactccttatgagaatctaatgcctgatgatctgaggtggaacagtctcatcctgaaaccattccaatggccccaccccaacccatggaaaaattgtcttccagaaaaccagtccatggtggtaaaaagattggaaaccactggtttagagggtacctagggacctgaaaaataaactggccctgcctccctttggttaatgctttcttcctctaatggattattcatcacctctcaatccaatgcttgaggggccagggacctaaaagaccatccaggcctatttccttatggagagagggaaaggacttgtccagttccacagctgggcagtgcagatctggattggagctcaggtctcttagtcctgtgctcctgctgctccttcccccactgggtgagcagttctgcagggggctgccactcctacccacaatcaaactgctcacttatttggagcacctgttcaggagctgcccactgggtacccctgaccccacttggctgggagcttctgccactccctccctcctctcaagcagctgattgctctaagcagagaggaaaccagtgccattctggctcccaaatgctggtacaagaccagcaaatatttaccactcttgtgtgtgtgtgtgtgtgtgtgtatttttttcttttgttagaaaagggctagcgcaatatataacaagtgattcatggtggcgtcttctggtagattgattgtattttgtcccttctttttttttttttttgtttttttgagacggagtctcactctgtcgcccaggctggaatgcagtggcctgatctcagctcactgcaagctccaccttccgggttcacaccattctcctgcctcagcctcctgagtagctgggactacaggcacccatcaccacgcccggctaattttatatatatatatttttttagtagagatgggttttcaccatgttagccaggatggtcttgatctcctgacctcgtgatcctcccacctcggcctcccaaagtgctgggattacagacgtgagccaccgctcccagccccttctttgtattttaaaatttctttagtaatgaacaaacattaataagacaagaaataaaaagctgttttaaaatttctcttaagcaaaaggccaacaatcatttaaaaaatgagtgggataagaacagattgttctcagg

SEQ ID NO: 234868 - DNA, 232 bp, Homo sapiens
gtagagatggagtctggggtctcgcttttttgcccaggctgatcttgagctcctggcgtcaagtgatcctttcaccttggcctcctaaagtgctaggattgcagctgtgatccaccatgcccagcctccattctttgttctaaactttttcctgaagggcctggaggaagtcacacccacaggccagaccccacattcttttctgctgaacccaagtcttttgacaaagctt

SEQ ID NO: 234869 - DNA, 310 bp, Homo sapiens
ggagtctgtcccagtgtcattcctgggactggcccagcagtcccaggatttgtatcagtggatactgaggatttgttatcagtgaagtgggagaaccgcagcataggtactgcagggcgtttctgcaagcccaccagcctcctctttacttgcctttgttgcctcttgtgcattgctcctttttataaacgtcccagccaggcactggcgctccgcctataatcctagcactttgggaggccaaagtgagagggtcgcttgaggccaaactagcctgggtaacttagcaagaccccatctttacaaaaaa

SEQ ID NO: 234870 - DNA, 511 bp, Homo sapiens
acagtgctaaaaatgtgcctctggaaagcacatttatggtgttatcctcaccctgggagaagggaagaatggagttctttgcattgaactctctcctgaccccacaaatatcttttcacaattggtggacatttatacccctcttgttgacttttgtctctgttgtcctgttgaacgctgatctcattgcacttaaacgttcacccatgcaagggaaatgtcactaaatgctgctgcttgctgagctgttgattttgcattggatagagcactgtgataatggcccactgagctaatcttcacaggaaagaaagttacactcatgtggttactctccctctgtaaagcagatctgtatttagtcttctgtttctgaaacttgaaggcacatgtcataaaaatgttctgcatataaatgaaataatgtaaagcaattatgatgcttgttaagaatgcaatgattatgaaatgtggagtgttaatgaataaaatatattttaacttgttcaaa

SEQ ID NO: 234871 - DNA, 480 bp, Homo sapiens
ctgtgtgtcattgcaaagtcatagtttctaacctttgcctgttgtggtttcaggctagtactaaacaggaccagaggacagttgaagtttactctctataatcaagagtgttttgcatgttttctacccagcaaattaaattatttgcctgatgagcattatttcatgattcccttcctaaaaggatgaagcatctggaaaatctgaagaaccgtgtaattgacgtccatgtttattagtggactaagagaaaatcatttcctcttgccttacattctcagacttacagggtcacagcttctgctgttggcatatggggggctgctccctctgacctggagccagcgtgggtctttggcctagactctcagctggacgtgggccaggggttctctggttgcgtgaccatgtgtcccctttcctagccagggttcctgcttcctgttgcccaagtgctcaaactccaactcgagcttgtct

SEQ ID NO: 234872 - DNA, 401 bp, Homo sapiens
aaaataagacctcgatgaaccctgaagggcagcaggtggaggagcgtgtgccagaagtagaggtgagggaccagggccacgcaggagcagcctctgtgtgtaggggagctgtggtgtccagaacctgcaagaccccaggtctgggcagctgcagcagattccgcccatagtggggagatgggaaagtctgttgtaattcccagggccatgtgaggcggtgggcagagcttggagcggaaaggcgggtgtccccggggtttgcatcccgggggcaagcagtgaggtctccatcagcctcggcacagcgagagaactgctgagcctcctatgagtgagcgtcccgtggttcccacgcacgataacgtcctagaagtgctgatcttgcccccaggttccagccc

SEQ ID NO: 234873 - DNA, 364 bp, Homo sapiens
ctctagacaacccaaaatgatgcctggattaagctagagcagcagaaatctgtgtacctagactgattcctattgtcccctggaaacttgctttctactgatttgatgttggagttgtgcgaattgaaagtcccacgtcaggaagtgtcctagtccaggacaaacttgggcagttggtcaccctaccagttaggcatatgtctcagtaaaattcacatgtgcatctaacgtgaggccatgaatatctttgtgtgaattctcagaaggtaattctctctggtcttagtttctcctgagcaactgtgtatttaaccaaacgacctaaggttactgtgaattgtagaattgaagagtttactttttc

SEQ ID NO: 234874 - DNA, 266 bp, Homo sapiens
ccgcctgtaatctgactctcactgtagccatccctgattgaggctgggtccccgcctgtaatcctgactctcactgcacccatccctgatcgaggctggactctttggtgtctttgtttacggcggcagatgggaaatgactacaaataatcagatgtcttgtcgtctgatcgtttaccggcatgctgttcatgccatgctgactgtgtttattgccctaatggggtgattaaacattctttattaaaataaacaaagtcttagga

SEQ ID NO: 234875 - DNA, 500 bp, Homo sapiens
ttccacactgcagtagcataaagataatttcctctccagcaaacaattgtagtaaaaacaattccatgcacaaagtaaattgaggtattgagaaacagttttcattattataaagaatgaaataaggatagggagacccactggggcttagttccaatttcatgtagcatttttctcattcatttgttggacttattctgccagaatgtattttatgttaatataactaaatctaatttttacctctcgtgaagagactaggatattataacattcaaccacatattggtgattctcttctattacggtcatatctgctgaaattgttatatagctatttttttgcaaaatatattaagacattccagatttttaaagtggttctttagtagttaaatttaattagacttaggtagactaaccaaaaggaatagtagtacaaatacaaggtgatttgcctttaaataagagacagcattgtacttataggaaaataggga

SEQ ID NO: 234876 - DNA, 372 bp, Homo sapiens
ttgggcagggaaggagagtctcaggcatgtgagaacaaagaggcttcctagaattggccactttttgtggttgcatccttgttgctggttatgtcttcttgccccagtgactctagacaggggaggatcatttgaggcacacagagaaaaagaggcttccctgacagtattatttgctatagttcattctttttttacgtgttctgcctgcccacttcagtatttcttggtggaaagggagagtctcagggctgagggagagcagagtccttcctctggccaattatttttggcgaggcttccaattaatctctttggctggtagcgttgaacttgtctgatagttccagagggacatccgctcaatcagga

SEQ ID NO: 234877 - DNA, 354 bp, Homo sapiens
acagtaggttggcccacttggggtctgtctcagtggggttggaatcatggggctgttactcttattaagagcataggcggccgggcgcggtggctcacgcctgtaatcccagcactttgggaggccgaggcgggcggatcacgaggtcaggagatcgagaccacggtgaaaccccgtctctactaaaaatacaaaaaattagccaggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccatctcaaaaaaa

SEQ ID NO: 234878 - DNA, 335 bp, Homo sapiens
  misc_feature (143)..(143): n is a, c, g, or t
  misc_feature (326)..(326): n is a, c, g, or t
  misc_feature (332)..(332): n is a, c, g, or t
tttttgtagagacggggtttcaccatgatgcccaggcttaggagaatgctttaaaacctcacaaatagataaggaaaagacaaaaggcccaagagagaaatagcaaaatatataaacaggcaatttctgaataaaaacctgtnagtggcaaataaagaatgtgggaaggggcattattctcattagtaatccaataaatgaaatttaaacatcaatatgatactttatattacccacaaatttggcaaagatctataaaaattataatacccagtgttcctaagaaattataatacccaggcttaggagaatgctttaaaacctcncaaatngat

SEQ ID NO: 234879 - DNA, 416 bp, Homo sapiens
agagaaagttattaatttaaagagtgaccagatactacgaagctttcttagaaggcattcatttttcacttagtgactttggacagctggatggtctttatagaatatgtatgagctgcatcatctgcaattagtgttttcaagagattcttttagtgaatgtaagccccttctgtctcctctgtatctgactcagatttggaaacccctaacatggtttattttggtatcatgaaaaaaatattttccacgtgggagaaactagatacaggcataaaactgagatcacattacacctgtattcaggattctaaattgaaagtattagtcttaaaatttatcctgaaagtacatattttttagttttttccattaaagtgacctataataaatgaccagctcagtggcaataagca

SEQ ID NO: 234880 - DNA, 439 bp, Homo sapiens
agtaaattttgttcctaagtctgccatttttatgttaatctagcctatatcaagttggcaaattcacatgctaagaggggtgggcagatagtacaattaagtgaaactgtctgagtactgaaccggaggtgacaaagagagtgtagctgtaaagaaactacagatttgtgccctgctgtaggcaacagtaaggtgctagggaagatacttgagggaagcagcctgactaccttggttgtaactggtagggagtatttaggaaggattgaagccggatagagatttaaagacagagagaagaggttgcagtttcctaagtaagggttatgtcattggaaaatgaggggttggattagaaaggaaaaaaatgggtaggacttggacagaaataactgaagcctggtccattgtcactttggaaagtttgtaaaaaaaaaaa

SEQ ID NO: 234881 - DNA, 364 bp, Homo sapiens
gcagccagtgagtaatgagttttgtgtcttggaaggaagtgaaataaatatatcaagaagtagaaagcggctgggcatggtgactcacgcctgtaaacctaggactttgggaggccgaggcaggtggattgcttgaggtcaggagttcgagaccagcttggccaacatgatgaaaccctgcctctactaaaaatacaaaaattagccaggtgtggtggcaggtgcctgtaatcccagctacttgagaggctgaggcaggagaatcacctgaatccaggaggtggaggttgcgatgagttgagatcatgccactgcactccagcctggatgacaaagtgagactctatctcaagaaaaaaaaaaa

SEQ ID NO: 234882 - DNA, 451 bp, Homo sapiens
cagggcctggcatcaattagaagctaaatcaaatgtgtcgaattgagctgctgaattagttgtcatccagctcctgaatggatgggttgcagaggaaaagttctggagaaatactccacagtgtggtccatggatctgtgccagtctgcaaactgttactggtccatgatgattaagcagtttgcaccagaatgtttatcaatgcactgcttccttcattgagaaagtcttggtacaaaataaatagcaactaaactaatcagtgtacttagctacagagtagatttacattctggtacaaactgtttaatcatcatggactagtaataaacagttcatggactggctcctgtgagtagctctgttctgaactctagaggttggcaaaatacgacctgtgggccaaatctaggctattgcttgtttttataaataaaattttattggaacc

SEQ ID NO: 234883 - DNA, 748 bp, Homo sapiens
ttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaatcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaag

SEQ ID NO: 234884 - DNA, 1860 bp, Homo sapiens
  misc_feature (951)..(951): n is a, c, g, or t
cagtaaatgctccccccatcctctccaggcccaaaccactggaattgtcctttactcctctttctgtcttatattcatgtctgtcagctaatatacctgaccacttctccccaccttcactcctgtccacccttatctccttcacagaccattatggcaggctcctcagtgatctctctgctctcacccctgcccccagagtgttccttacatgcagctggagggatgctgtgagcacctgtatcaggtcatatccctcccctgctcagaacacttccaaggctacatcttgctcggggtaaaacccagagtcctctgcaaggccctgcattgtctgccctcatcacctctctgacatcatctactcttcttactccctgtgctccagccacactggcccgagggcctttgtgcttgctcttttctttgcctaaagaactcatctatcaaatagcccagacttgttccttcctctttaggtctcccctgagatgtcactgccttcctgagatcttccctcaccacccttctaaatttgtgacttatagtcacatctatctttgcttctttaactttatccttagcattaatcatattactgtttaacactctgtagaatttatctgtgtttatggtctgtctcccctgacccttacctctaggagactgttgacttcatcagggaaggggcttttgtctacttcctccgttatctccaacacatagaaaagtgcttggcacacagttagggctcagtaactacttatcaaataaactattgaagagcacatatctggatcccagcatggcagggactctgccgatcccctttctacagaactccaaggagctgccttaaagttttctgagggctcaagatattcaacaagtatttcaccttgcctcttctttctcctcagcattgggaacacagaagagaacaaaatattnccctacccctatagaacctacagtaatagggacagtaatttagactatcaaataatcacacgtgtgaaattaccaagaaaggtagagagtgttataagaatacttgataggaaatcaaatccggatcctaggaaatgaggtttgaggtgatgaaggagtaggcattaactcctttaagagataagagtttgggatggttggagcctagaggctgatgcagagcaagaggtcagaccttgtgtatgccataaggagtttgggtgtttaccccacatgtagtgggaagttgtagaattttaagctggggacaggagcgtggtcaggtgtttgtgtgtgtgtgtatgtgtgtgtgtgtgtttccttctaaaattcttcacactaaagtgtactttaaaagactcctctggcttctgtgtggggaattgactataaggcattaaggattaaagtagggagaccagtgacaaggctgttactgtggaattaaaatagctgtgattgaagacagccacacattctttgctgtttttcctatcaagaggtggagtctccttccttctccttatatctgagctggccctgagatttgttttgaccaatagaatacaatgaaagcaggctgggtgcggtggctcatgcctgtaatcccagcactttgggaggctgaggcaggtgaatcacttgaggaaaggagttcgagaccagcctgaccaacatggagaaaccctatctctactaaaaatacaaaaaaaaaaaaaaaaaaatagccaggtgtggtgcactcctgtagtcccacctactctggaggctgaggcaggagaatcacttgaactcgggaggtggaggttgcagtgaaccaagatcataccactgcactccagcctgggtgacagagtgagactctttctc

SEQ ID NO: 234885 - DNA, 722 bp, Homo sapiens
ctaaggcagctgcatctagccaaaatatgactctgaactctcacctctccttctccagtctgagcaagctctgtgcatggctggagaccctaagagtgtatctctgaaaaccccagaccaccccttgatttactgaccaagatccacacctactcccacctcggaatgtcagacatcataaatttgatggaatctagagaagagactcccctgcaggttgggctcatagtaatctcatctagagtaggttaaatatttctgagggaagaggagaagtaaactataaataaaccatcgctattcaggcctcccatcagttgctttcactgaagatggagaaatgtataacccactgctttaaatcagggctcttgtcacctgagctagaaatgtgataaataccaaagtatcctaaaaaggattatttaagaaagagttaaaaatatatagagaatatattttccagttatataccttgatttatgctttttatgcttatgttacctctcaaattgttaagagtttagcactttgaccattctgtcctgaattaaaacatatctatttcaaaactgcaaaatttcatattctatttttcctagcctacctatattcttataaaaaagaactaaattccaaccctttattcttattaaacatctcttagagctttagataaaagtataggataaagtcccactattcggcacgagcggcacgag

SEQ ID NO: 234886 - DNA, 668 bp, Homo sapiens
ctaaggcagctgcatctagccaaaatatgactctgaactctcacctctccttctccagtctgagcaagctctgtgcatggctggagaccctaagagtgtatctctgaaaaccccagaccaccccttgatttactgaccaagatccacacctactcccacctcggaatgtcagacatcataaatttgatggaatctagagaagagactcccctgcaggttgggctcatagtaatctcatctagagtaggttaaatatttctgagggaagaggagaagtaaactataaataaaccatcgctattcaggcctcccatcagttgctttcactgaagatggagaaatgtataacccactgctttaaatcagggctcttgtcacctgagctagaaatgtgataaataccaaattccagttatataccttgatttatgctttttatgcttatgttacctctcaaattgttaagagtttagcactttgaccattctgtcctgaattaaaacatatctatttcaaaactgcaaaatttcatattctatttttcctagcctacctatattcttataaaaaagaactaaattccaaccctttattcttattaaacatctcttagagctttagataaaagtataggataaagtcccactattcggcacgagcggcacgag

SEQ ID NO: 234887 - DNA, 2797 bp, Homo sapiens
  misc_feature (721)..(721): n is a, c, g, or t
  misc_feature (1836)..(1836): n is a, c, g, or t
aagaagatgcctggagcaggcagcatcctcaaatggaaggtaattgccctcaaatcacttaactaggatgacctactttgctttcctgtatagccaggtctgttatcagacccttatcttgggaggcatcgtgccagagcctggggcaagaaagggctgctatccaggaatgcaggtgaaattatagctattagccctgtcttagagtgtgaggaaaatgtgcccccctacccctggctaagtttgggttcccatgtcataaactgcctccctctctgatagctctgcataaacatcccaggaactcaaagtaacatttgatttcccaaagagaacatttgcatttgtaactgtcagaaataggagagatcatcaaagctaaatgaattgggctataaacagtttgaaatatgtctttaaattttaaaaaacatattttttgtttgttttggggagagaggatcatttagactcaacaacaaaacagaaaactgtgagtgccattttgagacaagacctacctggtccttccccctcatactttctgctaccccgtgacctccctctctccttccagtcacagattatccgcttggttttggagttttaaatgtgtggtcctgagagggagaggagagcaagagaatctcaagatagatttggaagattagggtaagacagtgagggtactagaagtgctttcccaagtgagtccccagangggagggaaaatatccatggagaaggggcagtgtggttggtcctggctaaagggcctgaacagcagaggctattgcagccctgcatagcacagggcaatggaataacttcataggcccccaaactgcatggaagcagatagggtcttagaagcacggggttgctttcctggacctggtgtggcttggaagccacaaaatgtttcctgtgcacctacaagagtgtaagaaaaccactggataggaaaggaccttgcagactggaatgagtcatcatgcagaccaaagtctacctcagtggatggcagtgtggatggatagggacagatgtccggatactgtctgtcgtgtgcactcccaccccagccttttggtattcctggtacaaagatataactcttaggaaaaacagaaaccctaaataggctgagattaagtttctttcacctggaagaatgaagactatggtagattttgagttataaaactcaaatttttgcatttcttgaacacctaagtctatggactgatattagcaccagctgcagaaataagcacagttctcaccacttttcaatttgaatgcagaaggagccttgtctggccatagctctgccctctacagtggaaaacataactttagtggaatttagagatctttgagtaaagacagaagaatagcaaagtctgttatttaccacctcactttttttgtacaaatatttgaaagcattttcgcattatacaatacaatttgtttctattttgaggcaaacacatctgttagaggaattattgcatttcttccccctagaaagctgtctccttaatctttccacaaagtcttgagaatgttagcttctttttctacattgttggaaatcacagcgtggtgttcctcctgacggcactcccaccttcatcattctgtgcttacagtttcaccacattccattgttctaatgaggtgactgagtggaagctgaggttagaagataaaacttagaacaggagcagcccttggctcctttcccttggagggtgcttcaaaagaggtgaagttttcaaagatagaacttcagggagagggttttgtgttccggcttcgaagtggcanttctttcctgagttgtcacctggactatcttaccatatttcctggttgaatgattcctctaaatcttatcttagcctggccaaatatccctggtccctttgatatctaagttttctggccaagaagcaaattcctgtagttccaaatcagtagctcaagttcctgggtcagactacccgcaggccctcaagttgctgtctggttgtcgtctaaaaagttgatgtcacaggccagttgatatcaaagagtcctgggtttaaaaactgactcaggacttctaattgtaaggccttacacaagttatgtgacaattcttaacctaagtttcctcagctataaagtggggattatagcaatatcccacaatacctctgacaatgaaataatgtgtatatattgcttggcaccggatatggtttggatctgtatccccatccaaatctcatgttgaaatgtaatctgttatgttggaggtgggacctggtgggaggtgattgaatcatgggggtggtttctaatggtttatcactgtctccctagagctgttctcatgatagagttctcgtgagatctggttgtctaaaagtgtgtggcacctccccaccccacttttcctcctgctccagcaatgttcaatgtgcctgcttcctgttcaccttctgccatgattgtaagtttcctgaggcctcccctgccatgcctcctgtacagcctgtggaactatgagccaattaaacctcttttctttataaattgcccagcctcaggtattctttatagcagtacaagaactaatacagcacctaataggcattcaacaaatagtaattccctgctccttctgcctaagcagacatgcatgggtttgtgtatctaaactgtaggactttacaaagactaaaatggaattttttgaggcatttcactataatcaataaaataaagtatttgtaatcatgtt

SEQ ID NO: 234888 - DNA, 2751 bp, Homo sapiens
  misc_feature (721)..(721): n is a, c, g, or t
  misc_feature (1836)..(1836): n is a, c, g, or t
aagaagatgcctggagcaggcagcatcctcaaatggaaggtaattgccctcaaatcacttaactaggatgacctactttgctttcctgtatagccaggtctgttatcagacccttatcttgggaggcatcgtgccagagcctggggcaagaaagggctgctatccaggaatgcaggtgaaattatagctattagccctgtcttagagtgtgaggaaaatgtgcccccctacccctggctaagtttgggttcccatgtcataaactgcctccctctctgatagctctgcataaacatcccaggaactcaaagtaacatttgatttcccaaagagaacatttgcatttgtaactgtcagaaataggagagatcatcaaagctaaatgaattgggctataaacagtttgaaatatgtctttaaattttaaaaaacatattttttgtttgttttggggagagaggatcatttagactcaacaacaaaacagaaaactgtgagtgccattttgagacaagacctacctggtccttccccctcatactttctgctaccccgtgacctccctctctccttccagtcacagattatccgcttggttttggagttttaaatgtgtggtcctgagagggagaggagagcaagagaatctcaagatagatttggaagattagggtaagacagtgagggtactagaagtgctttcccaagtgagtccccagangggagggaaaatatccatggagaaggggcagtgtggttggtcctggctaaagggcctgaacagcagaggctattgcagccctgcatagcacagggcaatggaataacttcataggcccccaaactgcatggaagcagatagggtcttagaagcacggggttgctttcctggacctggtgtggcttggaagccacaaaatgtttcctgtgcacctacaagagtgtaagaaaaccactggataggaaaggaccttgcagactggaatgagtcatcatgcagaccaaagtctacctcagtggatggcagtgtggatggatagggacagatgtccggatactgtctgtcgtgtgcactcccaccccagccttttggtattcctggtacaaagatataactcttaggaaaaacagaaaccctaaataggctgagattaagtttctttcacctggaagaatgaagactatggtagattttgagttataaaactcaaatttttgcatttcttgaacacctaagtctatggactgatattagcaccagctgcagaaataagcacagttctcaccacttttcaatttgaatgcagaaggagccttgtctggccatagctctgccctctacagtggaaaacataactttagtggaatttagagatctttgagtaaagacagaagaatagcaaagtctgttatttaccacctcactttttttgtacaaatatttgaaagcattttcgcattatacaatacaatttgtttctattttgaggcaaacacatctgttagaggaattattgcatttcttccccctagaaagctgtctccttaatctttccacaaagtcttgagaatgttagcttctttttctacattgttggaaatcacagcgtggtgttcctcctgacggcactcccaccttcatcattctgtgcttacagtttcaccacattccattgttctaatgaggtgactgagtggaagctgaggttagaagataaaacttagaacaggagcagcccttggctcctttcccttggagggtgcttcaaaagaggtgaagttttcaaagatagaacttcagggagagggttttgtgttccggcttcgaagtggcanttctttcctgagttgtcacctggactatcttaccatatttcctggttgaatgattcctctaaatcttatcttagcctggccaaatatccctggtccctttgatatctaagttttctggccaagaagcaaattcctgtagttccaaatcagtagctcaagttcctgggtcagactacccgcaggccctcaagttgctgtctggttgtcgtctaaaaagttgatgtcacaggccagttgataaggccttacacaagttatgtgacaattcttaacctaagtttcctcagctataaagtggggattatagcaatatcccacaatacctctgacaatgaaataatgtgtatatattgcttggcaccggatatggtttggatctgtatccccatccaaatctcatgttgaaatgtaatctgttatgttggaggtgggacctggtgggaggtgattgaatcatgggggtggtttctaatggtttatcactgtctccctagagctgttctcatgatagagttctcgtgagatctggttgtctaaaagtgtgtggcacctccccaccccacttttcctcctgctccagcaatgttcaatgtgcctgcttcctgttcaccttctgccatgattgtaagtttcctgaggcctcccctgccatgcctcctgtacagcctgtggaactatgagccaattaaacctcttttctttataaattgcccagcctcaggtattctttatagcagtacaagaactaatacagcacctaataggcattcaacaaatagtaattccctgctccttctgcctaagcagacatgcatgggtttgtgtatctaaactgtaggactttacaaagactaaaatggaattttttgaggcatttcactataatcaataaaataaagtatttgtaatcatgtt

SEQ ID NO: 234889 - DNA, 1650 bp, Homo sapiens
cactccttcccttccctggttcctcaaggcacggctcccccaggcagatgaaagcttaatagagttttgcgacatgaaagtcagtcggaggaaagagccttgaacagttgtgcgtgagagagaggcaagcgcccgaaattattttacgacaaaggcagctctctctgccacagaggcacagaggagaaaggagcccaggaaacgggtcatttctttcgtggaaaaatggaaatgctctgaagcattttgggagacgtgctgtgaagcaggtgacaccagaagacaaggacactgggggctccctgccgggaggcgcaaaaagcaactcccgttcgagggtcagaggagcctggatgctaatgtctctccaaagtgacttggagccaactgccggaaaggccatgcccttaggagcacaggcaggtcccagctcagggatcaagaggtctgctgtgtgaccttcttcaagttcctgaccctctctgggctgcagtcaccttattcagaaaatggagaggctagacaagaaaatgatgctaatctcacccttttctgggctggcattttattgagcacctactaggcgctgggcattttgctaggcccttcgtgcacactgccatgagaaatccacagcaaccccagagatgggttcatcaataactcaccagcaaatacttcctgaggccccactgtgtgccgagcatgggcataggtactgggcacacctcgatgaacaagggaggtaaggatgtgactctcctagaactttctgtcgagaagaggagatggagaataaacatggaaacaagcaagatcattctggagaaaatgcaatcagatgatgtgctagatggtaacagagagaggtcgaatgagagagagggccgtgacagcctctctgagaagctgaaatccaagcagaacctgaaagacgaggagaaactcagatacataaagactgggaaaagcattcaagtagagggaacagtgcgtgcaaaggccctgaggtgggtgcagtagataccacaggccccctcactcgagaccactccaagcacctcctgccctcttgtgccacagagctcagaaagctaaagcaatgttccccagaggtcctgtggccaaggtcctgcatgggcctgggtgacccctgcagaagcttctgagcaagactgagcagggaaagaaaggccatgtcagaaaaccatcctccagcgagcatggaggcagagagtctcatcctggcatcccaggtgctgagcagagcagacagcagcagaggggctccctagagcagctgggggccctgcctgtgccgtcgctctttcccctccctgccctctggtctgacatcccattggcatcacacacgatgcctcccggaggtgctcttgtgcacacagcaggtcaaagtgccagagaattagatcctgtcctcttgggaacagccctcagccagcagtgagcccttaggaggatgctccaagctctatcctccccgggtccagaggccctgggatggagcgccattgtggaagcagtgacaacttgatgaagctccctgggctggccccttcctctctgccttgttccccgttccctgcagtcctgcaatcacctcccaaataaaccatgtgcccttgctgg

SEQ ID NO: 234890 - DNA, 2667 bp, Homo sapiens
  misc_feature (1201)..(1201): n is a, c, g, or t
  misc_feature (2165)..(2165): n is a, c, g, or t
  misc_feature (2271)..(2271): n is a, c, g, or t
ataactgactcatgagtctataacaggatggtcagttgataccggactgcggaatcctaaaagcccgcagagtaaaaccggaatcttagtcatagcccccattggaaggggatctgttagtgatccccattggaaggggatctgttagtgatatgatatgtccttcttttagcgcactagtgtgttctcatctcctgcatagatgcacgggttcatcttcacgtaaaaattgacccctaacaaacctgtgtcaaagaacagttttcatagcatatatagagggaagaattatagtagtctttcaacaaaagtaacaaaaccttccattgtactggattttttagcagcctgaaaaacatttctcaagacttccctgtcagaatcatctgatgtagagtgtttctgtgcgttcttagtttttctatgcgatgttaagttttggaggaactagaaatgtttgaccagaggcacccacaatcaggtttccagtatctcaaagcttgtcttgtggataaggagaaaactcaacgggcacaactaggaccaataattgggagtgtgagggtgacaggtttcagttcagtatctgaaaattaggctactagagctgcccaactgtggaacaggctacctgaataggtactgagcacctcatcccgggaggcattcaagtagactctggctgactgccttgatgacagtgttggatgagaagctgtattagtctgttctcgcactactgtaaagaaatacctgagattgggtaatttataaagaaaagaggtttaattggctcatggttctgcaggctgtataggaagcatggctggggaggccacaggaatcttacaatcatggtagaaggcgaaggggaagcaagtacctcttacatggctggtgcaagaggaaaagagagagggggaaggtgctacacgcctttaaacaaccagatctcgtgagaactctattgagagaacagcaccaaaggaatggtgctaaactattcaaaagaaatcacccctgtggtgcaatcacctcccaccaggccccacctccaacattagggatcacaatttgacatgagatttgggtggggacacaaatccaaaccatatcagaagctgcttttactgaaaggcctctccagtcagaaaactggattgtcgagtgctccaataagcagagtaattctgggttcttnggtgctaaaaaaaaaaaaaaaaatagaggagattactctccttgaacaaaatttgatctattgaaaaattttaccttggattttttttcacctatttctatttaaactttaccgaaaaaaaaatcaaggaatcatttttcttctccatgctcccctggattcttcaaacaaaggaaaaattttagtaggggttaggtgagggaggagtgagtgctaggactggatttgaaaaggtcagttgttgaagaaggaaaacagaggcaataattatttaaaagcatggttgcccaaatgtgattttcagtactggttttggtgatggcgggagaaaattcaagtagggctccctgacttgcaagtaacaaacacttctgccttttctagttcccacagacctacccccaacacacacacctatcaccccatcaatccaccactgctctttgattttctcataacagtaaagagaatgcaaacaaatctttccttctgaagcccaaaactggatcttaaaatcttaaaagttgggccatgagcggtaaggacaccagaagaatctaaaatgcctgcttaaatcaggcagtgaatcttatggagtctacagcagggtttggcaaagtaggcccaccacttgatcatacaaagaaagttttgttataacacagccatacccatttatgcagtgttttggcagctttcacaccatgatgatgacttgactctatatgacaaagaccatagggccttcaaagtctgcaacatttactatgtggcccttaacagaaaaaaaattgccaacctctagcttagggcagtggttctcagccctggctcagtgtcagaatcacctggggtacattaaaaatagagatgccaggctgggcgtggtggctcatgcctgtaatcccagcactttgggaggccaaggtgggcggatcacgaggtctggagttcgagaccatcntggcctatatagtgaaaccctgtctctactaaaaatacaaaaaatgagccggacatggtggcatgcgcctgtagtcccagctacttgggaggctgaggcaggagantcacttgaactgtggaggtggatgttgttgcagtgagccgagatcatgtcactgcactccagcctggcgacagagcgagactccgtctcaaaaaaaaagaaaaagagatgccaggctgggcatggtggctcatgcctgtaatcccagcactttgggaggccaaggcaggtggatcacttgaggtcaggagctcgagaccagcctggccaacatggtgaaaccccatctctactagaaatacaaaaaattagccaggcatggcggtgcatgcctgtaatcccagatgctcgggaggctgaggcaggagaatcgcttgaacctggaaggtggaggttgcagtgagctgagactgcgccactgcactccagcctgggcaacagagcctgactccatctc

SEQ ID NO: 234891 - DNA, 2553 bp, Homo sapiens
  misc_feature (1087)..(1087): n is a, c, g, or t
  misc_feature (2051)..(2051): n is a, c, g, or t
  misc_feature (2157)..(2157): n is a, c, g, or t
aatgttggtgaaagatactataattcttccctctatatatgctatgaaaagcgttctgtgacacaggtgtgttaggggtcaatttttacgtgaagatgaacccgtgcatctatgcaggagatgagaacacactagtgcgctaaaagaaggacatatcatatatagagggaagaattatagtagtctttcaacaaaagtaacaaaaccttccattgtactggattttttagcagcctgaaaaacatttctcaagacttccctgtcagaatcatctgatgtagagtgtttctgtgcgttcttagtttttctatgcgatgttaagttttggaggaactagaaatgtttgaccagaggcacccacaatcaggtttccagtatctcaaagcttgtcttgtggataaggagaaaactcaacgggcacaactaggaccaataattgggagtgtgagggtgacaggtttcagttcagtatctgaaaattaggctactagagctgcccaactgtggaacaggctacctgaataggtactgagcacctcatcccgggaggcattcaagtagactctggctgactgccttgatgacagtgttggatgagaagctgtattagtctgttctcgcactactgtaaagaaatacctgagattgggtaatttataaagaaaagaggtttaattggctcatggttctgcaggctgtataggaagcatggctggggaggccacaggaatcttacaatcatggtagaaggcgaaggggaagcaagtacctcttacatggctggtgcaagaggaaaagagagagggggaaggtgctacacgcctttaaacaaccagatctcgtgagaactctattgagagaacagcaccaaaggaatggtgctaaactattcaaaagaaatcacccctgtggtgcaatcacctcccaccaggccccacctccaacattagggatcacaatttgacatgagatttgggtggggacacaaatccaaaccatatcagaagctgcttttactgaaaggcctctccagtcagaaaactggattgtcgagtgctccaataagcagagtaattctgggttcttnggtgctaaaaaaaaaaaaaaaaatagaggagattactctccttgaacaaaatttgatctattgaaaaattttaccttggattttttttcacctatttctatttaaactttaccgaaaaaaaaatcaaggaatcatttttcttctccatgctcccctggattcttcaaacaaaggaaaaattttagtaggggttaggtgagggaggagtgagtgctaggactggatttgaaaaggtcagttgttgaagaaggaaaacagaggcaataattatttaaaagcatggttgcccaaatgtgattttcagtactggttttggtgatggcgggagaaaattcaagtagggctccctgacttgcaagtaacaaacacttctgccttttctagttcccacagacctacccccaacacacacacctatcaccccatcaatccaccactgctctttgattttctcataacagtaaagagaatgcaaacaaatctttccttctgaagcccaaaactggatcttaaaatcttaaaagttgggccatgagcggtaaggacaccagaagaatctaaaatgcctgcttaaatcaggcagtgaatcttatggagtctacagcagggtttggcaaagtaggcccaccacttgatcatacaaagaaagttttgttataacacagccatacccatttatgcagtgttttggcagctttcacaccatgatgatgacttgactctatatgacaaagaccatagggccttcaaagtctgcaacatttactatgtggcccttaacagaaaaaaaattgccaacctctagcttagggcagtggttctcagccctggctcagtgtcagaatcacctggggtacattaaaaatagagatgccaggctgggcgtggtggctcatgcctgtaatcccagcactttgggaggccaaggtgggcggatcacgaggtctggagttcgagaccatcntggcctatatagtgaaaccctgtctctactaaaaatacaaaaaatgagccggacatggtggcatgcgcctgtagtcccagctacttgggaggctgaggcaggagantcacttgaactgtggaggtggatgttgttgcagtgagccgagatcatgtcactgcactccagcctggcgacagagcgagactccgtctcaaaaaaaaagaaaaagagatgccaggctgggcatggtggctcatgcctgtaatcccagcactttgggaggccaaggcaggtggatcacttgaggtcaggagctcgagaccagcctggccaacatggtgaaaccccatctctactagaaatacaaaaaattagccaggcatggcggtgcatgcctgtaatcccagatgctcgggaggctgaggcaggagaatcgcttgaacctggaaggtggaggttgcagtgagctgagactgcgccactgcactccagcctgggcaacagagcctgactccatctc

SEQ ID NO: 234892 - DNA, 397 bp, Homo sapiens
gggggtaagaacccagaaggtaaaataatgtctattaatcccagcagtataagaaaacagctttgtggatattaagatttgcagcagtttgggctaggagaataataattgggcatcaaagcattgcttctcaagcttgaatatatgcaaatcactttgttaaaatgcaaattctaattcagaaggtctgaggtgagtccctagaacttgcatttcttacaactgcccacctacactgatgctgacagtactggacctacactgagtggcatgaatgtaaagaatctacattggagttatgtatataaatacagttttatcactggagtgcagtgagccgagatcgcaccactgtactccagcctggcaacagagtgagactccgtctcaaaaaaaa

SEQ ID NO: 234893 - DNA, 402 bp, Homo sapiens
gggggtaagaacccagaaggtaaaataatgtctattaatcccagcagtataagaaaacagctttgtggatattaagatttgcagcagtttgggctaggagaataataattgggcatcaaagcattgcttctcaagcttgaatatatgcaaatcactttgttaaaatgcaaattctaattcagaaggtctgaggtgagtccctagaacttgcatttcttacaactgcccacctacactgatgctgacagtactggacctacactgagtggcatgaatgtaaagaatctacattggagttatgtatataaatacagttttatcactggagtgcagtggcgcagtctcggctcactgcaacctctgcctccaaggttcaagtgctcctgcctcagcttcctgagt

SEQ ID NO: 234894 - DNA, 383 bp, Homo sapiens
attctcccacctcagcctcccgagtagctgggactacaggcgggcaccaccattcccagttaatttttatatttttagtagagatggggttttaccacgttggccaggctggtctcaaaactcctgacctcaggtgatctgcctgcctccgcctcccaaagtgctgggattacaggcgtgagccaccactcctggccttaaagctgtattttcaaatcatcaggttgtagatgatatttaagaggctgtatgaggtcacctgggaaggtctagcacaatttcattttattaaagtatgtttctcttcttctcagcttgcctatctcaggtttagtctatggtttcttaaggaatagtttctccggttgttcatttaaatggtt

SEQ ID NO: 234895 - DNA, 340 bp, Homo sapiens
gtttgttgatgggcagacagggacacagctgaggtattcaacaagggccctgagagagggacaggcagcccctgtgaatcttgctgttcagcagagacaggagtcagcacgtgtgagggcagcagggaagtcttcctggaggagtgagacctggcgatgaggaggcacggcagggaggtggaacaggcaggagagactcttcaggaattgaggagatagaatagaggacactaaagccttagagaggccaggggtggtggcttggcaggatcatcgcttgaggctaggagtttaaaagcagcctgggcaacatagcgagaccccatctctaaacacaaaa

SEQ ID NO: 234896 - DNA, 210 bp, Homo sapiens
aagtgtgagccatcacacccagcttccctgagcctttatacagaactcgcctttgagttaggttctgttgtatattctagttagggcattatattgattttttaaattactatcattctgaattaataacaaattgtggtacattcatacagtggaatagaactcagcaataaaaagtaatgaggggaggtggggatggttaatgggtac

SEQ ID NO: 234897 - DNA, 497 bp, Homo sapiens
tacaaaatataaacctgtacgctaaaaaggtacattttactctaaggaaataatacctcaataaaggaaactgaaaaaaatgtgcaagtagaaatggaaacctctatagtaaagctacaagataaagttgaagaaatcacccagaaaatggagccaaaaagacacaagtgaaaaaagagagaaaggatgtaaaatgtgaaatgcccagtccatgagggtcaaagtcaaaataaaataaatttctgaaagaagaaaaggaaatcatgaaacaactcaagaaaaatgtcagaacaccagaacacaagttttcacttttaaaggtcttagcaagtgcccatcaggacagaaaccgtagataaacaaaaagatcttatatgtcttcaaacagtcaaattaacaagaataaataataaaaattgcttcagacttttaacaacaatcctagaagccagaaaacaatgaagaaataaatgttaaagaaaaaatttcaagcatag

SEQ ID NO: 234898 - DNA, 1602 bp, Homo sapiens
  misc_feature (1125)..(1126): n is a, c, g, or t
  misc_feature (1147)..(1147): n is a, c, g, or t
  misc_feature (1239)..(1239): n is a, c, g, or t
  misc_feature (1306)..(1306): n is a, c, g, or t
  misc_feature (1413)..(1413): n is a, c, g, or t
tttctctgacactggacatggtcatataaaatcaggtatagaaccttttcaaagacttcaaatggattaatctcagaaaatttaggtggaatttttggatttcagattatttacttccttgtagttataattgacttggattagtaggtgcacacaatgatttttatctgttaaggtaaaagataatttttaatgtgacaaaattttctttaaaaattttaattggaaagtaaaacatttcctttaatctacatgacatacttcatccttaagctccttgagagcagagagaccctatcttatcatctctccattggtaccacataacccacaccattcctatttattgataccaataatcctttcaatgtaactagtaggcttttgagtatatgcacaaaactgtaactctactaataagctcttctgcctatgagacattatcgctttggatcatccttatttccataacagtttgttccattctgccattacaatgccaggatgtaaagctccaggggtgcaggaatctttcttttttgtttactactctatctccagcatctagaacattgtctggcacaggtaaccactcagtatttgttgaatgtatgaatacattttttttaagacacaatgacaaaatggctgcagagactgcttttgttgtatgggatgaagacctcagatttagtgtcagaaaatctcaatgactgtcccaagcttgctatgaatttactgtgtcatcttaggtgtgccacttaatctctctgtgcttttcttatatatgaaatgattatgttagatctgaggcatgataaacttccatcaacctttaaaggtacgtaattctctgcttcatgattagcagcatgcattttccaagtggctgtctgggaacagagttacattttgtggcagtggaaccagcattgccaactggcatacacaggctcggaagtaagattttggtctctttggcagctaaaaatttggctctaacaaatgaactagtcaccaacctgattttttaaaaaataaggctcttctatactttggcatagaaaatttatttataagaacagggaaaacttatgttcattgcagcactattcacaatagcanngacatggaatcaacccaaatnctcatcaatggtagactggataaagaaaatgtggtacatatataccatggaatactatgcagccatgaaaagaaatgagatcatgtcctttncagggacatggatagagctggaaggcattatcctcagcaaactaatgcaggaacataaaaccaaacnccacatgttttcattcataagtgggagttgaacaatgagaacacatggacacgtggggttggtcggggaaacaacacacactggtgtctgtcctggggaaaggtggngggagggagagcatcaggaagaatagctaatggatactgggcttactacctaggtagtgggttgatctgtgcagcaaagcaccatggcacatgtttatctatgtaacaaacctgcacatcctgcacatgtaccccggaacttaaaagttgaagaaaaaaataaactgtggaatgtattgttcagccatt

SEQ ID NO: 234899 - DNA, 433 bp, Homo sapiens
gagagagggtaagagaccgaggatagaaagagaaagaaagtttggcgacagggtagctggaagagagccttgaaattaaaggacagatttaaagttgaaatccattccatacccaccactctgatggttgaatttcctttcctggcccatgcaccaaaatgatacggctctaatgagtgggggaacaccagggttcttggtcctcatgccagtttagataaaatgacttgggcacacgtggagtggttttaaggagcagaaggtttaatagataagaagtgaagggacaagtgaagggagaagacagaaagaggaagctccctggtacagagacagagggagggggctccaaagccaaaagaggaggtccccccagtatacagatcttataaagcttctgtcagatttatcagtaagttccatatatatatat

SEQ ID NO: 234900 - DNA, 461 bp, Homo sapiens
aagatagattaatgagagaaaaagcgtgcaatttttgctaatatttatatgcacaagagttcacagaaaagaagtgaaactcaaagaagtagttagacttctagtttacatataattttaataaaggaaaatttgaacttcaagggatgataaatcatggggaagtaactaggaaatatatgggggaaactaacagaagataaaggttcttttcctaaggtctgttatgcagatttatcttggtgccaactctccatctctggtgatataagttgctctccttttcctgatacaggagatagacaccataacaaagggaaactcatgcccaacttctaggcagataaagggagggtggagaactcttctacatctgttgattttcagttgcctttgggtcaaaataaaccttacgttaaagtggcatattttggggtagcgtatcctgatccccttcaagt

SEQ ID NO: 234901 - DNA, 409 bp, Homo sapiens
agggtaggtagggcttcctctgaaactggttgtatctggtaagtaattgtcccatgtctcccacttgaagcttaaacttggccgtaggaggtccttatgcctgtaatcccaggactttgggaggccgagctgggcggaggattgcttggacacaggagtttgagaccagcccagggaacatgaggaaaacctgtcaatacagaaaatacaaaaacattagccaggcgtggtggtgcacgcctgtagtcccagttactctggaggctgaggtgggaggatcgcttgagcctgggaggcagaggttggggtgggcctcatgattgtgccactgcacttcaatgtgggtgacagagtgagaccgtctcgaaaaaaaagagaaaaggagccaatgatagcagctatgtttgtt

SEQ ID NO: 234902 - DNA, 748 bp, Homo sapiens
aggtggtgcactcacctcggcctcccaaagtgatgggattacaagcgtgagccactgcacctggcctcccatggtgttattatttttttaacatttacagatttttattgattcaatacatatttgaatatccactatgcaaggctactgtgttaagcaccaagtttactggtatgggaaagatagttgaaagcctcgtagaggatatattgcatcaaaagaaatggcaggcgtggtggttcacgcctgtaatcccagcactttgggagaccagcctggctagtatggtgaaaccccatctttactaaaaacacaaaaattagctgggcgtagtggcgggcgtctgtaatcccaactactcaggaggctgaggcaggagaatcgcttgaaccctggaggcagaggttgaatgagctgagatcgtgctactgcgttccagctcgggtgacagagcgagactccatctcaaaaaaaaagaaaaggacacgtgttcagcaactaagaagtcatttttatatacacgtgctaagtgccaccagtgtgtggcctttgtgtgtgggggaggagtgaaagatgctgggaggccggtcaaggaaggcaccttgtggaagtgacatttgagctaatagctgaaggatgggtgagaggaaagaaaaagcgtcagaaaacggcttgtacaaagaccctgaggttggagagaggtgtgcgtccaggaaaatgagaaaagcacagtgtttggaggaagaca

SEQ ID NO: 234903 - DNA, 654 bp, Homo sapiens
tttttaggtcaggaatttgggatgggcttgtctgggtggttcatcttggatccacgtgctatcagctggagtggctggaccagataatccatttccacagtggcctctttactcacaatgtcttcacaatccttggtctctctcccaacccggctgccaaataattataatctttttggagtttgtttgtttgtttgtttgtttttgagacggaatcttgctctgtcgcccagactggagcgcagtggcatgatctcggctcaccgcaacttctgcctcccgggttcgagtgattctcctgcctcagcctcccgagtagctgggattgcaggcatgtgccaccgcacccggctaattttgtatttttagtagagatggggtttcaccttgtaatctttctgatgtttttactttatacattgaaaaatgtttaagaagcagtctataaactttctgtattccaagaagtcctgacacaaagatactctgagccagaagatctacagtccatggagaattgtgtgagcttaatggagaagtaagaagtggtaaatttgagacacatttgaagtaaactaataggattttctggaattagatgtgggataagagaaagaaaataaataagggctattcttattgttagattgtttt

SEQ ID NO: 234904 - DNA, 302 bp, Homo sapiens
ttcggcacgagggctgctgccttttttcccaccagaggcttcttctgcttcttaacactgcgcatatgtgtatttctctccctccaggaggacgctgctgcgcatgcggttgggaacaaatgggcggggatttccccggaagtctccctttatggagggttggggttgggcgctccgcagtcctcccagggccgctctgaccggccgctctgtaacttctcgcctcctcttcgccgtccctcccacagcggctgctcggctcccgccccctcgccctcccacagcgggtcttcccgcggccg

SEQ ID NO: 234905 - DNA, 508 bp, Homo sapiens
aacccaggtagaccgactccatactcctagccaacaggctgtactgtctccataagaccaaatattgtcacatgctgacacaaatatgctaatatgttaacaattacccaatctaagtggaagacgtggatatgtactgaactattttttctttccttaagggattgctttaatttccttttttggagttttcattgatagtgtttagagacaccactgatttttatatattgatcttgtatccaacaactttgctgaaatcatttattaactctaattatttgtttgttcgagatggggtctcactatgctgcccaggttggtctcaaactggtgggctcaagcagttcttcctcctcagcctcctaaatagctgagataataggtgtaatgccactgcacctggcttgaactattctttcatttctggtaaatggttccaataaaacattagggggaaagaaaataataatttagaaaaaaattattaaaaatgctaatgcgaaaa

SEQ ID NO: 234906 - DNA, 372 bp, Homo sapiens
aatacgctagatacactgcaggaagcctaagagtaagaaatgcaacagcccaattagatgctggtgaatgctcaatcccttttcctggagagaagccattaagcctgctctgctgagctccatgagatcacatgttattaaacttcgtctttgccattcacctgagacactaacttataggcaatccaagaatgagttgtgacagcctgtctctctacccaggtggtaatgcttagtgccattcccaatgtacataaaggagatgtctctgttgtggtatcttaatagatcctgtagttcccacatgttttggtaactgtttgatataattactgtgtctcataaaaaataaattttttttaatacagtaaa

SEQ ID NO: 234907 - DNA, 2318 bp, Homo sapiens
ctggtaaagcagcggccagggggagccgtgagtgaggcgctgcctctcccgctgaagcgggttccaaggccaccgtgagggggaccatccatccaggagagtactgggcaggctgcaaatgtctgtgttaaaacagctctgctgggctaagacaggacagaagcagacagcaggtggatgagacacaatttcctatccagcagaacctgcagcaagctccacagcaccctccatgggctcagtcttgctcccgggaagatggttaattccatcagctccttctggccggcagcaggaagagtggccctgtgtgtgccaggccctgcagtctctcctctcagctggtgtctccagtgagggacctgagtcatcgcacacatgagcctgtgctcagcctgcacatctcccgcctcccaccagctgctcctcaactgccagggccagactgtggcaaaatctcactcctctgccgatgctggggtttccctcgtgtctgggaggtggtgtgcttggtggcctgagcactgcagtgaatccatgtttccctcccagcaccctgttctgtcctccaacttggccgacagctctggccagggacgcagcccagctggtgcccaccccgcactctgtccatttcataagagcccttggtttcctcacttccctcagattttgccaagagaatggtcctggtgtggcccagaaaggccagcggggtgcagcctgggactgaaagcagaggcggctctggtggggaaaaagtagctctcccagcctagccctactggtgggcggcacctcctggctccaggccatcttttgtcccagtcctaggtaagaaaaacacaaacaaaagccagtcccatggcactcgagaagcaggaggccgttccctgacagcaacatgctgtgtgcacagacacacgggtggacaggaggcagagctcggggttgctgcggagcgggcaggacactggagcggcaggcagtgcggacccgccgggcagccgtgcacggttgtcgtcctcagcggcaggagccagtttgttgctcagggccttgtctttttacaaagagccccaggccccgggggcttctctgggtgcctctttgctgccatgtctgcacgcgggcggagagcagaccaggctaccgaccctctcgctttgctgtcttcacgtggaaaagccagtgtcgtagccccaaaggaggggaaactgtattgatttggggagcctctatgttgatttcaaaacagattgtctcctgtgttctcaaagactggaagcgaaccccacaaccgccttaggccacaaaagctttatcctttctaattagcatccctgtgacctgctctgcgccctgcagatattttgctcagccagccagaaggagggaggccagacaccagcccccacagacctgcggctgcgaccccctgcctggggacgatggggtcggggtccagtagctgccccagaaacaagtggggctgcaggaggctgatggtgagcttggaggttggcagaattctaaatctgggcactgcagggtccccacaggtcacgaccctactctgctccacccaggctccggaggacctgagcaggaacctctgcagggggggcccggggctccctgtcctctcagcagccggcagtgctccctgacagcccgggcctctccctccagtagttcggtagtttgctgtcaccaacatggctgggcctgggacaggctcctcctctccctccagaagccaggcagtccctcctgcctcagtttctcagactaggccgcctctcccatcgcgagacactgaagaccctcagctgtttccatctgcccagtctgactgctggatcgccctctgtgtgcgttggtttgctgtgttcttgctactcgcccttggataagatttcttctctactcatgaagctgcgtgtcctggagggcagggccgcacctcacatgcatgttgcccacatagctcagcaacagatgctctcacgcttgttaaaagtaaaaccgggccaggcgcagtggctcacgcctgtaatcccagcactttgggaggccgaggtgggtggatcacctgaagtcaggagtttgagactagcctgaccaacatggagaaatcccgtctctactaaaaatacaaaaaattagctgggcgtggtggcacatgcctgtaatcccagctactcggaggcaggagaattgcttgaacccaggaggcggaggttgcggtgagccaagatcacgccatagcaattgcactccggcctgggcaacaagagcaaaactctgtcaaaaag

SEQ ID NO: 234908 - DNA, 605 bp, Homo sapiens
aatctaggctgaccctgtagattactttgaccaatacaatgtggtgaaaataatgttctgggatttccaagctaaggccccaaaaggacttagcttctactttcctcttcttgaaatgcttatacttgggatgctgcttcttggatcccagccataaatgatagcaagcccagccaccacgactggaagaactccaagtcccatggagaagccacataaactgagatgtggcagctgaattcccagctgatagccaccattaactgccaatcatgtgcatgagtatctcagatgtttcaagcccaatccagcccctagataactgcagctaaagtcaccatcatgtggcgcaaaaccacccagctgattcctatcaactcacagcattgaggcaagtgaaatggttgttattttaagctaattaagtttgagggtagtttgttagtaacagacaaccccacccaaaatttatgttagtgccattaagtaaatgaaatgaagatcaagaaacccattactcaagaacgaaagtatcactaatattgttttatgtattcatgtgttacaccttgccactatcctgagttttatgactcctttaaaga

SEQ ID NO: 234909 - DNA, 319 bp, Homo sapiens
aaataaatgagacaaaaatatgcataccaaagctactgttttcttgatgtgcccaaacagatcttgcccatcccttgacatcatgtacttcactttggagaccactgtctgatacagactgtaaatctgcctatacatacacctttggtacgagtttctttcatcttccttccttttcctgccttctccctcctttcctttcttttatatttatttatttatttatgacaggatctcattctgtcatccaggttggagtccaatgacacaatcatggctcactgcactccagcctggcaacagatcgagactctgtcta

SEQ ID NO: 234910 - DNA, 399 bp, Homo sapiens
ctggtcataaattcctgggctcaagtgatcctcctgtcttggcctcccaagtagctgagatctgcacctggcatgcatgctaaatatttggtcaagggtttatttctggactccctactctattccgtagatctatttgtctttatgccagtatcatgctgttttgattactttataatatgttttgaaatcaggaagtatgagacctccaaatttgctctttttcaagattatttctgttattcagagtcccttggtgttccatatgaatttttttttttttttttttgagacagaatctctctctatcgcccaggctggagggcagtggagagatctcggctgaccacaacctctgcctcctcggttcaagccattctcctgcctcagcatcccgag

SEQ ID NO: 234911 - DNA, 253 bp, Homo sapiens
atttactgatcattttatctgtattctacaaggccagcctaataatctttactttccaccggtaaggaaactaaggttcaaagaggtaaagatcatgcaactaagaagtatcagaagtgaaattcaaacatagttactcctcgttctcagggaatctcagtgtaataagggatataaatgcacaagaaattaaaatattagattaaaaaataataaaagattaaaatcctacattggaaggtcaattaaaaat

SEQ ID NO: 234912 - DNA, 495 bp, Homo sapiens
cagagattcacttagaattcaaattcctttgatataaaagtttggtttttctaatcggaatcaccctctctcaagggaatcagagctagtccagggagctagtggctctttgggccccagttttggtttcttgaggcaaatggtagagcaagaagagtctcactgaaggtcaagggctggaggaagctggagttgtaagtcaagtcaggaatgtgagtgaggtcaaacgtcaatggtagtggtgcagaagtaagacttgaggctagggttctaaagccaggagttcagaggtgcatatggcttagaaaacagtgaaaaacagatggcagggctggagggatttggaataattgttgaaactatcattgtgtattttgatagcttgactttataggtccaggggagagtggtgtatttatctggcttaggaagccatatacgagaaaggtgattactaaatctatattataaacatttgattatccacattgaagc

SEQ ID NO: 234913 - DNA, 490 bp, Homo sapiens
caattaatttgggactctctttccagctaaaaattcaatattgatttattttcctttgtcatgcacaattgctctgaaatgacaggtattctgaaattacttttcaaaggctgtatgttctggtggtttaaaagcatgggctttggggttagagagctctgccaacttctagccaagtgcgtgcctcattttctacatctacccttcttaaaaaattttaaatatattaaacattactaaattgtacctcttagtgtatcaacatatttcaatagtatgtacatgtctagtatacattcagtttaatcgtgtcttgtatacattcagtttaatacttacaaatctatacatctttttgctcattttcaaaataagtttgttttaattgaagaatactattattcatcatgtgcatgttgttttgaaatatgtataccttgtggaatggctaaatcaagcaaattaaaatttgcatttctccatatactta

SEQ ID NO: 234914 - DNA, 654 bp, Homo sapiens
taaataagcactaaacaggtcacaaacaattaaatagcattttcatgtcaccatgaagggtggaattggggcacttgtccctgatactttcttctctgtgataagacaaacaagatacatgccagcatcaagccttccctactagggagccacctccaccccaagacacatcatgcagccagccctctcacctggctaactccaagcattgattctccctgtcaaagccaatccttattttcttctctataaactgtctagtgcaattccactataatctttactttagctttttggagttgcctattttcaaatgaaaatcattggctttgcaaatgattgcagcatgttttaggcaggttccatggtgagtgcattgtccctgcatttgcagttggacaatataacactcatttgtagagctttttaatgtaatggtgctgtgatgtcttacttagttccttgaggatttcattagtggtaactgaattacactagtagtgggaattcagcccaggatgtattctttcattaagagctgcggtgtttgacagtatgtcagggatgaagcatgcctggaaatgggaagattttttaaagctctgtattcctcactcacttttctttctttctctctttagtctcccccagata

SEQ ID NO: 234915 - DNA, 475 bp, Homo sapiens
ttattttataatttctagattttactacaaatcctatgctataaatacactacaatcttcactattaataggaaccacagaaataagtaaagtcttctggaaaataaacatgtttctttaattaaaaaataatctctgacatctttgataataaatgtagcactgaaaatttattttaggattcaaataagattcctaactgtcttgactctatttattctgagcctagcagaatacctttttatataccctttaccttgaaagtttgcaaaaaattatactattgattggctggggtttaaagtctacacattttaggttataaagttaagagtagtttatggaatttaattgacagaagtttttttccccacaaatacacaaattccaatttacttacccatagtcacagatcagattggaaacttaggcaaatctgtgcgactaacaactttgtgtttagaaacagctccca

SEQ ID NO: 234916 - DNA, 591 bp, Homo sapiens
cctcacccttcatgttgacattccattccctaagagggtcatatgtttcttcatatgtccaagtcctggagctaaaatgctggcagaggcaggatgtagaccttatgtcttctatggttggaagaaaatagctgcttcccatcaagatctcacatctgggcaatgacccccaagtaggaaagtaagtggatactgcacagccacaccccctccaaaatatccagcatcataatggcaatggcgtgtactggcctagctctcatataattttcaggcctgttttgcaactcatcttagatattcaacatggaagtgtgtgctttttgttcgtcagtgaaaatttcttgcctgaacatttaagccttaccaaaaaaccctacccaggccaagaacagcatgtttctatttagaaccttctctatgtggaattagttcacctctgacagtcaggagacagagcacagggcaatgctaaagagaggggtgatgttgtgtccagcaatgaatcattacctgtaatcaaaatcggagaaagaacagaaaatggagctaaacaaaaatctctctataataaaattctctgggcaatta

SEQ ID NO: 234917 - DNA, 354 bp, Homo sapiens
tctcattactctgtccatacttataggttcaggggtgaacacataacccatgccatactgatgagactcaatttggggagtgtggttagaataattttgaagaaggaaacatttctttttttaagaaaaaatattgtaaatggaaaatttatagttatatgtgtttatggggtacaaagtgatgttatgatttataaatacaatatgaaataattaaatcaagctaattaatctatccataacctcaaatactctttttgtgttaagaatatgtgaaatttactcttttagcatttttgaattgtacaacacactattattaactatagtcaccacagtgtataatagatctcc

SEQ ID NO: 234918 - DNA, 625 bp, Homo sapiens
cagatcagggaaaaaagtaaaaggaagacagcaaagccaaccctggtttttttttgttgttgttttttgagatggagtctctgtcgcccaggttggagtgcagtggcaccatatcggctcactgcaacttccgtctcctgggttcaagcaattctcctgcctcagcctcccgagtagctgggattacaggtgcccaccaccacacccgggtaatttttaaaatatattcttagtagagacgggttttcaccatgttggccaggctagtctcaaactcctgaactcaggtgatctgcccgcgttggcctcccaaagtgtgggaataaaggcaagagggaagaaaaccccaattaaaacaatatggaaagtacaatgatataaacaataaaatggcaagtttataagaaaaaaatttagttcaataaaataaaaaggaagtattccactttgttttaggtactttaaccaatattaataatgcaaagatgactaagattcagttctaccttcactgacttgtattaacttcaagcactgaaagtatttagtgatacatgttcatgtacacatagtgacctattttcttttcttatactgttggttggtgacagtagtcagatcttct

SEQ ID NO: 234919 - DNA, 479 bp, Homo sapiens
gagctccagtgtgaatgtccaacttagagctcaacatttccatttggatgtttaataggaccctgatggatacagatggcaatagaaagcctctctgaggaagtgacatttaagctagactttcgggatgagcgggagccagccatgtgaagaacgggggaggagagacactccaggcaggaggaagtcgcgtgtgaaaactccaaggtggaaagagctcactgttgtgttcaaggaacagagagaagggcagtgtgtctagagtgcagcactcaggagagacagcacgagatgagattttctgaatttcatcccgatcacacagcacacagcagaggaagtggttggcctgccctccgggtcacctctctcctcatgctggcccttacgaaagataaaaatactgataactaatgcttattgaacacttactatgtttcaggcattgttttaaataaatttatattaaataaatagta

SEQ ID NO: 234920 - DNA, 491 bp, Homo sapiens
aaaggtcttacaaatatggctaagtatacaatagaaagaactaaacagaaactcttacttctatcagaatttgaaaggatgagaagttctgtaggttgcaaaggagacacaagggcacctttcaaagggtctgtttatctcaccactccataccttgcctgggcaaagggattttacattgcagctctaacgttaaggagatgtgcttatttgtttgttttttgttcttgcagctcaaggaggaattaagaagtaaaagagacagcttggaatgaaggtgggtgtaaaaggcaattggatgtgaaagggcaaatgtcctgactttggggacttgcctcagcttcactaatctcagtgacagttgcggtatagagccataattaccgtgtgtcctcttggctcagcataaaaagaataatattccacctactattgatgtctgtgcttcctgtgtactgcaggccctcaataaacatgtgttgaatcaataa

SEQ ID NO: 234921 - DNA, 455 bp, Homo sapiens
ctgacaagagaaggagaaatcgttggcctctgcgtgacatggagggtccccccacctgcaagcttttgtgtttgctggatcttggacagtaccctggcgaaaagcattcggcaagattatccggctagcacagccttcaaggaataaatatctaacaccttgttcccttttgcggttcaaaagccactgtcactgggctcaaggaggaattaagaagtaaaagagacagcttggaatgaaggtgggtgtaaaaggcaattggatgtgaaagggcaaatgtcctgactttggggacttgcctcagcttcactaatctcagtgacagttgcggtatagagccataattaccgtgtgtcctcttggctcagcataaaaagaataatattccacctactattgatgtctgtgcttcctgtgtactgcaggccctcaataaacatgtgttgaatcaataa

SEQ ID NO: 234922 - DNA, 326 bp, Homo sapiens
gtgctccccgcaccctcctcctcctctgcccacagccctaggccaccccacccacctccctcaggcatcgcgcaagagtgacggcagaccccctcatcccagacccccacttctcacccagaagtgagaggaggggtctcagacgttgggggacacactgctgggtgggtgatttccccccaaggtgctccctctgcccgtccttcccagggtggggctggggcctgcgtgggagtgcccagtgggcacccgctcggcccaagctctgcctgaaaggtccaaacgggcgggccctgaaggttcagccaagcatcctccgcggccgc

SEQ ID NO: 234923 - DNA, 467 bp, Homo sapiens
gttggaaaaactgcaaactagattcagctactgctggggaaagacttgctagactacagcaaaaacaaaacaaatcaaaaaccacattattccagtggcattcacaggaagcacaagcagttaggaaacccatgggaagcagataggaagagataagcccctttttcctcttccagctttgcagtctccctttagcaccacccatattgtcagagtctaacaggaaaccagcggtcaaagcagaaatacggttttgagagcctcagctccagcattctaaagcagaataaagaaagatggatttcaaagttaaaaataatactaataactggccgggcacagtggcagttattttgggaggccaaggctggagaattgtttgaggccaggagtttcaggcatgcagtgagctatgatcatgccactgccctctggcctggatgacagaacgagaccctatctctata

SEQ ID NO: 234924 - DNA, 728 bp, Homo sapiens
actgtcacctccttgaggtcaatgtgatgttatctaattttttagataacatctatgtctctaatagatctatctgtgcaatagaaccatacagtccttcgtagataggggaagcacaaatgttggttaatatttaacagagtatcagacctgcatccttctctctaagagctcaaacttcagagagtagattcagagagtaaatgttttcccaggctcaggcaagaggggtggtttgtatgttatttctttcttattttccagttagacttttggaaatctgccagatgcaattgaaaaaccctgctcagctttgtccaatgtctcatttgaggatcagcatgagtttgtttacttgagattaacaggagtcaaggatatacaaattcagcaatgtatggataactttcccctttttaacgctggcctcaccacaaaactaccaccatattgttgaattttggaagtttattatgctttattttttcctataaaaaaataaatgtcatcacattgtaatagttttataacctgttttatcatattttaaaatacatcttgaatattctttcatataattaatcttctacagcataattttaatatctatgaagattccattatgtgcttgtattatacatttttactctgaatacattattgttgtaaacaatgcttacaattatgaaaataaatatatatggctcatttacacattattctaaatc

SEQ ID NO: 234925 - DNA, 586 bp, Homo sapiens
tcttcattctaggcttcatctacaacagctttgcggaccatctctgctttactcaatgagctttacaatttccagtccagggttagactcttaactcagttttctgattgtttttctggcatccagtgtctttgagacaatcatgcagaaagcgctgggagccagttgcctgtgtattgaaagcccggcagagcgggacatggaggaaccacggaagccactgcccggccagcccagcagccccgttacccacaacctgccttaggaacccagtgaaatcaacagaccactttgcccctggtccaagatccccactggagacattcagctgatctggtgctcaactcttttgggcatagagtaaacactacttcacagaaggcagagaattgcaccccagcccgggctgactttggaaacacagccaagaggggtctgtaggggcacagtgttgggttcctggcagggcagctcactcgaagagcaggcaccgtacctgggttttgacagtaaaccttcactgacgatttgagggaggcagccagggtctgggtagttattcaaaagtctgatttctatgctattt

SEQ ID NO: 234926 - DNA, 399 bp, Homo sapiens
ttgacagctgccggacacaaactcgcagtggttcaattttcttcgaaacggtgtggtccctgcaaaaggatgtttcctgttttccatgctatgtctgtgaaataccaaaatgtattttttgctaatgtggatgtgaacaattctccggagctggctgaaacttgtcacatcaaaacaatacccacatttcagatgttcaagaaaagccagaaggtaaccctattctcaagaatcaaaagaataatttgctgttatagaagtggattcatgagcaacctgtgtcttgcagatgatggaaatgagtaggatttaacttttcaatcaggaataaaattccttaaagcctcaacattttcgcagcacttgaatcaataaatgtttcacctttgtgcatttgtg

SEQ ID NO: 234927 - DNA, 690 bp, Homo sapiens
  misc_feature (261)..(261): n is a, c, g, or t
ggcagagcatcggcacggtgcccaccgtggacctggcctcgcgctacgagtgtgccgcggtggtgctgcactcgccgctcacctcgggcatgcgcgtcgccttccctgacaccaagacgacctactgcttcgacgccttccctaagtgagcggcccgggcggggacggaggcggggcgggcaccggaggccgggcggggccggggccgggcgctaagtctcacccgctccacgcccctcccgcagcatcgagaaggtgtcntagatcacgtcgcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaccggccggacctcagcaataaggcggcccccggacctcaccccgcgccggccccccaggggctgcatgtggaccccccgggcggcccgggggaccccgcccccgacccaggggctgtggacgatgtacaggcaacagagctacgcactcctttccttttggaagcaagaagaaaatacgtgaaaacggaaattaaagatttaaaatta

SEQ ID NO: 234928 - DNA, 372 bp, Homo sapiens
gaaaaaacatagtaacttggatggagggcattgaatgctacctctgtgtagtttcttggctagtgttttggcctgtaagttcgtaaaactggtagaaaacctaggttctcaagttaggacaaccctccttctgcaagaaaaatgtagaatgtcactctcaagtcatacaagaatacaagttccctgagggcagagaccttatctctcttatccatgttggtatgtcctgctactagtaagtatttgtttagttaaccagtcatcataaagtaccgtaaggattttacaaatgctagatgatttctgggaatgtggtcaattcctaataacttcaagaataatttttgtgacttaagtacaagtctttatggc

SEQ ID NO: 234929 - DNA, 406 bp, Homo sapiens
ccgagattacgcgattacactccagcctggagacaaagtaagactccatctcaggaaaaaaaaaatttaaattaaaaagttctagtatctaaaatgagcaaaatcgccaggcgcggtgggtcacacttgtaatcccagcactttgggatgcagaagtgggtggaccatccgaagtcagaggttgagaccagcctgcagtgagccgagattgcaccaatgcactccagcctgggagacagagtgagactccatttcaaaaaaagaattagccaagcgtggtagcatgcaccagtagtcctagctaccggggaggctgacggggaaggattccttgagcccgaaggtcaaggctgcagtgagccttgtttgcaccacctcactccaacctgggcaagaccccatctca

SEQ ID NO: 234930 - DNA, 427 bp, Homo sapiens
tcaagatttgagccttgggtgagctcttttattgtaatatttgacttccaagtcatatctgaagagagagcagaagtactttcaactccactgatcacttgtttttccacttagcttctcattttctgagtttgtgctgttgagtgcaggaaatgttaaataggttggccttcagttgaaagatactgagatttactagcgctgttgtagattgggcttttgaacctagaattattgcttttggtgtaaaccaacatgactgccatgctgtttcctagacatatgaggatactacaggctctattagagactaatttttaaaatagcccctgatattcctcaactctttatatttagcattttgtacactattctccaagttggcatttggcagcttttcctcctcttaaggcaaagttaaaaaaaa

SEQ ID NO: 234931 - DNA, 481 bp, Homo sapiens
aagataaaagttcaagtcctggttctgtctctaactactaacttgatcttaggtaatcctttcaatatctaggccccagtttctatacctataaaattagattaaagtgatattttctaaaatatgtacctatattattagtagcatgcaagatgcttttacttttattgatttttattttaacaatattgcattttaaattagaaagaaaaacataattacagtatcaaattaaagacttatgaatattatttctagcaatataaaatttaccttttaaagaacattcatttaagttaaagaaaggtgagtgatttaaagaaaaatagtatgcatataatggtatagctgatatatagatatggcaaatcatgaatatgatatatgaaggactgaagtttcctccttgataaaatcaagaacaggttagattaaagcagtaaatcctagacttttagattttaatgatcaataaaatgta

SEQ ID NO: 234932 - DNA, 508 bp, Homo sapiens
tttgatttagctctttcttttttccaagatagaaaagttaatattgttgaagactcctgcattcttttccctagtcttattttcttccctcccataaatgtgttaaaatctctgtgtgtattgttttggttgtatttttacataaaactttacatattatataaaatttaattgaaggtaaaatttattaaattattcttaatatatattgtaatttaaaaattaacagcttcattgtcttgataaaatttatggtatcttaaacatgtgcttgtttttctaagagaacattgaaacatagattttaaaacaaattgttgaaagattaaaaaatctgcctttgcacactgttacattgaaagtggggcatttgtcgtgaacattcatttcaaatatgtagtatcttcagaatatttgagaaggatttgtattatataattgaaaaatctgttaaattgtatttatgttaactgcttaattctaataaaatttccattcattttttaaa

SEQ ID NO: 234933 - DNA, 547 bp, Homo sapiens
agccaacctctgtattgatgatcaatgtccacatcaatgctaatctcctaataggaagcctgtagtgtcacaatttctaagccatgacccattacataaattaaggcattgaatgtagtgacaaaatcaattcacagttgctaggttagccgaacccttttgggatccccctccagaagcccagcagacccaagaaagtggtaaatgagtagggaaaaccattggcagatgacaatcacacaccagaaaagattctgagcagataacatcatgatcaagcatatttccaagaactcacagagctaataatatggtcacctctataaaacaagatcaagtaaagatacaagagcttaaagcaacaataagacaataggtggctatcaggatgcattaacaaacatataagaaactttttttcaataaaacagtttttttagctattgaattactgaagctatagattgaactgacacaccttgtccatggtggggagaaccaatacaaaacaatcaacaccaaaaatagttattgaacttcatagaaa

SEQ ID NO: 234934 - DNA, 311 bp, Homo sapiens
caatatagttacatatatattacaaatgtgcgtgtgtgtgtgtgtgtgtgtgtgtgtgtgttttaatggaagatgcactgcctgcctaaactcagaataacctggtttacctaaagcatttgttaggcaatctttcctatagcatatttactttatgttgttgatttgttttatattttggagactttcaaactaataaattaagttttcgtggcaatggttctgtatctatttgtgagaaacaattcacaaattggagtctaaaggtgtatgactaaaaaaagtgtttataaaagaaataggataatagg

SEQ ID NO: 234935 - DNA, 387 bp, Homo sapiens
gagacaaagtctcgctttgtcgcccaggccggagtgcaatggcacgatctcagcccactgcaacctccgccttccattccaggttctcctgcctcagcctcctgagtagctgggattacaggcacgcaccaccatgcccagctaatttttgtattttagtagagacggggtttcaccatgttggccaggctggtctcgaactcctgacctcaagtgatccacctgcctcggcctctgaaagtgctgggattacaggtgtgagccactgcacttggccccaactcgtattcccaaatagatgtattcagaaaatctgccttcactttagctctgctgcttcagtacctttgattatgtttgctctgctctcccttctatcataaattc

SEQ ID NO: 234936 - DNA, 420 bp, Homo sapiens
gcgcttgggattacaggcgtgagccaccacgcccagccaagacattcttaaaggaacaatcaactggtaggaaagtatagattataaaagtactacatttcaaatatataactatttactactacctctaatgacagacatttaataaattcaaaatgacaaattcaatagattcaaatacatacttaatgtatttcacctgcctgaaaaaaagtaaagcagtcaaaaaaactagaatatataagttttctgaatcaagaaacatgaagagcggtctcccaaaatcatctgacctattagaccctatctgttaatggattcaagttatggaaaaagcctaaaataaagaatttgagaaagataagagccatttttctactacaataccctcccacctaaataaattactttggcccaaag

SEQ ID NO: 234937 - DNA, 373 bp, Homo sapiens
gccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagtttgagtggatcatttgaggtcaggagttcaagaccagcctggacaacatggtgtaaccctgcctctactaaaaatgcaaaaatcagcctggcatggtggtggatgcctgtagtcccagctacttgggaggctgaggcaggagaattgcttgaacctgggaggcagagatctcagtgagctgagatcacaccactgcactccaactgggcgacagagcaagactccatctcaaaa

SEQ ID NO: 234938 - DNA, 265 bp, Homo sapiens
tagttggaagatctggaaacttggggaatagttgttatttctttattgatctggtcatatcctgaaaataattataattgaggaaaaaaggaatatcccttatatggcttgcaaaattcttgcatactttttatggtatggtttaagagagtcaataaatagcatctcctttcccttccaagtccagaatcagttaaaagatggatggaaaagacaggcaaatggtgatcaaatattgcctttattactgatgcaattggagaac

SEQ ID NO: 234939 - DNA, 334 bp, Homo sapiens
aaaagtcttccctatgaggaaaggagcccacttgtggagaagatgaacactcgcatggaagcccacagaagtgagagaggtggcctggaggagggcactcgagtgaggagatgggcacctccagccttgggtcagtcacaaaggaaggacagaggcaggaaacaggagcattctggacagggggccctggccgctgctcacagcagctcatcttctggcgggagagggttagctcctgcccagtgtcctcacgtacgagagtggtgagtttctaatgcatcacctctcaccatgcaccccaagacagctgctcttctgaatcctacctagagaa

SEQ ID NO: 234940 - DNA, 468 bp, Homo sapiens
cgtataacaaattcataccaaaattttaacaatttttgtcaaaatgttggttgaaaatataaataagggaatttgaagatattgttataaatacagttataattagatatttacataaataatccttttttgggagttaaatattttccctctatcaacttctgtttcttttattaaacacttcaaaaaattactggtcatgtgttgtggctcatacctgtaatgctagcagtttggaggcctagatgggtgggtcacttgatgtcaggggttcaagaccagcccggcacacatgccaaaacccttttctgcaaaacacagcgtggcgtggtgatgcatgcctataaacccagctactcgggaggctgaggtagtagaatcacttaaacccaagaagcggaggttgcagtgagccaagatcatgctactgcactgcagcctggatgatagagcaagactctgtctcaa

SEQ ID NO: 234941 - DNA, 742 bp, Homo sapiens
ttgaggtattgatcaagtcagtcaggagaagcaggctggcttgtgtgtgaaggctgggctgtttgggggcctcactgtgtgaaaagatttggattctagcagtttctttctctacaagatctaatgtctggagagatggagaggcctattaggggagttcagatgactggagctgggacatcactgcttcttcaggtcccaggcagcctcccctccagctatcagcatgtctcggctatcccatgctgtcccctcaatctccaactgccctcctttctctccatcaccagagaaatgtgactgcctagggagcaaccatgtcttgaaaggagaaagagcaagaataaaggtgtctctgaggggccttgcttctcttcccctagttcttttaggcattttgttttgtttcatttggataagagctaacatttagaacaataatagaaaatagaagtacttgtctggagggtctagcagaggtccacagtgactcttatgagctgtataaaggactgtcccttctggagtctagtaatcaaatctggaggagtagtcctcaaatcttgttagagaatgaagttctcagggtacactcttcctggctaagcaatcccatcccagcccctctctactgaaatcattcatcctggtcaagtgtgtttctcagaatacctgggtatgtcaacagagataaaagagaagtgcagcacacttcctagtttcagctggcactaaaacaaga

SEQ ID NO: 234942 - DNA, 496 bp, Homo sapiens
ctgtcctccttggcatcatcctccaagggccacggccaatccatcacccatccaccagggggagcactcatgaacaactggcatctcccctagaaggaacagacctccagaatttggtcgggcaccctcatacctgtccatctcatcaacgtcatagacaaacagaagtaggtacaaaagaataaagccaacagagtctaacgctgcacatgccattgctctgtcaccacgtggttgctgtaaatccctctaagaattctgctggaatgtccacttgtaaaatcacagaggggtcaaactggcattccagacccagagaagccacagaattggtaaaaatgaagccaaagtaggttctttttttctcctcgagacaaatgcagtaagatcatctcttatttcatgccaaagtaaaaatggtcacagcgatagaaaaggactaatatctagaaaatagctaaataacaacctcaaatgcataagacacaaagcatct

SEQ ID NO: 234943 - DNA, 554 bp, Homo sapiens
acactgttcaaactcaggatgacagaccagggaagaccctggaagtggactcagggccatgtggtcagggatgctggagttgcagggtctaaaaaggaggatatgggctctggggtgggcatattctcttgtccctacagaccccccaccccatggcaagagggtcaagaccagagtaggatccctctgagatatatagatatagatatagatatagatatagatatagatatacacacacacacacacacacacacacatgcacacatgcatacacatatacacatatacatacacatgtaattggcttatgttcttttaaaggcaagataaggggaaaactaatcaaactaataatattattgctacggggatttgatagaggggacaaagatagaagctaggtttctcctagtgtgctttgttttgcagttttgactttggaactgtgtaaatattttacataataatgcataagattgatatttatttatttatttattgagacaaagtctggctctatcgcccaggctggagtgcagtggtgcaatctc

SEQ ID NO: 234944 - DNA, 534 bp, Homo sapiens
caggccaggcgcctgtctggaatggccgagtcagtgggtggccagatgggccctggaccctcctgacatgggagcctgagctccacacggctccagtcacctgccctggaccatgttgtgttccagcaggctcacctccctggtgtcaccccagctcacaggccacacaccctgctctgccacagaccctcacgccaggtcacacacgcagcctgtgtgcgggcagcctctctgcttggagggttcttcccagcggccttgggcaaggggtgccgtgcgcctctccgtgtaccctgtccacatgcaccacatcccctctgggtcacgctttgtgcagaggtttctagccccctctggactgttccatagagcaggaactaggggtcggaagtctttggtcttcagtccaagcataggacccagcattcaagtgatcagtaagaatgttacatggatgagttaatttatgaatgaacaaattaaggaattaatgaatttaacttcatagaaagtttcctcctgccattccggaga

SEQ ID NO: 234945 - DNA, 486 bp, Homo sapiens
ctgatactgccacctttttcaaatgttagcttccctaataggtgagtagtgacatcacattctgattttttcagaagggtttatatttgctatacatcagttcacctactttgcatttcttcctcttagccctgcttttaataaagaaaactctttccacattgtcttctctttcctcacttgattattcttcgtgggaataagagaattaaaggaatgtggaaaagtgtttctcttgcattatattgtcctaagaagcctcagttatcacttgctcttaccagtgctttgcagtcaccaggaatggtagaaagcagcggctggccagagggctggcagaggcggggctgttctttgtgcttgtttatattcattttctagtcacagctcaagttgtttcactttctgctgctcagggagacgagggcaatgtaaatgtgcttgctgttgtttaagcctcccggacagtaaaaacaaaagcggccg

SEQ ID NO: 234946 - DNA, 318 bp, Homo sapiens
tgcatcatctggtaaagggatttctgcctcatcagattacagactacatgtgaagccttgaaggatagctccaaggagatgcgtgagcacaaggcagtgtcctcacagtgagctaggaagaggcttgcactgtcactgccagtccgtttgtgcatcagagaaggcctaagcgtaattgagcagtcattgctgtctcctccagggagaggaaccatcctcctcacagatggctgaagatcttatgaagctgaacctcccaacaaatcctcatatttcgatacaaataagaatatgattgtcaatattcatacaatgttt

SEQ ID NO: 234947 - DNA, 699 bp, Homo sapiens
gcaatcattctagaaatctagtttactgctgcattctatagagatgcaaatggagctggatttatgtttcctttggaaaacagactttatttaaacacacactatgtattgctaattccaacaacaggaaaaagaggcaagtcaagctctttccacgactggcagattgcaaagcccttattttaaaattgcactgcccactgacaaagggctattataaaagaaacaactatttgcaaaagtaccagatataaactatcacatttagcaggataaaagtcacttggcttaatcaagagtctattaatgaaaggactgacctatatacaggaaattgtcatctttccctaattccagaatagcaaaagaaaaatagttatgtttgatttcccagtaagagatataacacattgggcagtcttgtagtttccatttatgtcaattacattagtacagaatttggatttcagctcataaaccaacaattccttgccatccagttaaaaatgctataggcatatcaattgctttaaaaaatttctacattaatatgtaagactatacgtggggaaaaaaaggaaaatggaaaaggaaagaggttttataattctaggaggaaaatggagttggcataatcatatttcttggtaagaggtgataaaaaagaatatacacacataaatttgaattttactgaat

SEQ ID NO: 234948 - DNA, 710 bp, Homo sapiens
aagtaccagcctgtttggttggttggtttgcttttgaaagttattacaatattatttaaggccttttcggataagttcacttttaaagtaggtgttatcaatctaatttctgaacgttatgggtcagaaaaatcactagcaagtggctcagaaaaagggaaaaggtacacttctgcaatcagctgaggagttcacacctttttttctaaatcaacatcatatttgctgttcagaggcaatctgaaaagctgcaaattcagctcacctcaaccccataatttcaaacgttagaggctggtctctgtggtttcctactggttcctgtggggagctcccgctttctttctccatagagcttagggtatttctcatatgccccattggctacctagtgtctcaggtaataaacgtatccgaagataaagcaaagattgctatgggagagtgttgtctcctaaaataggactgtcttgccaggccaggcctcaagaaccagagagaataataaacagcacaggatgaaatcagcatgattgcaaaaggactggactcaggaaaaacaagtttgtttgcccagaacaaattaccagaagggatcaaaaacatcttgtttttctttggtgataaccatatgctaccggattggaatgtttaccagaaaatggaataaagaccttcccactggcaaaatagagccagggttcacccag

SEQ ID NO: 234949 - DNA, 885 bp, Homo sapiens
agcgggcgtcctgttcccgcctctccagttaaggccactggtgtgagccggggctctgcgcgagcgagggacgacggaagggacgggcaggtgtgggcgcggggccacgcagcccgacggcgggagtcgcaggtgctgggtgcatgggccagtgaggacgcacagagatccctcgccgcgcggaggaggagcagcgcgggagccaggcgctgccccaagaccctgcctgcgtccgagcgagcggaacctcgcgcttcgcccggggacaatccgaagtccgcgctatggaagaggagaaatatttgcctgagctgatggcagagaaagatagcctggatccatcttttgtgcatgcgtcgcgccttttggcagaagaaattgaaaagtttcaaggttctgatggaaaaaaggaagacgaagaaaagaagtatcttgatgtcatcagcaacaaaaacataaagctctcagaaagagtactgattcctgtcaagcagtatccaaagttcaattttgtggggaaattgcttggaccaagaggaaactccttgaagaggctacaggaagaaacaggtgctaaaatgtctatcctgggcaaaggatcaatgagagataaagctaaggaagaagaactaaggaagagtggggaagccaaatatgcccacttgagtgatgagcttcatgtattaattgaagtgtttgctccacctggggaagcttattcacgtatgagtcatgcattggaagagattaaaaaattcctggttcctgactacaatgatgaaattcgtcaggaacaactacgtgaattatcttacttaaatggctcagaaggactctggtcgtggcagaggtattagaggcagagggatcagaatagctcccaca

SEQ ID NO: 234950 - DNA, 423 bp, Homo sapiens
gttggaacttttttttttttgagacagagtctcactctgttgtccaggctagagtccagtggtgcaatctcagctcactgcaacctccgcctcccgagttcaaatgattctcctgcctcagcctcccaagtagctggggttacaagtacgcaccaccatgcccggctaattttttgtatttttagtagagacaggtttcaccatgttggccaggctggtctcgaactcctgacctcaggtgatccacccgcctcagcctcccaaagtgctgggattacaggcaggagccaccacgcccagcctaaacatttttatcttaccaagaattcctcaaagacccttggtgctgccacaatgcaaatgtggtcacatttataagaagggagtttatatttacaaggactgttatcacatttatcattt

SEQ ID NO: 234951 - DNA, 421 bp, Homo sapiens
agtgcagtggcacgggtgagactcactgcagcctcgaactcctggtctcaggggatcctcccgcagtgctgggatgacaggcacgagccacttctcccggcctaggcgtggatctgaagctgcaggaagtcagcccgcaggagtaagaacggcactgggctgtgatgaagtcatctcggtacaaaggaattctgtgccacgaaaatattcatggaaatatttcctgatgcgatgtctttcccagcatatcgttgggtaaagcacagactgctgtgtgtccaccaagacaaggtctccaggtggcagggatcatttctttgttttcatatctgcatttctggtttttctaccaatgatcaggtattccctgtatgttgattttacttccaaaatttaggaataaaatatttaaagttaataa

SEQ ID NO: 234952 - DNA, 524 bp, Homo sapiens
caaggccccgttgtgcccttgagcccaaggtcctgggtctagactgtgaactgttgtacgctctcagagcgccctgttcctctccgtcccccagcacttatcatggtttgtaattttatggaatttgtgtaattgagtcgtgaatgtctgtctctgggctcgtaggctctgagctctccaaaagctgggaccaggtctgctttgctcatgctttgtccccagtaccttagcacagcacctggcactttgtgggcactagacaaatacatgctgtgaatgaatagctgatacaggctggtttcaatagcagagacatggctcagccttctcttctaatccaaggcatcccaaagaggccaataacggaggggtaggaaaccaagcgggcagggcacacacggtccaggcaacattatgaaattggaaaggtcactcccttctcaggtgtcaaccttgaggtggggcaggtggtatggagtgtttgaaatagaagaccttgggaataaacactcatggaaactttg

SEQ ID NO: 234953 - DNA, 453 bp, Homo sapiens
tgggccccctgcctagtgaggcctgaatgtccctttcccttagtaatgcccatgcccagcctgctggggggctggttctgtgcaccccatggccagccgtgcccattacctggtgccgcaggatgcctccacagagagctgccctgatctgcgtgttctcatggaatctgggcaggtcccttccagcccctgccatgcgtagaccctgccagaatttctgtgttgctttgagcagtgtgtacctagggttcaagcacacacccttagagtgcattgccagggttccagaagagtgggctttgctcagcctgagggcagttcccttaagagtgagccaccctcctccagccttcatgtgtggcagttggctcagaattttgtgtattctcgatcattttgctacacatccacagctcatagctgagggttttgctcagaaaaaataaataaata

SEQ ID NO: 234954 - DNA, 348 bp, Homo sapiens
tcttcaattctaattgtgctttgaaaatagctgatagtcgccgaagacttattgttcaagggagaaaaaacctgccacttttaacgcacagacacttgttatttaaatggaaattgtataattgctttcactatgatctatagactgccttggaaatatgagggccctggataaagcatattacagcttttattatgtctagctttatctattatgtttattatgtttagtttttctattggtttctcagatctaatttggaatttcttttaaattctctgtgtgttatcacttcagcaatatatcctgggtatactcttctgttgactagctttccaccagctagat

SEQ ID NO: 234955 - DNA, 486 bp, Homo sapiens
agcgatattttcattatgataagataaaaagtattgaatttgcatggacattcatattttccaactcagtatataggatttctcattctgccctacactcacgtatctattgtatccacctttctccatgcacgcttttcatgggaatgtgaggccctccttctttcaatgctaacctgtctactttctccagctccggagatggacagtatctggaaaaagtctattatgacattctatcttcttggctgaggattgaaaggtaatctagcaagaaccaccaaatagaaccttaatactgttgcttactattatgtagtatatagaaccttaatactattgcatagatgttctatgtctcttatgggacatcagtgagaatacatgtagcctactttattactggcatacgtgtgtgtctgtaaaggaagtatgtttaaaagaaagtcaaataagcagaaatagcaataaatggaaatgaaatga

SEQ ID NO: 234956 - DNA, 542 bp, Homo sapiens
tgctgctggactgagctcctcatcctacacttgcaggggttgctcttttggacagaaagctggaataaaatgtaaattttagacttccaccaaggccaggactagggtgaagggactaacgcactagtctcaggagcaactgttaagtaacgctaatcctgaatgaatgaaatagttttaaaattgaatgtaatcgcaaagaaaaaaaacccatgatagacaaaatattaaaactttaaataaaggcttgcacttgcagaacccaggctcaccggcctctccctgctcctggcccggtttcccagcttggttctctacaagtcagaattcctagcaaaatcaaagtgtgcgcgcgtctgcccgagtacacgccgcagagttatttctgccccatcttccctatttgaactcaaacaggacagcattttcctgggtgcagcccctgcgttgggtgaacagcgcagtgataaagcctggcgttctccacctgcaggcggaggctgacggcgcggtctttggcgcgagtccgtgcaccgcggccg

SEQ ID NO: 234957 - DNA, 271 bp, Homo sapiens
agactttataaagttgtgtgccattatcataatcatgatcatcatcatcatcaccagtatctattccccagcctcagctggtccttctctgttgatagctaccgaccaagatggtgtccacctgtccctcagccagtctcaatgttagatgatttctttctgacctccctttatggagagcatttactttagaacactgctcatgatgaattctttctctgtcctttgagatgtaaatctttgtccagtctctggccagttttacagctcg

SEQ ID NO: 234958 - DNA, 510 bp, Homo sapiens
ggaatccttccgaacttctggcaaggacagagccgaagagtatcaatgtagccaaaaaattcgatctgagaaaagttatctgcagaaagaccttcagctgcccgaagggctgcacttcagagagccttgtcctccttttaggccagattctatttgacagtctgaggactgtcaaaaaaatagccacaaaatggaatcatcagtaccgtattcctggaagcactggtccttagggatccagaatacttggggaatactttattctgattgaaccaccacttccctaatcaatcatgttggctactgaacagcaaccagagtgcctttatgcagacgaaaatcgccacagcctaaatccgtatgaacaatgtcttgcccatttcaaatggaaggttttcattcatgcttaaatagcagcatttcataaaggaaatatccatagcagaataaatgactcctgtaccaaaaatttctgagactctttagaattaaagtcacagttcaaataga

SEQ ID NO: 234959 - DNA, 2624 bp, Homo sapiens
tggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatgcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggatt

SEQ ID NO: 234960 - DNA, 2292 bp, Homo sapiens
tggctgcctgacttgggagatggatgggctgagggagtggagggggacctcagaggagcaggaccagggagactcccaggacggtaggggtcccacggctgggtggtcctaagccactgggtggatgaaaggccgagggatgttggtcctgcttctgcatgcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggatt

SEQ ID NO: 234961 - DNA, 1583 bp, Homo sapiens
  misc_feature (1013)..(1013): n is a, c, g, or t
ttttttagatttatcaactaatgagaatgatcgatttaatgaaatttgttatttctacatcagttattttttctccacactttttatatagatacttatcatcagcatttgtctacctatgaacttcatcaagtaaatttagcttcataaacatcataaaaagatcaatgaatactaccacatattcttttaactaaatgggatggtctaggatcttgtaacatattgcacaatgaagtttcctgttgaatgactgtctggctaaaagtacttcttgtccttaaaaatcatattgtacattcattccttcttaagtttcagaaaatttatctaggatatcatcatctgaagattcataacctgagatttcactactacctgcctctttacattcaccatctaataactgtgaaatatctttctttgtcagttttcttctctttgccattatgggtagaaaatgaaatattctgaattttcaaccgtgtttactgaaaccctcaaaaatacaaagataggatttccagccttcttttcaaaagatgagacaataccaccaaccaaaaaaagcctgggacctgatggattcacagccagattctaccagatgtacaaacaagagctggcaccattcctacagaaactattccaaaaaactgaagagaaaggactcctccacaacttattctatgaggccagcatcatcttgataccaaaacctggcagagacacaacagagaaagaaaacttcaggccagtatccttgatgaacattgatgtacaaatcctcaacagaatacttgcaaactgaatccaacagcacataaaaaaggtaatccaccatgatcaagtaggcttcatccctgggatgcaagattggttcaacatacacaaatcagtaattgtgattcatcacataaacagaactaaagaccaaaaactacatgattatctcaatagatgcagaaaagacttttaataaaattcaacatcccttaatgtaaaaaactctnaataaactaggtattgaaggaacatacctcaaaataataagagccatctatgacaaacccacagccaacattgaactgaatgggcaaaagctggaaacattacccttgaaaaccggcatgagacaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaag

SEQ ID NO: 234962 - DNA, 371 bp, Homo sapiens
agcaaggtggggagaatagaccttctcatcttgacattcagaattcttcacacttggcccttacctcagagaagcattctggacaccatagtcttggaatcctgtaagagattgtatgtgtatttaagtatgtttctgggaagaggacttatagtttacatccaattctcaggagtctgtagtccaaaaaaaccctagagacttcatccttagaatattctctggctttagagtcaaaattaactcagtttggcaagttactgaccctgagacttagtttctgccttagtaaaatgagataggcctgtggaatatatattcttatctgaaaattagagctaataacagtaaatatttgatgaacactgaat

SEQ ID NO: 234963 - DNA, 560 bp, Homo sapiens
atgagtggatcatgatgaccgtattgtagggacttgccatagtatggctgcttcccgatctactcgtgttacaagatcaacagtggggttaaacggcttggatgaatctttttgtggtagaactttaaggaatcgtagcattgcgcatcctgaagaaatctcttctaattctcaagtacgatcaagatcaccaaagaagagaccagagcctgtgccaattcagaaaggaaataataatgggagaaccactgatttaaaacagcagagtacccgagaatcatgggtaagccctaggaaaagaggactttcttcttcagaaaaggataacatagaaaggcaggctatagaaaattgtgagagaaggcaaacagaacctgtttcaccagttttaaaaagaattaagcgttgtcttagatctgaagcaccaaacagttcagaagaagattctcctataaaatcagacaaggagtcagtagaacagaggagtacagtagtggacaatgatgcagattttcaagggactaaacgagcttgtcgatgtcttatactggatgattgtg

SEQ ID NO: 234964 - DNA, 505 bp, Homo sapiens
agaaaggcttccctcgagaaatgatacctgagtattaaactgcaggatgagtaggattcagctgagcaaagaagggttggagaaaagtagacagcagggaaaatccctgatcctagagaagtgggtcttgttggaggagccagaactggcaggtggctgggaacccagtaggaggtgtgagtagtgggtaaaaccagggctgcaacaagcgttagaaacagattatcctaaggcaaaaataactccctttcactgctgctgctggtttggttggcaaaaggaaaaaaaaaaggactccatgattttagtaatcagattgctggtaataatattggtattattattctgatactattcactatatatataataggatagagcaaataagtaattaggctaatgttgatagaaaccaagattcttcaccataagagatgcaaatataaaatttttaaaattgtaaaaattctgtaattttaaatttgaataaaatatattagtgtaa

SEQ ID NO: 234965 - DNA, 652 bp, Homo sapiens
cctgccctaactctctgctctcatcatcctgaactacttgcaatttcctcagagttgccaggctgtctgtctgggcttgtgtactgttgccaatgcttcaagaaatgctgacgtctctctccatccccttactagattaactcctacacaacccataggattcaaggtaagtgtcactacttcccagaagtcttcccgggcaccctaacccactccctgctcccagtctgggttaggtatccttcctatgtgctctcactttatcttgcaaggtctcatatccaagcactgtgtattctgattacacacttgtcattgaagctgagcttcgtgagagcagggattatctttttcagctttgtgacttcatcactcccacatagtagagactcagtaaatgtttgatgtatgaatcaggaggaaatgctgacgtctctctccatccccttactagattaactcctacacaacccataggattcaaggtaagtgtcacttcttcccagaagtcttcccgggcaccctaacccacttcctgctcccagtctgggttaggtatccttcctatgtgctctcactttatcttgcaaggtctcatatccaagcactgtgtatactgattacgcacttgtcattgaagctgagtaatcgt

SEQ ID NO: 234966 - DNA, 753 bp, Homo sapiens
cctgccctaactctctgctctcatcatcctgaactacttgcaatttcctcagagttgccaggctgtctgtctgggcttgtgtactgttgccaatgcttcaagaaatgctgacgtctctctccatccccttactagattaactcctacacaacccataggattcaaggtaagtgtcactacttcccagaagtcttcccgggcaccctaacccactccctgctcccagtctgggttaggtatccttcctatgtgctctcactttatcttgcaaggtctcatatccaagcactgtgtattctgattacacacttgtcattgaagctgagcttcgtgagagcagggattatctttttcagctttgtgacttcatcactcccacatagtagagactcagtaaatgtttgatgtatgaatcaggaggaagagcaaagcttttcttgctgtgatggcaataacttttgtatttgtcaaaaattgttaacgaaatttcaagtcaattatttagatattgaatttaatttagattggtacatgataatttgaggggtagaatattcaggcgaagatatccaacaagtagttagaagttttggagtacaaattagaagacaatttagtactggccatgatgactcaggagtcatatgcattgaggtgacagttaagaacatggcggtggatcaaataaagacagagagacaggcagagccaggcagagacaaaggaagaaggagagatcagcagagaaattta

SEQ ID NO: 234967 - DNA, 307 bp, Homo sapiens
ctccatcctgggcgatagagcgagactccgtctcaaaaaaaaaacaaaaaaaattagccaggcatggtggctcatacctatggtcccattttgaagctgcagtaagccatgatcacaccactgctctccagactttgcaacagagcaagaccctgtctctaaatatatagctttatcatctcaacaagccgtgtggagtctagacctagcttgggtgagaaatacctgttggccacatgcatgcaggtggcagctggggcagtagccccatgagcaggctctgaggcctttccccctatgccgtaaa

SEQ ID NO: 234968 - DNA, 478 bp, Homo sapiens
agtcccacggagttggagtagcggggcacggtgacctggaggaaagtgaagacccagctgggcttcaggttttctctgcagaaccccaaggcgatagcccggcagcccctgaccctagcggggggagccccagcatcagagatgtccctggcctgacacccaaggcgcctctgagtgtcatctggcagggccagcctcgcagcgaggggagcccgggacagggatccccgcccccaggcccaggaaccccggggtcagtccacaggcccgagggcccaccctccgcctggcccccattgggaggggccttgagagaccgacgctggggaggggactgggccggcgagatggagcgcgcagcccacccccagggccggagacgcagacgagccaccgcccagcccgggaacggaagccgcgggggcgcgtcagcccttgtagaccccgcgcggggtgtcgctggggccgcggcggccgc

SEQ ID NO: 234969 - DNA, 1956 bp, Homo sapiens
  misc_feature (1417)..(1417): n is a, c, g, or t
gtaccagccccaaaccctgccagcagtatgggggaggatgcatttctccacaccttgctgaaggatggggacttggcagagttcagtgatgttttagggttggaacattgattcctttctctctctcttttttcccttttctccttgtgcctctcttcctgtgggtgcctgagaaaatactcagcctgtatgactgtggcctgagtcgagaaggagtgctagctctgagaagaaaaggtttatttccactctcatgtgactatccatctatccatctctccatccatcagcccattggacaatatgtacccagttcctatatccagctagctactgtaccaggtgccaggcatttcgggaagaataagacagacaaggttgtcgtcctcatccttctgctctaccaggaacaagtgaagtgataggaagagcttttcctcaaatagctctgagttgtcccaagtccagcctccagatcagagaccgtggttagggccctggaggatgcccacagcacctcccatgtttgcatgctaactggaggctgcctcttcaggtgtgaggaggcaactgtgcaggtggggcagggctgcctttcatccccctcctttcttctccagggatctggtatgctgagtttgcttttgaaatggaggtcctggccagaggtagcctggtaaatacagttcttaatctaaaaaaacaaaactcagtggggagagagtatggggaagaaggaagcattctccttacctgtggactagacagggagtgctgagagacggagcctggggaaagtcccattggtgtgagcttagagttccaggagagattagccacagccggatgctgacaagggtgccagattgtttcattatggaatggttagttatcacctcagcctcccaaagtgctgggattacaggtatgagccaccatgcttgacatggttcattttaaaagattacatctgggtctgtagacctcctcccatataacttggattttgtggacctgtatgatggcctgcagcacagcactgccagcctcagagaaggctggggtgtcagttcatgagtcaccccagagtcaacacaagtcagccccaccagccgcacagtgtgcctgctgtctattgcaaggtgaatgcaagatgattttttaaacaaatttgtctccctgtggctggtcacttggaggccttttttttttttaaaacatgtatttacatcctattgatgtatcaccatcctgttggtaactttaaaaattttgtgtatgtaaaattgcctatctactaatttgacaacaataccccggaggtggaactcatccccaacttttggcctggctgtgagacatccctccttgttatgtcttactttgttgctgttgcttttgtttctccccacacccntgcccccatgggggtccttggccagctctactccgactgcagttgtagaactgggcagagaaggtatgacaccccctcccccattatacctcagaaagaactagaagtatgataaatgagtacgactgggaatttgttttttccactatctctaggatgttcatgttttgtagaatccatatccttaattctttttgtgtgaaaatgtagagcatacctagttctcagacccaattccatagattagaaagaagttttggccgggcacggtggctgatgcctgtaatcccagcacttcgggaagctgaggcgggtggatcacctgaggtcgggagtttaagaccagcctggccaacatggcaaaaccccgtctctactaaaaatacaaaaattagccaggtgtggtggcgcacacctgtagtcccacctacttgggaggttgaggcaggagaatcacttgaacccgggaggcggaggttgcagtgagccaagatcgtgccactgtactccagcctgggcaacagagtgagactccattt

SEQ ID NO: 234970 - DNA, 249 bp, Homo sapiens
cttcacaataattactattattatccctatttaatggatgagcaagctgaggctttcaaaggttaagcactttgctcaaggtgacagcgcaaattaatgttacatctggaacccaaattcacatcccaaactgggaccctccctcagtcttctgcacccactaaaaaaccttgacagttcatttcaccaagcacctatcaggtatttggcaggtgccttttaaatcactaatactttaaaaacacaaaa

SEQ ID NO: 234971 - DNA, 449 bp, Homo sapiens
ttctttactgatcattgatgtaggtacataatgagagatctccatcagtgagcttggcaccagccacaggtggcccactgccaccagagctgggcacaggcccacttccagctgctactcatgatggagcaaaaaccctcacttctagccatcacccctccagatctggtacagagcccggaaaaggaagccttaggtgtgagtgaagcctcagtgaacacacacacgtgtcagcaatggaccagctgctgccaaatcacacaactacgcaacacgttgctcagaaatgccaatggtgactagcagagtgcaaacattactatgacaatggagcagaggcccggggcggcaccgagccttggtaagagccgacagaaatggcaggtcacaggccgtcactgaggagaactgcaatgcggcaacacttatatgacacttaatttgggtca

SEQ ID NO: 234972 - DNA, 440 bp, Homo sapiens
caagagtcttagctccttccttcagtcttcagtttaaattctaagaaatattattcgaagtttaagaggtcttattagggcattaatgtgggttttcccgtatcaagagcagacacaggtttttggtgtcttaggttctaaagataccagtgttccttagatttctgacctgactgtgaagggaattctcttttttttttgagacggagtttcgctcttttagtggcatgatttcggctcactgcaacctccgcctcctgggttcaagtgattcttctgcctcagcctcctgagtagctgggttacaggtgtggtggcatgcacctgtagtcccaactacttgggagtctgaggcgagaggattgcttgagcccaggaggttgaggctgcagtgggccatggtcacaccactccacttacagcccgaccttgtctcaaac

SEQ ID NO: 234973 - DNA, 458 bp, Homo sapiens
tctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatccca

SEQ ID NO: 234974 - DNA, 396 bp, Homo sapiens
gagagaatccgtggagcccatatcacagtcacagtcacagattcggagatccatggctgttttcataaattacacccgaacccctggtggttcccgttgtgtgtgttttctcaactgcagtgtgtctgttgatgtgaggaacccagaacagtggcttggaaacccctggaaccacagagctgtggtggtcagagagcctcacacatttgtctgtctgtgaagtatgggctgcatgaccctcctttccccggtcgcagcttcatgggaggctgtgcggggcgggcccagccccatggagctgggctcttgcctgtggaaactgaccagaattaagtggtcagaaacaggcccacagagactctggagggttcttcctttgtgttctgctggcagcag

SEQ ID NO: 234975 - DNA, 1191 bp, Homo sapiens
atttttatctgttctatcttgttaggaatcaaagaaatacaaattaaaatatcaaaggccattttttacctttacaattggcaaattcttctgaaaccttaacatagtgtactggtgaaaaagttaaaaaaaaaaaacgggcattcttatacactaatagaaggaccatatattttatccaacctcaggaaataaaacacacatatgtacaaaaatttatctatagagttattcactgtagcactatttacacacaattaaaagagcagtaattaaaacaaggttccaaatatcagatacaagttaaatttttacattcatgcagtggtgtattatgtgccaatttttaaaagatgttattaaagtatatttaatggcatgggatatatttgagattggttcagtttaaaacaataggcaacaaaagatttcattaatgaccctaacatcaacaattgaaaaagactgccatcccccgcaaaacaactcacttttgaacacagaaaaaggccgggcatggtagcccaccctgtaatcccaacactttggaaggctaaggtgggcaaatagcttgagcccaggagtttgagaacagcctaggcaacatggagaaaccccgtctctacgaaaaatacaaaaattatctgggtgtggtggtgcacacctatggtcccagctactcaggaggctgagaggtaggaggattccttgagcctgggaggtcaaggctgcagtgagccatgatagcaccaccacactccagcctggacaacagagtgagaccctgtctcaaaaaaaataaataaataaaggaaaaaaataataaataaaatagaaaataaaatttgaaatatcaaatttagcaaatataattcaaaattcttgaaaactatgaatctggccgggcgtggtggctcatgcctgtaatcccaacactttgggaggctgaggtgggcagatcacgaggtcaggagttcgagactagcctggccagcatggtgaaaccccgtctctactaaaaaaaatacaaaaaattagctgggcatggcgatgcacacctgtaatcccagccactcgggaggctgaggctggagaattgcttgaacccaggaggcagaggctgcagtgacctgagattgcaccactacactccagcctgggcgacagagcgagactacatctcaaaaaaaa

SEQ ID NO: 234976 - DNA, 605 bp, Homo sapiens
ctatgtaactgtttgccacactggctgcaccaacttacaatctcaacatccatgtgtaaggactccaatttctgtctctcacttgttatcgtctttctaatttttttcagagacagtggtcactctgacactacacagaacaaatcactgatcaacaatgctgatgattttgtacttattaagagtgataaagaggaagtataaagttctttagacatcttgctaagacacatgtaagacagaagacataaaacccacaaaaattaagagcccattgcctaagtaagatttctaggggtccaatggttggaagcctatcaggatagcttctccaaggtgtcagagacaagttactctacttgcactatcagtggatactaaaaaggacgttacaaagattaacaatcactgtggattttgaagcagtactccaactcattgaccaaggaacctgttaggctaccatttataagttgaaatcagaacaaaagatggctctgcagcaagttcatgctatagtataagctgctctgccacttgggccttataacccagtatatcaattgtctggagcctctgaatccttcctccaagatcttgtggca

SEQ ID NO: 234977 - DNA, 463 bp, Homo sapiens
gctaacagccaactatgcgggggaataaaacggagcagagaaccgagttgggttccagagaccccagattgtcttcatttgcagttgccaggttccctgcagcccgggtctgtggatttcccgcggctcagcgcccgcagctcaggctccgtggagcccggcggcatggacgaggcgtcgcgcgcgccctctagtggagaaaaagggtcactgccgaacgccagctgcggaccgtcgagagttccttgggccatggctcctgccgggagcagcagccctggggccgggatccaggatgcagaggcgagaaaatgaactgcccggccaccacgaagacaacccaccccttgccagtcacccctcaaactactgacaatgtcaacaacaataattataacaatcatattaataagtagaatgacaaatataataatatttaacagtttgtgattttcagcccaca

SEQ ID NO: 234978 - DNA, 6229 bp, Homo sapiens
  misc_feature (935)..(935): n is a, c, g, or t
  misc_feature (1104)..(1104): n is a, c, g, or t
  misc_feature (1454)..(1454): n is a, c, g, or t
  misc_feature (1497)..(1497): n is a, c, g, or t
  misc_feature (1567)..(1567): n is a, c, g, or t
  misc_feature (2247)..(2247): n is a, c, g, or t
  misc_feature (2433)..(2433): n is a, c, g, or t
  misc_feature (2523)..(2523): n is a, c, g, or t
  misc_feature (2555)..(2555): n is a, c, g, or t
  misc_feature (2617)..(2617): n is a, c, g, or t
  misc_feature (2771)..(2771): n is a, c, g, or t
  misc_feature (3359)..(3359): n is a, c, g, or t
  misc_feature (3472)..(3472): n is a, c, g, or t
  misc_feature (3576)..(3576): n is a, c, g, or t
  misc_feature (4056)..(4056): n is a, c, g, or t
  misc_feature (4075)..(4075): n is a, c, g, or t
  misc_feature (4320)..(4320): n is a, c, g, or t
  misc_feature (4376)..(4376): n is a, c, g, or t
  misc_feature (4488)..(4488): n is a, c, g, or t
  misc_feature (4533)..(4533): n is a, c, g, or t
  misc_feature (4899)..(4899): n is a, c, g, or t
  misc_feature (5235)..(5235): n is a, c, g, or t
caaaaaatgagcattattttagcaacacaatcctgacactatgagagggagaaaactgggttggatcaagtattcatcttacccagtaagccattataactcaggcttttgatgcatattttgggctgttattcatcaaggtggtcaaagtcatgaagaactgtatgttattctataatatactttctatattaagtctgttcagatgataccacattttctacatcactgatccattaaaaaaaaatctttctttgaatgcctcttgccactaatcaggctatgatattcagtttttgagataggttaacaaattgaaaacccagctttaaatgttatggtagtttaaaaatagaagtgttttacttcaaactattctgagttgctgcttagagcaataaaaatgtactttatagcttgttaacctagatctcagggatatccgttctacaataatggaagtagatttgtttactgtctaaatcagccttgtcagaacaatgctctccagtgactttttaaagtcagagtaaaccaatacattctgtcttctgtgattatacagcatggcatggtgttctcttgtatacttgtgttttgaatatgagtaacagtctttagctgactttagcattttggagaaatctgtatatgtggcttctacttatataagcatctaccaaatatattaactgagttttatagtccggttattttccatttcagttacttccaagactcttcgatatgcacttacatacttcatactcattaaatgaagatattggaagctaccttattttgaggtacagcataaagcaccagcagagcttagttactacacattttagcacaatctcctgtaagttactgcatgctgcaaaagagctgaatgagtcaacagacattgtaatggtgatgtgtaactcataacntgaaataaactatgtcaaatcgattagaaaggtctgagcacatctggaaaattggcaggtaatttagaaagaaatgactagttattaagaactcaggccagttaaactgggagattaaaatgtattacattgagagactattgccatcaattgccatttgttattgaanataaaatgcagcctagttttgagactcaagtgatgaacccttcccatgggttctttctacctttctactggtcctcaaaaacaagttaaagcaaaaaagatttaagtgataaaatgtgtttatgcctcttggatgtatacttttttttaatctaaggaagaaaccttatgatatgatatgatgaaaccatcctctctggattctaatcctaagtaaatactgaccagctgcattaagaaattttctgtttttttctccagatcttcaaatgctccattaaaaaaagaaagtttgttctagtgttttcccatcagcatttacctactcttatgtaccttcaccacaatcanaactgttttccagcccaaacttggcctccaggccctcactgcnctagagccagcccctcctaatggtttcgctcacactcagcgccttagcttcccctcctcagggtcacttngagaaggaaatacttctgcctctttgtaccacctcctgccagaaaggagaccccgcactgtacctgattctttgggtcataggaacagcatgtgccccacgtgggcattctcctcagtctttatatcacataccctgtgaatcagcatgctggggtaggaccccagggtggaaactgttgaaagccgtccagcaggcaatgaggtatgctctaccctggaggcctggtaaccttcacgacccccttgagcttcaagtctctgtggctgatggttttaatgataggagcccagaaagggaggcagcttccacccagctgcacccctcgaggtcttgtgctccctgaccgggccatcagctacatccttttgcaaagcagccatcagcttatgatggggtcttgctaagctgagtgcctgctccaggaaagccttgtgatgctcatacgtggtccgatacttgtatttggggtgagccagcttaggtttaacgactaaaggacaggaagagcccggcaagccttgcttgtgaaatggacacggtatatccaggaacacacccagtctgaccccagcagcactgcactttacatggaaagttagcagctatccattattcatttcaactgcaatgctattgcagtcaggcagtgcagagagacagcagttttcccttatccangtgatcttgagaaggggaagttgaggcactaagtagaaggaaaacccttagggaaggttggctctaaagagcaggaaatttatccctccctcatgcacctgaagcaagctggtgctcagtgggacccacaattcatagaagttccctaaatgcctgggcctggttcagtgatgatttggctgagcngagacctgggagtgctctctggcttgctgcagccattccatctcagctccaatgagacagggccaaagatggacctgattctccacccantgggcagaactcaaggccattctcagctatanctgctacttcccttggtaatccctgttacattcttcccaactcttaggctgttgccaatggnctagctatttggtttgccacctgaaaaaaccagacaagcagataaaggcacctctttggggggctgtagaccatggaaacaaatcatgcatggaaccatgtgggtcactcaggtacaagcccacagtgtggacctgtttcgatgagaccaactngaatgagctgctgatccagatggcactggccacataaccaccaggctgcctgagtttaccttcatactgggcattgcagcacatcccccatcacaacatgagcacaaaggaaacccagtttctgacacagagctgccactcactgcatgcaggtgttttatagtccggttatcttctgtttcagttggtgtctcaggaggccacacttccctgggcaaggccccccctgctcctggaagactgactacgttggacccctgacctccactcagggctgacactgttccaggctatgttgttactgtcccagtctggtcagccaacttcagccacaccaccagtccgcttggttcttactttctgtttgcagtctgacaatggaacaccttttgtcaaggaaaccactcaggagtggacagatgaccttccatgccattgccatccacaggcaccaggcattgttgagcactggatcagtctcttcaaaaactgactcaaagacatctgactttggtctcctcctggtcacacgcttgactaagacacgttgttcactgaatgtagctgttccagaaagggaccatcttntcttggctgcttcttgagtaatgaccagaatgaaggggcaaggaatcatctagatctattttgaaaatttgataacctttcctgatcattcctggacatgaggcttctctctntaccctaacaactcccccaggcccacgtggttagtgcacccccgtgagcccagcgcgttctagtctaattctgatgcgaccacctggatgctcatgccgcattnccatggactgagataggtgggacagggaccactggctgagagctccgccccctgacccccctacagtggttcacacaggccaaaatggtggccgtgacaggcctctgtagactttattaaaatcctctgtgcctcttgcacctgactgtccagatggaaagtcgggagtgagcaggggcatggggagcaaagtaaagctccagccactgacatagggcacactaattttattccagtggagggagaagaaccacctcagcctcaggagcctcggcccacaccccagagaaccacctcagcctcaggagcctcggcccacaccccagagaagaaccacctcagcctcaagagcctcggcccacaccccggagaagaaccacctcagcctcaggagcctcggcccacatcccggagaaccacgtcagcctcaggagcctcggcccacacccctctacctccactaagaggtaagcggggtgngggctatgaatgacctttntcctttactgtcatccctggtgtctgtcttccttgtgaaggaaaataacttggtgccgctcacccaaactattacaagcaccttaactgactgctggctctcacatcgtcaccaggcagctctgaacacagctggactgccattgcccttaacttaccgagaaatttttggaaacagcaggggagggcctcggctcgactggcagtgtggacagacagggcagggtaaatggatggctctcaaanagtctctccaaagccgagaaggacttcacccagttgctcaaactgaactggaaacngtgcgttttaccagcagatcaggaggctacattgtagtgattgtcaaagtgcacttctcagttcacactggtcccaacagtcaaggaagcccaacttgggggtgccagcaantgtaacccacactctgttttcagaggcaccacgcgtgccccaganctacactccttgtatgggagggagtcaggtactaagttgcttttcttccccaaaacgtgctttcctttccccttacaccttatggattctcttgagaatggaagtcgacaccatcgatagaccgtgcagcactccgacggctatgcagatcgaaaacagagccgccgtgcttaccctcaccctgtgggcagtcagatatgatgggaatcacccagttagaaagatggcatggaatctgtccctgacttcaaatgaagtaatcaatggtattgccctggaaggcaagcaagtcagcctccactcaccagcgagagttgtcagggatggtagcattgccccagactcactcttagtggcacaatcaancacgaactcagtcattcataccttgggacgtaaagaaatgacagtgaatggcagtaacaaaggcacaccacagcaagggacccaagctcggcgcaccattgtcctttttcattctggttttgctgagctgctgttgcttggccttgcacaaatgctgactgggagtagtctgagacctggagtgggacacacgtccttcccatgactaaaactgctgatgaatatgataatatttctacactagcctccctcaagcccagaaccatgatctggaacagcatttgcatggagcaccaaattacaggccttaatccaacaagtatttcttgattatangacttgattccaggttagacagatggaaaaatgctgataaatataaaacatgtcttgctctctaaaaaattatagtttggttgcaaaagtaagaccaagttgactaagatataatggtcttttgtatcattatgtgatcatttgatcattgtatcattatttgatcaccaaattatatggggccaaaaataacacaaaattgggaaagagattgtaatcactgagggatgaaaaaaggcagtcaggttttgaaaaagagctctatttgggtgcacgccgagcctgcctgactgtctacaaatgaaaatcaggccaatgcctgtggcctgcaaggcttctcgatattctaaggtgacatggattgcatgttattatgcaatttttaaaaaaatggtagagcctctggatgaacgtgttataattaggtttccttttgttgatttggaactctttctgttcattgctgtgtgaaacacgcttgtggaaggaattatgccagctttgcatagtgtgcatttttagagagaacattttcattgaaacagaatcagaaatgtaacaacgagttgggtagaaatttgtcatgattcttgttggcatatattattgttgctaaaggcatttattaaacttaatgaaagtgttcattaagaacactgaagattataatgctgacaaaaacaccaaaaaaagtcattctactacattgaagattaaaaataaataagctaccccatcaaaccaaataaactataacttttaggtaattataaaatacaacttcacctgcctgggcaacatggtgagatccccgtctctacccccccgcccccaaaaaaaaatttagccatgtgtggtggcatgcgactgtgatctcagctactctggaggctgagaagggaagatggcttgagcccaggaggtcagggctgcagtgagcagtgttcgtgccaccgcactccagtctgggtgacagagtgagactctctctctc

SEQ ID NO: 234979 - DNA, 430 bp, Homo sapiens
caggtcttgataaactggctcagttggacttgtggcctctgcctaggaactgattcagcataagaggacagctttgactccctattattttatctctgacctgatcaatcagcactgccaactttctgaccccctatacaccaaattattcttgaaaacctcagtctccaagttttgggagagactgatttgagtaaaactctggtcccctgtacagtcagctttgcatgaattaaactctttctctattgccattcccctgtctagataaatcagctctgtctaggcagtgggcaagattaacccactgggttacatgtggcctttcccaattctatcttatgaaatatttatctacttggtccccatagtcatcttgaaatgtgtttcatgttgcaatgttttaataaaggctttagctaatatcttt

SEQ ID NO: 234980 - DNA, 227 bp, Homo sapiens
tctgtgagtgccagtgagaaataatgatttttttgtatatgactgttagtatatatttgtcaaatcatcgtgtaccaagttaaattttataattcttatttaatatttaaatacatttatttagaacttgttgtcttcacttgcattaatttgaactgtgaattttattaaagttgaaatatgaaaaaatgtgttgtttcctttgaattaaagatgtttgtaataga

SEQ ID NO: 234981 - DNA, 296 bp, Homo sapiens
cattttgttatcttttccccatcagatcgattaacaaggagtgataagtaataacttttttcctgtctagtgaactatccaaagtgaatgtcaaggagatataatggctgggcgaggtggctcatgcctgtaatcctggtggtttgagaagcctagaggggagaatcatttgaacccaggagtttgagaccagcctaggcaacatagcaagaccctgtctctacaaataataaattttaaaaaggagatataaggagtctggttaattcattctctgaagaaatacttcattgttt

SEQ ID NO: 234982 - DNA, 346 bp, Homo sapiens
tgagcaaattactgaacatctctgtgccttagttttctcatttatgaaatattccctaaatggtagctagtgcttatttagaatttactgcactaagtgttttatatgtgaaaaaaactaagccttagagagattaaatagcatcaagtggacagaaatagatttcactaggattaataatgggcaaagaaaatgaaatctaggagcaatacatgtaaagttcataacatttgtacttttattaaatcatttccataaaattgatctaaatgttttagttgactgtgagatgaatatgattcattgtcatgtcgtggctttaaaaattagaaacagaaaaaacagc

SEQ ID NO: 234983 - DNA, 100 bp, Homo sapiens
atctctaataccactgcccaatttcaagcgtatagcttcatgaaataaatgaaacaatttatctcccaataaccacccttatcccttctgtgcattctcc

SEQ ID NO: 234984 - DNA, 484 bp, Homo sapiens
tatgaatccactgtgttctcaagtagcctatttccaatttagggccatagctagtctttggaaagagatttcaaaatcccagtgactaagaggctgcaaaaggatgatggattggacgtttggaacgtcctttccctcccatgctttcagtgtaatcgcttactcagttcatctccctcaagttttaagacaaccctccgacctggtaggaaagctcgaaagaactggaagtgccagagtttggatgatttgttgctgcccgcagtaatgaggatttgaattggtctcatctttgtttttaaggaaacagaatcaacaaataagtgagatggcactgtgctaggcaacaagaacactgccaaaaacaaaaacacggcctgagaaaggtttgagatagaagcaaaaatatagttgatcaatgatgtcgtgccataaaacagtgccaaatgaattatataaagacagtaagtttttgttgttcttt

SEQ ID NO: 234985 - DNA, 589 bp, Homo sapiens
ttgacaagacatgccaaaacataaaaatatgtacactgcaattagtttctgaatgtagatgttacaacttaaacttatttttaaaatatttaaaaataggaaggctagacatgcctctgtatagaaaatctgataaaaatatttctccctaaattgtaaattcattgatattccagtaaaaatttccatatttttttagttgagaagctgattctgatcatctgtagaattttgattttaacgaggaatgtagtttacattaggaatgtagtactaatactaattgaacatttgctaatgtttcacacactattttaggtgctgggggatacagtaaggtacaagatggacaaaaatacgtgctcttacagatctagtagaacagaaaaaattaaatgcatgctatgtgataagtatatgatatgtcccataaagagaaatgatataaaaaagaagctagggagtgctggatcaggcaccttactatccccagaacatgttggtattagaggatgagggaagaactagaggtaactgtgagacacaaaaggcataatgaaaatagtcatgatagtcccaaggcagatat

SEQ ID NO: 234986 - DNA, 325 bp, Homo sapiens
caatcatctgttccagtttcccagaaccctgctgggaaagtactttttaaaaagtacttttacaaaaccccagcctccaaattctgggggagacaggtttgagaactttctccctgttctccttgctcagcaggcctgtgattattacattctttgttgcaactcctgctggtctcattagtcttttttcagggcagtgggaaagaagaacccatcaggctgcgacattgttccattaaacttgatactagatttttgacatatataatttatcatgtaaaggcagttttcatcttttcctctcttaatgaagacttaaaaaaaa

SEQ ID NO: 234987 - DNA, 457 bp, Homo sapiens
cacatgctatatgattccacttacataaagttaaaaagcagtcacagctaaattataatgttaaaaatcagggtattgattgcagttttggaggaagagggcagtgactggaaggaggcatgaaaggagggcatattgattcctggtaatagtctacctcatgatgtagctggtattcacgtggaggttcacttgtgatagtcactggctataagctatattttgtgcacttctctatatttttctaatacctgaattattaaaaatgtgtaaagagtaaatatcaattaaatttcccaaagtttcaagaaaatcataaattacaaaagtagtccagaacctagaaaaaaaaaatgaaggaaactttcccagtctgttctataataatgctatacttgatccccaaattggatgaatacagaattcatgaatataaaaaacagccaagaaaaaaaaa

SEQ ID NO: 234988 - DNA, 468 bp, Homo sapiens
aatactgttgtgttacagttggctacgtatacagtacaataacatgctgtataggtttgtagcctaggagcaataggctataccagtagcaataggtgcgtagtaggctataacatctaggtttgtgtaggtacattctgttatatttgcacagtgatgaaattgcctaatggtacatttctcagaacgtttgtccctgtcattatgtgacccataactgtgtgtagctcagaggtcaaaggtatattaggaggatatgcccagaattctcactaccatcccattttaccttccttgtggataaccatttcatgactactttcaagtttatcttgacctaacaagtaagtctgattgattaacctcatcttaatcatgggacaaaaacaagcagactcctcaaagttccatatttaaaatggtgataacgagacttaactcattggattatattgaagattaaatgga

SEQ ID NO: 234989 - DNA, 530 bp, Homo sapiens
atttattgctcctgtgtttggggtcagcagcactgctgatcttggctgaactcactcatgtatctggggctcacttggctgacaaaggctgaccttggctggggagaccagggtgactcagctttgctccatgtgtctctcattccccaggatgctgggttagcgagaaagtggaaaccccagagcctcttgaggcctccacttagaactggcagattgttgttctggctgctgcattctgataactaaagcaagtcgtaagaccagcccagattcagggagtggcaaaatggcctctatctctttagtgagagaaattgtaaggtcacctgacaaagaacatgggttcagggaggggtgagaaattggcccctaaatgaaattagtcaagcaccccattatctcattttagagaggagcaaactcagtttcccaggagagccagcgactggtccatgttcactcagcagaatggggactagagcccaagactctcgtctttcactctgggggcctttccatctacccca

SEQ ID NO: 234990 - DNA, 331 bp, Homo sapiens
tgtcagcaggtgaatggtaagcaaattgtggaatatttgtacaaagtaataggattcggctgtgaaaaagaatgactattgatacatgcagtaatctgtaatgacagaaaacagattagtggtggcctggggttgggagtagaagagaaggggaggattatgagagggtaggaaacttttggggatgatataaatgtttgttatcttgattggactggcagttttatgggtgtatacatgtatgaaaaattatcaaattgtaaacttgaaatgtgtgcagtttactgttcttcaattatatttcaataaagttcaaaaaaattagtgcttg

SEQ ID NO: 234991 - DNA, 941 bp, Homo sapiens
gagaaaacaccaaatggcggatgacgccggtgcagtgggggggcctggaggccctggtggccctgggatggggaaccgcggtggcttccgcagaggtttcgccagtggcatccggggccggggtcgcagccgtggaccgggccggggctgaggccgcggagctcgcggaggcaaggccaaagataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccacccgtggggccatcatcctggccaagctctccattgtccccgtgcgcagaggctactgggggaacaagatcggcaagccccacactgtcccttgcaaggtgacaggccgctgcggctctgtgctggtacgcctcatccctgcacccaggggcactggcattcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgagaaaaaa

SEQ ID NO: 234992 - DNA, 344 bp, Homo sapiens
aaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaaggtgccacacgggctctctgggcacagggccggcaggggctaaccccatctgatgtgtgcagaaaatacatgaaatgcctgcctataaatttctcaatttttgatgtaacaccct

SEQ ID NO: 234993 - DNA, 184 bp, Homo sapiens
tgggagtatttttaccagccagtgcttcttaaacattttggtcttggaacccgtttacactgttaagaattattgaatgtaggccgggcgcagtggcttacgcctgtaatttcagcactttggaaggccgaggtgggtggatcacctgaggtcaggagttcgagaccagccatggtcaacgtgg

SEQ ID NO: 234994 - DNA, 415 bp, Homo sapiens
tatttatttatttatttatttaaatagagacagggtctcgctgtgttggccaggttggtcttgacctctttcctgtttgttttggtttttgagatggggtctcactctgttacccacactggagtgcagtggtacatcctcggctgggctgcaacctctgcctctggggttcaagtgattctctcacatcagcctcctgaacacctgggactacaggtgcaggccaccacacccggctaatttttgctagttttggaagagatggggtttcactatgttgcccaggcgtgctggtgggcgactgtagtctcagctacttgggaggctgaggtgcttgagccagggaggtcaaggctgcagcaagccatgatcgcaccactgctccagcctgggccacagaacaagacattagctc

SEQ ID NO: 234995 - DNA, 427 bp, Homo sapiens
  misc_feature (137)..(137): n is a, c, g, or t
  misc_feature (148)..(148): n is a, c, g, or t
  misc_feature (195)..(195): n is a, c, g, or t
  misc_feature (335)..(335): n is a, c, g, or t
  misc_feature (364)..(364): n is a, c, g, or t
cattggaagatgccgagccgcagccaccctgacggctgggactcggtggaggctccctacactcgctggggctggaagaaattggtctttggggattctgaaggcagcttcctctattctcttgctccttggtaacnccacatgacangagctccgccggcaacttgcctgctcacacctcccgttcgcaggtgnccccaggagagcggcagggtttggggcgagatgagcccaagactgccccaaatgcacggcagcacactgcggaggacgtactgcccgcccctccctcactgcctggctttctcatgctatagttggggttgaactctggnccctgcggtgactctgccctttccacccnattcgcagagcccagctgctactccacggtccctgcaccggctgctgcacagacccgcggccg

SEQ ID NO: 234996 - DNA, 129 bp, Homo sapiens
gctgtgtccacatagatggccacagagagatagaggcatcccgactcttcagtatcagacccagagagaccttgaagactgcaagcatgaaatgaaaaagatatgcaaagcggaagtgactctggagat

SEQ ID NO: 234997 - DNA, 757 bp, Homo sapiens
aggatcagcttgtcaatctctgcaaagtagccagcttggattttgatagggattgtatggaatgtgcataccaatttggagtggttttagggttttctagagaaacagaaccaataagaggtgtaggggtgtatgtgtgtgtgtttgtgtgtgtgtgagtgtgtatgtgtgtttagagagagaaattactggagggaattgattcgcttgattatataggctgagaaggcctaagatctgcattctgaagacccaggagagccaatggtatagctccagtccaaatccaaaggcctcagaaccaggagagttgatgatgtaatttctaatctgagtccaagtctgaatcaggagaataccagtgtcctggctctaagacaggcattgagaatgaattcttccttttaaccttttattttattcaggttttcagtagattggatgaggcccacccacattggggagggcaatctgcttattcatcctactgatgcaaacgttaatctcattcagaaacaccccacagacacactcagaataacaccaaatatctgggcaccctgtagcccactcaaggtgacacataaaatcagtcatcacagagagtattgccatcttaacaatactaagtctgacagtcgatgaatacaggttccttttatatttatttggatcttctttcattttgctcaacaatgttttgtagtttttggtgtgtaagttttgtatttcttgggtgaaatatactccaaagtat

SEQ ID NO: 234998 - DNA, 413 bp, Homo sapiens
ccccagcctgggcgacagagcgagactccgtctcaaaaaaaaaaaaaaaaaaaaaaaaagagagagagaaaggcatctttgtcaatgtatttaagttaaggatcttgagatgagattatcctggattgtccagttaaccctgaatccagtgacaagtgtctttaaaagagatacacagaggagaagacagacacaaagagagaaggtgatgtgaagatgggggcagagattggagggacgcagctacaagccaagaaaaccaaggattgctggcagccaccagaggctgggagagaggcctgggttgagacggcctcagagcctccagagggagcctggtcctgctgacacctcagttttggagttctgacctccagaactatgagaaaataaatttctgttgtttcaagcca

SEQ ID NO: 234999 - DNA, 560 bp, Homo sapiens
tggaaaatacaactctggtataaggcaactcttgcgtctcacaaatcctatcttccgatcaagctgaaacaaatgttcttgctccccacatcctcacaccccgccttccctccaccagcatgcttacagcagcactgcaccctccgaaggcgtgctgaggcttttcccaccgcagccccggatctccacaaagccaaactcacgcatccagcagatccaaataaatgccgcatctgccctgacgccttcccaaattctatgggatgttctttgttcttttttcctagtaattcgtcaaccaccgccttgtattatagcaatgtggatataaatcttatcctctcttcactgcaaagaacatgtctggtttatgttcctattcttttgaccccttggacctgttcagaaagcattacttaaatgaagtaacaaaggcatgggctaacgacagagggtgtccctgagccatttggattccaccgccataaggtgtagtacaaagactcaaggagggggtgctccgccgttcaccccttgttactaaatgaccattcctgtca

SEQ ID NO: 235000 - DNA, 353 bp, Homo sapiens
gaccgtgtgagggagatactaccaccattttacagatgaggaaactgagggttagagaatgtaggagttgacccaaggtcatggtgcatctagtacatgatggatccaaggttcctatctggacagtctgccttaggcttacagtgctaagcaccacatgcagtttccccaatcatacaccttaggacaccacctttgtatgtgggtctcgtgccagagatgaacgtgggcgcatgcacacgcgtgcatgcacacacacatgcacacacacacacacggagagagatttatttcaaggagttggcttacacagttgtgggaactgacaaatccaaattctgtagggcaggcca

SEQ ID NO: 235001 - DNA, 356 bp, Homo sapiens
gaccgtgtgagggagatactaccaccattttacagatgaggaaactgagggttagagaatgtaggagttgacccaaggtcatggtgcatctagtacatgatggatccaaggttcctatctggacagtctgccttaggcttacagtgctaagcaccacatgcagtttccccaatcatacaccttaggacaccacctttgtatgtgggtctcgtgccagagatgaacgtgggcgcatgcacacgcgtgcatgcacacacacatgcacacacacacacacggagagagatttatttcaaggagttgtcagttcccacaactgtgtaagccaactccttgaaaaaaaaccggcgcggccg

SEQ ID NO: 235002 - DNA, 458 bp, Homo sapiens
cacacctggccaatttgatttaagacaaagtctccctctgtcacccaggctggagtgcagtggtacaatcttgattcgctgtagcctctgccttctgggtttaagtgatcctcctgcctcagcctcccgagtagctgggattacaggggtgagccactgtggccagcctaacttttgtatttttagtagagatggggtttcactatgttggccaggctggtctggaactcctgacctcaagtgacccgcccgcctcagcctcccaaagtgctgggattacaggcatgagctaccacgcccggcccgtcaaatttattttcttgttagtaaatctctccttcgcatgctgtgcagttcacgtggctgcctcacttaccatctgctcccacccatgcaatgtctgctcacaagggccgggatctttgaactgtggcctctgctgtgttaccagcacactc

SEQ ID NO: 235003 - DNA, 449 bp, Homo sapiens
tagattggtatagctattatggaaagcagtatggaagttcctaaagaagttaaaaatagagccaccataggacccagcaatccctattatgtacgtacccagaagtgctgagattacaggcgtgaccaccgtgcctggcagttttacccttttgtaagccaataaaattattttaatgataggatgttctcttttctttaaggttttgtggtatagtattgaactgaaaatatttgaggtgactgtaaaatacacatatttcccaaaattattcttgaattaaatgtcaaaactaatataaaagcataattgaaaattataggcatcttgaaagttccataaagacagaagtaagggtcattcagtcattattactttagaaaccttgattaaatatgtgccatgtgttaggccttttgttagatgttagggtgagagattttatagga

SEQ ID NO: 235004 - DNA, 434 bp, Homo sapiens
ggttcttcctctaaaagatctgactcctagtgcccttgtcccgttagaatcccacagaccccaaaatggcattctatccctgtccttaggatggcgtgatggaaaagagctgagttcccctgagactggagcagggtcagaaagacagggaattgaggctgggcacagtggctcagcactttcagaggccaaagcaagagaatcgcttgaagccaggagtttgagaccagcctaggcaacagagtgagaacttatctccacaaaaaaattttaaaaattagccaggcatggtggtatgcctatagtcccagctacttgggaagctgaggcaggaggatgacttgagcccaggagttcaaggctgcagtgaactgtgattgcaccactatactccagcctgggcaacatagtgagaccctgtctctaccaaatta

SEQ ID NO: 235005 - DNA, 442 bp, Homo sapiens
agatgaatttttaggattaccagtagagtaagtcattgtgtaaattaacgtaataatattttatgaaagcaaaatattatgattgttttaagcatagtactggcaatatattagagtggctttgattattaatgtccaatcctactatttctcaatcacttgttttgctttatgttggtttgtttataagatttatttaaatttgtctattttttgtctttcaaatggtgagaattaacttgcatttttataaaaccactatgtcgaataccattccaacctttcttagtcaatttagtaagtaatagctcagaatgtgttggaaataactgtgcctactatataaacattaatcacagaagtttatgcataagccccattttaaacactatttggatgttgctttatagctataacaaataaaaaattttaaattattacc

SEQ ID NO: 235006 - DNA, 1953 bp, Homo sapiens
gctttaatgatttatggcaaactcatactagccttgatcagagaggtgaccctggcagttattgagcattaactctggaggactgacgccactgagtctttctacacactgtaatttagtgttcctatccaagatggccactaaattgcacttcttctattttcaccctctggagaatggtaaaaagcatgatttgcaaatattgtcaagtccaaagtgtgtttctaaactactaagctagccaaatgcatctctatatgttacaatgttctgcagatgtgaaaaaatccttcccgggtttatgaaagtgagaatgatatgcatctttagctgcctctggcatccggcacgtcacacagtgtggtcagtccagtcaggctgcccgagccacagattcccagcggcttcatttgtcagacaagctgacaggtgttggtcaggaaaatactgatcaagttgtttttgttgttgttgttttgagacagggtctcactctgtcacccaggctggagtgcagtggtgcgatcttggctcactacaacctctgcctcccaggttcaagcgattctcctccctcagcctcccgagtagctgggattacaggtgcccacgacgacacccagataatgtttgtatttttgtagagacggtttcaccatgttggccaggctggtctcgaactcaagtgatccacccgcctcggcctcccaaagtgctgggattacaggcatgagccactgcactggccttcaagatgttaaaagaaagtattattgtcaatgactgagtatttataaggacagaaattcctgaaattactccgttgatgctcctggtcctgaggcctcctttagagtacgggggagccttgatattgaaggccatggagggaagaatcagcagagcagcatctccaagcatcagcatctgggttccaggaaaaggtgcacgcactttgtgctggtagcacctgcgtcagattcccaagatgctctgaaacagaagcatttactggagtaaaatactgccttacaggctgtgcacagtggttcacgcctgtaatcccagcatttagggaggccaaggcgggcagatcacctgaggtcgggagttcgagaccatcctggccaacatggtgaaaccccatctctactaaaactacaaaattcagctgggcgtggtggcacacgccaggagtcccagctactcaggagtctgaggcacaagaatcgcttgaacccgggtggcagaggttgcagtgagctgagatggtaccactgcactccagcctgggtgacagagcaagactttgtctcaaaaaaataaatactgccttacaaaggagagggcaaaatagagtatttctgatgctgactgacaatgcaagtgacatgaaaatagcccccatgattcaactctaggccagcaactcttattactatgcctgtgaactctttgggaaacttacaaatataaattcctacatcctactctggtagtcagctttgtttggtctagggtgggtccaggactcctcacttttagtaattgtccctgccgattcttttttttaaataatggctttattgggatataattcacttaccataaaattgactctcataaagcatataatttagtggtttctagtatactgactgtgttgtgtaacaaccaccactctataattttagaacatttccatcatcctgcccccaaaatccatacctattagcagcctggccaacgtggcaaaaccccaaaaccccatctctacaaaaaaatacaaaaaaaaaaatagccggacagggtggtgcgctcttgcctcagtcacagctagctgaggggctgaggcaggattgcttgaaccaggaaggttgagactgcagtcagccaagattgtgccactgcactctggcctgggcgacagagcgaggctccgtctcaaaaaag

SEQ ID NO: 235007 - DNA, 1541 bp, Homo sapiens
gctttaatgatttatggcaaactcatactagccttgatcagagaggtgaccctggcagttattgagcattaactctggaggactgacgccactgagtctttctacacactgtaatttagtgttcctatccaagatggccactaaattgcacttcttctattttcaccctctggagaatggtaaaaagcatgatttgcaaatattgtcaagtccaaagtgtgtttctaaactactaagctagccaaatgcatctctatatgttacaatgttctgcagatgtgaaaaaatccttcccgggtttatgaaagtgagaatgatatgcatctttagctgcctctggcatccggcacgtcacacagtgtggtcagtccagtcaggctgcccgagccacagattcccagcggcttcatttgtcagacaagctgacaggtgttggtcaggaaaatactgatcaagttgtttttgttgttgttgttttgagacagggtctcactctgtcacccaggctggagtgcagtggtgcgatcttggctcactacaacctctgcctcccaggttcaagcgattctcctccctcagcctcccgagtagctgggattacaggtgcccacgacgacacccagataatgtttgtatttttgtagagacggtttcaccatgttggccaggctggtctcgaactcaagtgatccacccgcctcggcctcccaaagtgctgggattacaggcatgagccactgcactggccttcaagatgttaaaagaaagtattattgtcaatgactgagtatttataaggacagaaattcctgaaattactccgttgatgctcctggtcctgaggcctcctttagagtacgggggagccttgatattgaaggccatggagggaagaatcagcagagcagcatctccaagcatcagcatctgggttccaggaaaaggtgcacgcactttgtgctggtagcacctgcgtcagattcccaagatgctctgaaacagaagcatttactggagtaaaatactgccttacaggctgtgcacagtggttcacgcctgtaatcccagcatttagggaggccaaggcgggcagatcacctgaggtcgggagttcgagaccatcctggccaacatggtgaaaccccatctctactaaaactacaaaattcagctgggcgtggtggcacacgccaggagtcccagctactcaggagtctgaggcacaagaatcgcttgaacccgggtggcagaggttgcagtgagctgagatggtaccactgcactccagcctgggtgacagagcaagactttgtctcaaaaaaataaatactgccttacaaaggagagggcaaaatagagtatttctgatgctgactgacaatgcaagtgacatgaaaatagcccccatgattcaactctagttcaccacgttcatagtagtaaattggcgcagccgcaagttccacgtgctgcgaatcccgggcctgttttccacatcgtatgtccagcacagattcatgagatcgtacatctctcttgga

SEQ ID NO: 235008 - DNA, 2071 bp, Homo sapiens
cttataatccttttattcgtctcatgtagattccctaacacacccaccaccgtggccactccacagctctcccaccatcttgactcctagttcctgagaaaatcgaggctgacccacctgactttcctgtttccttcttcccacatcagagacctatatttcgctagcttcgtacccatcatttctcgctcaaagaatgcagcatccttccttattccaggctcacctctcctactataccctcatcccagccctcctccatcctctttacagaccttccctatggatttcctctgagcttttgcatttctaatgtggaatttctctgcttactgccttgtacttttgatccagctgaactaaactaactcaaatgtgtcatggtgttttcttcattttgcctgcttaactcatgtctttccagccttaaactcaatgctcttccctttgggaagagttttctgaccctccatctcttcccgtggctgatcacagcgtttattggacagggctctgcttgtcattttcacatgtgtgtccacctctggactgtcgctctagggtacagagcagcctctaccccagtgctggacaacactctgcccacacagatgggtgctccctgcgtcctgagtggactttcctgaaagagaaactgagtctggccttctcttgtttacaatttgccttcacctctgctctgaatgctcttggaggtctctagcccttctgtggtttgttgtcttttcccctcagtcttgctgcagcatctgccactgttaaacaccttcctgaaattctctcctccctgatggcctgtgacatgacacttcctttgctcttccctagcatatgtaaactctcctgtttctctccttcactggctcctccaaacccttagagatgggtcttcccacagttttgtttccaaacttctctctctgccctctcaccttctgtggcttcacctgtcacttgtgtgcagacaaatgcttcgtagtctgtgtgtgtaacctgaatccctctcctgagcctcacgtgtgtgtccagcagcctgattgacatcatcacctgaatgcagtcccagcatcctaagacccacacatccaaaagtcagctgatcacgggtcacacactagttcgggccctaagtagccccaactgggtcagctcctcagagcttctaaccctgtctccccaccccatctgtctgcccactgcgatattttcagatacttcagtttgtaaacacatactgactacctactgtttctccaaagcacagttctgatcatttctttcctcatctcaaaaaccttcaggacttccctttgcctagtaaattgagtagaaatgccttagtcagcatcccagatccttgtttttttgtttgtttgtttgtttttaaactggggcagtactcctgctttcctcccattcctctttcatccctgtattgaggtcagattctcccacctgtcactcctcttgtacacttgatacctgtgcagcatagtagagtagccattagccacctgcagctatttaaacttgaattaaaattgaattaaaattttctccttctgccagggccactcatcgcacattcctcctttttcacacaaactttcctgatcattcctttcttcatgagatatcccctcccttttgagcctcagtagtatgtttttcccttgcaaaacctacccattctttccttgtagccattgatatacttacctcatttctgaattggaagagtttttgaggtaaagactacatgaagggctgggtgcggtggctcacgcctgtaatcccagcattttgggaggccaaggcaggggattacctgaggtcaggagttcaagaccagcctgggcaacatggtgaaacccccgtctccactaaaaatacaaaaattagctgggtgtggtggcacgtgcctgtaatcccagctactcaggtggctgaggcaggagaatagcttgaacccaagaggtggaggttgcagtaagctgaaatcacaccactgcactccagcctgggtgacagagcgagactccgtctcagg

SEQ ID NO: 235009 - DNA, 985 bp, Homo sapiens
  misc_feature (966)..(966): n is a, c, g, or t
aatggttagaaagtggctaacatttgttgagcacctgctgtgtgcctggccccggctgggagccttcgtgcccagagtgaccccgtctgaatgcagttctttgcctcattcaaactggggagtgggaggcagagctgcacaactcacaggtgccgagctcaagactcactcctgggtctgcctgggctgggctgtgcttgttgcccctgtggccaacacacgcgcacctttcacctgaaagccaggatccgcagaacgttccccgaggaggtcgttgtttggcactatgatttgtctcttcctaaaaaggtgatagagttacactggagagagcagcatccaggtgcagcagggatgggcctggggctcacgggcaggggctctgtgtccggctggggcctggggtcctgcgctgcacctgtgtgtcagaagcactcagtaaatctttgctgatgaaggatgagaggatagaggacatgatgcttgctgctgcattgcctgcaatcctggatgagatgcccaggttggctttgctccccgtcgggtggatgtgatgttagctgtgatgttaggtccctggctttaaaatacgagggagctgggaattgagggagcaggttggggcagaaaggacagccccgcagaggcctggagctgaggcagtgcgggcgaccccaggagcagtgagtgcttccgtcacagccttcatcgcaccctgtggtcctcataaaggggatggaatctacgaatttagttttcccagcctccttaaaaactcattcatgccaggggcagtggctcacacctgaaatcccaccactttgggaggctgaggcaggctgattacttgaggtcaggagtttgagaccagcctagccaacatggtgaaaccccgtgtctactcaaagtacggcggagcacttgaccccagaggagaggtttagggggccgattgggcactgaccncatctggcatagatgagcc

SEQ ID NO: 235010 - DNA, 574 bp, Homo sapiens
cccacgcgtccggccttcatcgcaccctgtggtcctcataaaggggatggaatctacgaatttaggtccctggctttaaaatacgagggagctgggaattgagggagcaggttggggcagaaaggacagccccgcagaggcctggagctgaggcagtgcgggcgaccccaggagcagtgagtgcttccgtcacagccttcatcgcaccctgtggtcctcataaaggggatggaatctacgaatttagttttcccagcctccttaaaaactcattcatgccaggggcagtggctcacacctgaaatcccaccactttgggaggctgaggcaggctgattacttgaggtcaggagtttgagaccagcctagccaacatggtgaaaccccgtgtctactcaaagtacaaaaaaaaaaattagtcagacgtggtgtcacgcacctgtaatcccagctctttgggaggctgaggcaggagaatcacttgaacccaggaggcagaggttatagtgagccagtattgcgccactgacctccatctgggcaatagagtgagaccctgtctcaaaaaaaaaaa

SEQ ID NO: 235011 - DNA, 819 bp, Homo sapiens
gagatagaggcgtccgcggtgtaatttcgatgccggtaccgagtctctctagaggtctggaatcagcagcctgtgaaaaactgcccactcctactcctcaagtagtaaaggaaggtgattcctttccagataccttggcaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaac

SEQ ID NO: 235012 - DNA, 821 bp, Homo sapiens
gggtcaggtagcaggccggtggggaagagctgataaataaatcatctcctctagaggtctggaatcagcagcctgtgaaaaactgcccactcctactcctcaagtagtaaaggaaggtgattcctttccagataccttggcaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaac

SEQ ID NO: 235013 - DNA, 640 bp, Homo sapiens
agaaatggggtttcaccatgttgatcaggctgatcttgaactcctgacctgaggtgatccgcctgcctcggcctcccaaagtgctgggattacaggcatgaaccaccatgcccagcctctatcttccattttttatttgtatactatttaccaagcatgaaccatgacttttcaatatgtgttattatgggttttctttttcttaattctaatgggagttatcatagatttgtattaaggttttacttttttctttttttttttgaagacagagtctcaaaggaatagatgaaatataaaatgaaataaacatcgcataatgaaattgaatataaaatagaatagaaaagaaaaataaaaaaattattttggggctcaagttagattttcttggaataagaacggtgttttgttttgttttgcttgttttataaaaatgcagctttgagtggaaggaaaggtttacactgccaaaaaaataaaagttttgaaagtcatgccgactcttcatttttttcctctttacatggaaacttagctgtaatgaatatttagttaattcttccactctgcacttttttctttttagacggagtctcactctgttgcccaggctggagtgcagtgctgtgatctcggc

SEQ ID NO: 235014 - DNA, 1207 bp, Homo sapiens
caacccatctccgaaaaggattaagcatcactagggctccaagtgagttctgatcagaggctgttcggaagacagcaggggccatgaccaccctctctcctgaaaacagcctctctgccagacagtcagcctccttcatcctggtgaagagaaaaccacccattgacaagacagaatgggacagcttctttgatgagagtggccacttggccaaatcacgggacttcatttgtgttaacatcctggaaaggggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgcacgtgacattcagaaaatctatgacaaagatcccctgggcaacgtcctcatcgacaagaagaggctagagaagatcctgctcctgagttacgtctgcaacacgcaggcagagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagtcctctgggataa

SEQ ID NO: 235015 - DNA, 450 bp, Homo sapiens
agctgccccttagaggaaaaatttattgttctagcttctaggaatgttattggcaggtggcatttaaatctcagccccttcagggtttacctgaactgcagagaacgagcctacctgaccaagtacaagatcctttccaagtcagcccaggagggatgactgacagagcagaggcagaaaggaccagccattctggagcaggataagtgttgatcccaagggctcgcatagaaaacacgtgcacattaaactcagtatcctaatctgcttgtagacaaatgttacctgcaacatccagtggaagagagtaggaattcgggaagattaaagttgccaccattgcagagaaaaatcattattgagccgggtctcaaatttattattattaccattttccacatactggtgtccgaaaataaacctgaaataaatgcttaagaaaaaaaatca

SEQ ID NO: 235016 - DNA, 360 bp, Homo sapiens
tgtgctgttgataatgttttgtaattatttgataaatgtgggtgggagatacaggataaacaccaagggtgatatttatcttctttgaaactgtcttcccccaaccctggtaactatttgatgcagagcatatataatgcacatgaataaatgtttgactgacaactgattgattgatttggctttatcatcaagtaggtaggaaattttcttcaaatgcaactgcaaaggacaaataataatgtctcaggagagttatggattggcaaactagaaaatacctggtccagccacaatgagatatattgaaagctttcataggcacagatgtttgccaaaaaacacaaaacagcacaatta

SEQ ID NO: 235017 - DNA, 498 bp, Homo sapiens
ttttttccatggcttttgggctggtcttaggcacttgctgtcattgtaggcaaggctgttcttttttgtgttgtttacaaaattatgaaagaaaatcctatctcttaactggatggttataattttcattcattccaatagcttttgatataaataactgcttttctttaacagttcaattactaccatcttctaatctgtttcatagttagctttgatattttccctagaggaaatgacacctatataaaacttaactaaacttattatacaatataacttcaatattcaaagcccttttaatgagaatttaaaatttgtttctcttcgagtttcattttcttggtctaaccgaatcattctcacaataagtgagaaaatagagactactatctctctctatatattttttaaaacagaaggttaatttgcttgtaagtcgtggctacgttcgatctggagacttatctgttggactccaaagcacaaatttttttc

SEQ ID NO: 235018 - DNA, 482 bp, Homo sapiens
gacaatccggggctctgagagtgcattgccagcagacctccactatgagaattgttaaaggcacttcttcaggcagaagtatgaaagtttagatgtacccagaggacttgagagatctagaaatgataaatatgtgggtaaatagaaatggcattttctctgtcatctcttaatttctttaaaagataatggagtatttaaagtaatatggaatttataacatggaagtaaaatgtatgctatcagtagcacaaagggtgggagcaaagaattgggaatatactcttgtgaggtgtatacattatatgtgaaatggtgtaatattacttgaagataaactatgataagttaaaaaatggatagaatgaactctagagcaatcacctggaaaaaaaacacacacaaaaaaggggtgtaactaataaaccaatagtggagataaagtagaataagaaaaaatattccacaagaagatgggagaa

SEQ ID NO: 235019 - DNA, 635 bp, Homo sapiens
gaaaatatagataagaagaattaaagcccctttatgggatcctattttgtttgtatactaatccttgtttaatctgggaaggggaacaagttaacaaaccattcggacgaaagttgatacaaacttgaattttccaccagaatgtttagggaaggtaatgtgtcaatacctttttcctttatgaaaaaagtgttaataaaattagcattgaagaaaactagccagccaggtatggtggctcacgcctgtaatcccagcactttgggaggctgaggtgggcagatcacttgaggtcaggagttcgagaccagcctggccaacgtaatgaaaccccttctctactaaaaatacaaaaattagtcggtggtgggtgcctgtaatcccagctgcttgggaggctgaggcaggagaatcgcttaaacccaggaagtggaggttatagtgaaccaagatcgcgccattgcactccagcctgggtgacagagcgagactgtctccaaaagaaaagaaaattaaaattaaactgttcacagcccctcagaattaacgttgccagttttcctgagatggtaaggtcgtttcctggcccatgcctagcctacctaacctctctctgctgctctgttgatcatggc

SEQ ID NO: 235020 - DNA, 355 bp, Homo sapiens
aaagttgaaaatataatagccaataatagtggaattaataaataatgttgtatgataaaacagtatacagcagtgaaattgaatgaactcggctgcatgtatcaacatgaataagtttttgaatataattttgaatgaaaaaggcaagctgcctttactttaaataaccctgtctctactgaaaatacaaaaattagccaggcgtggtgacaggcacctgtaatcccagctactctggaagctgaggcataagaatcacttgaacctgggaggcagggcttagcagtgagctgagatggcgctattgcactccagcctgagcgacagagcggactctgtctcaaaaataaaataa

SEQ ID NO: 235021 - DNA, 679 bp, Homo sapiens
agttacttacctagtctgggctcatcattttcacaggtataacaggagtaatgacatggtggggatgaagtgggatattgtctggaccacgctttgcatagtgtctcatggctaggaagtactctatacaaagtagttactattattagctattatatttcaactgatgaaaggtacaaagaaactcccaggaagcgggtcattgctgcatgccgctgtctttaaagaacgcccagcagcaatcccatacgtagccaacaagatatgtggacgtcaaaagtaagtgctccttgggtgcagcacaccaacatggcacatatatacacatgtaacaaacctgcacgttgtgcacatgtaccctaaaacttaaagtataataataaaaaaattttaaaaaaaagtaagtgctcctatgcaacatacccagtaaattaatgattccaacttccttttcagttaaagcagtggatcagaatttgaaaaggagtaaaggtcaaggccatgaggtctaactaacacggtagcatcagagcctggcccatagtaggcccccagtgtctaccggctgaatggatggaggctggttgtttaactgtcaaaccatactctctgatgataagaccacagttagccagaagataaagtttctgcctccaatatttttgggtcttagaaagga

SEQ ID NO: 235022 - DNA, 363 bp, Homo sapiens
ggaacttgatggtaaaagtaaacagagcagtaactaaaggaagataagaagccaactatggcttccattttgttttatttttcaggtaggagacatttgagtaagtttatatattactggggaaggagacagaaaggagcaataaaaatacagaaatgaaaagaaagaagtgatgaacatcacttcgacaattcttcactttcaaaacgcaaactgtatcacccggggtccaattaagacacagaaaccacactataatttggttggggaaagtttaatataaaaaaagttggctgctaagcagtaacaaaagagaattggctgctaatggggtaacaagaagtctaaagaatagaggactga

SEQ ID NO: 235023 - DNA, 387 bp, Homo sapiens
tgctttttcccagtcatcgacccccaagcaaccactattctgattctgtcactacagacttattttgtttggtttgcctctaaatctcatataagtggaattgtacagtatgtattccttgtatctgacttcttttattcagattgatgtttttaggactcatccatgttgtgtgcatcagtagttctttttatcgtatagattttattaatgtagcagtttattcattttcctgtgggtagatacctagcctctttgcagtttggactattgtgattaaaactgctgtgaagattctttgtggaaagctttttatggagagatatatagagagagatggtttcactctgcactccagcctgggtgccagagcaagactccatctca

SEQ ID NO: 235024 - DNA, 709 bp, Homo sapiens
ctgcaggcagtgtcaggacagaggaggtagagagcagggcatatgctgacccatgcagccgaagaaagaagaggcagcaacaggaggaggaggacttgaacctagaagatagaggtgaggaacttgttttaggttgttggaaacagggaaagcagagagcagagcatgcagtgatgaaagaggaggaagaagctacagcatctgaaaggaatgatgcagatgagaagcacccagaacatgctgagcagaacatcagaaaaagcaggaagaaagaaaagaaaaggagaaaggaaaaaacaaaaaagaaaaagaaaaggcaggaaaggcaggaagaaagaaaagagaaggaaaggaaaggagaaaggaaaaaaagaggaaaagaaagaagaaaaggaaaacaaaacaaaagaaaggttgtagaacagaaaaacatagtaactaaatttaactttatacaatgggctgatgaatagattagatacagataagagaattaaagcatcctgagtgaagaacaatgagacagaaataacatacactgtgccactgacatgtaattggaggcccaggaaggagaagaaaaaatggggcagaaacagtaaacatataatggatgagaatcttccaatacttgtgaagctcatgaaaccatagtctcaagaagcactacaaaatgccagcaggattcaaaaaaagacatctacagacc

SEQ ID NO: 235025 - DNA, 321 bp, Homo sapiens
ctgcatccagcttgtcattttgattttttttaaggatcatatcccccaaaagaggaaaagtaatgtccaaattatttttacttatttgaacttttcctaaaagtgactcagtgctgagatgcaatttatttctctttttatatactatcaccattgtatgaaccattttcattaagtgaaagttgacttgtccttcatctttagttcattacaattagattttttttaaggcagtttgaccaaattgtgtcttccaggatggcgttttcatacaaaagaggaaaatgttaatccaaattaaaatttaattagttaaatatg

SEQ ID NO: 235026 - DNA, 135 bp, Homo sapiens
gataatctctggtacccccaagccaaacaagtcaggtcatggaataatatggaaacagaggtttagacttaagaagactctgcccatgactcttgaaactccacaaggaaaacagaacactctaaaaggggtgag

SEQ ID NO: 235027 - DNA, 730 bp, Homo sapiens
gatggaccaggagggggccctaaatgttgcagcctcagcatcgccacctttggtctctgcccttgcactatcagggtgttgaggcaagaagaaggaggagaagttgtttcaggcaccatggtctcttgtcctagccttgctcctgctgcttttcctgaagttaacaacctctgcctcagggaaaggctttatcatccacaaggcagtatcatccacctccttctgcttcctacgccactccccaggcttaagaccccagccttctccctgtttcttgggatctcagtcaggtagcctctcttcctagtcaccttgatattccccaccttctctccaccctagtcagttccctttctttctctcctcttgcccttgatctccctctgcctttttctgcctttccttccctgtaatcctgtggctggagataggctttgggctgtaattgagaccagagctggacctgggacctgcatctacttctgcaggcaaccagccagtcatgtcaccttgatggagtctgtcacctctttgaacctcagtcttttccctgaggccaatcagtttatgtgatgtgtgtagccttttggctttccaggactctcagctcttcctctctgtcctccacatcttctactgccttttgcatgggaaggtagagaacaacacccaaaggatggtgtctcctgtcccagttgaaaaggtttctacctagctattgatctggcca

SEQ ID NO: 235028 - DNA, 423 bp, Homo sapiens
agccagtgatacaaaaaatatattgtggaagtgtcttgtcttaattctgcaatcgcttctgtacatgtttgaagtcctagaccccaggaggagagacagtcaaattagccaaaggtaatttgtgaagactggccatgggaggtggtggctaaaagtcctccggcccctgctgtctgagcatccccacagaaagtcctgggccgcactgacagctgagaaagaacatctcagggcttggatcccctgttcagaggacacatgctcctccacccagtagaggaatggcggctccatgctgtgtcctgcagagctctcagactctgcacttgaggccctgggcctgcatcaatgtgaaggctcttcagtgttatcacgtggagacagatgataggaatcctgcaaatgagcagaaaggatgtgacg

SEQ ID NO: 235029 - DNA, 401 bp, Homo sapiens
gaaaggctgaagaagcagaaacagggaacgaaaggtagattggcgtttcagagttacttcccttgcagggttaaagcatgggggacttcctcatcaaacctgctcaggtaaactgggccccttctgattagctgctgtgcatctcctatttttttgaaaagctgccctttttaaagttccgttggacagcctggcacctagcaggagtgactccattctggtttggtctggtccgttgggcctagtgtaagagttcagtcctcccataaattttatttaagattattcttgaactactattctccttgctattcatgggctttcccaattaccaatataacagagcctgttctgaatcatccataatccaatccttcgcatagcatatattctgcactctg

SEQ ID NO: 235030 - DNA, 229 bp, Homo sapiens
ttttttttttttagcagtttgagttggtgtagtgtattcttggttatcaaaatactcatatagctttgggattttgaattggtaaatattcatgatgtgtgaaaaatcatgatacatactgtacaatctcagtcccatgaaattggatgttgtgcctactcacaggatctagaagcatatgtcaaactataaactgcttgtgattgtgaatgactttgttctttgcttc

SEQ ID NO: 235031 - DNA, 574 bp, Homo sapiens
ttgtgagttattaataattttaaatatattaacatatgttaatgtaattaaatacaatgctggaatccatttgctaatattttatttaaagttttttgtctttgctttggaatgtgattggcctttcagttttgtctgtttattagaatcaaggtatatctgcctcatgaaaggtatgtgtttgtttgtttttcctttctattctctgaaagagttttggattatctattcctttagtgtatggtagaacactcctaaaaaacttttgggctggtgttttttaatgggtagattttaattactgattcagtttctttggttgttcaatagtttattcagattttctgtttcttttttgagttagttttggttctacatttgttttgaagaaattgcctgttttacttattttctaattaatttgtaatatagttgttcaaagcattattttatgattgttaaatatcaaccgtatttgtaactatgtcttcttttgttcacagcacctttttttttttttttgtctgagtcccactctatttagcctgggcaacaagagcaaaactctgtctcg

SEQ ID NO: 235032 - DNA, 351 bp, Homo sapiens
cattgtttttaaaatgagtattatatttcattaaatctaagacatctcacaattttaggtaccacaaagaaaaaatgaagccaaatgaattgtgacactttgtcaattaaaagacacattccctgggaggccgaggtcaggagtttgagaccagcctggccaacatggggaaactttgtctctactaaaaatataaaaattagctggtcatagtggcacacgtctgcggtcccagctactcaggaggctgaggcaggagaatcacttgaacctgagaggcagaggttgcaatgggccatgatagggccactgtaccccagcctgggcaacagggctcaccctgccatctca

SEQ ID NO: 235033 - DNA, 336 bp, Homo sapiens
acaatttatgattcgtattcataaaatttggttatattgacttctctgagaaccttagaagaaggggctttgcaaaacaatggaggaataggatagaaaatctagaacatttgaaacttaccacaatttgaccttggcaacgatttgttgactgtgatcccaaaagcataggcaaggaaagcaaacataaatgggatagtatcaaacaaaaaaaatcaacacagtaaggaaaataatcaacagagtgaagaggcaaactaaagaaatgagagaaaatattggcaaacctaagatgtttatatccaaaatataaaagaaaatcaatgctccatctca

SEQ ID NO: 235034 - DNA, 114 bp, Homo sapiens
cttctcctttgttctcccttttaccttcaggcacccacttgcatctcttctgggggttctttcctttctttcctgttctaaggctttttaaataaacttccatttcttctctga

SEQ ID NO: 235035 - DNA, 361 bp, Homo sapiens
cagttaaaatatctcaattaaaatcatacatactcacatgttcaaataaactgcaataagcttctataaaattgcttagaaaatataatttctgttttaaatttgtaaattatttcccaggtcatcaaattaataattgaaaaaaaccttctaataattggtgggtatttctgcctaattttcattaaaagtggtagtttagtctgtcctcctgaagcacttaacctgattttatatcttaataaaggaacactatttaggagtttggggactgtgctatgctgtgaaagccattccttggagcccatttttgttattgatgaaattcttccagtctgggatgaacaaactgtaaagccat

SEQ ID NO: 235036 - DNA, 597 bp, Homo sapiens
taggggccattcacggcccgctagaatccctgctgtgcaaaaagcttgtaaacaaccattgcctcatttcatctttcccctaaacattatttctgagattcatctacgttgattcacatagctcttttagtcccaagagggcagatatgaaccgtcccattttacagatgcaaaaccgtgactgctcgggaaaaaacgagtggctttgcgacgacgaaatcccaggacgccaccgggccacgtgcggcggcgcatctggccgctcgcgatcccacccgcgcacgctccctcccgcgctccctcccagccgccgccgcgccgggtccacgtgtgtgtgtctgtgtgcggaatggggacgggggcggtgccgccggaggggtggggtccgggccaacgtcacgggcggtgcggcccaatcagcggcgggctcgcggccccggcgctggtattggggcagcgagggggcagttctctataacgcggtctccgggagccagcggggaagaaagaaaccgagcgggcggaaggcgccctccccgccgcctgggcccgggcaccgggtgccgggcccggggtccttcccgcctcccgcggccg

SEQ ID NO: 235037 - DNA, 521 bp, Homo sapiens
cagaatgtggttgttattaaggcattgaaagggcttttctttgataagatcgccttgtcctgcattgtttgcggctgtgttggcctttcagcggctcgggggagctccctctgatcaggcctgtatcttcccaggacgcttttgttgtggtttgcaaagggttttacctgaacaaagtcagcctgcggggcattaaacacctccaggcaactcccaggcccttcagatctttctgtgggattgggcactgggcgattgaacctgttcagctgcaagaagacccaaaagtgggacggagccagagagaacagcttctggccagggctctgccaagggctgagccaagacagacctggtggagacgccaggctcgggcctgctccaacattgtggacactatttgtcaaggcccttcagtaaaacaatcaatctgggatttaatatgttgactcaatccaatgagcatagatcactggtcaggataactctggccggatttgcagcaggaataaatggaggat

SEQ ID NO: 235038 - DNA, 498 bp, Homo sapiens
gctgggattacaggtgtgagccaccgtgccccgcccatgtagcatgtagaatgtagtcttttctaagaggttaatgctcccagctaaaaaccttttctttccggaaaaagggaagaatgaatgttgggtaactaacactcggcagtgccctctccctatgctctagaccccctcccctctgacagtccctgctccagcattatccctcccctcacctcgtgtcatggctcttctctcctaacctgtcctttcggtaattaattgtgcaacccttaccctccaccatcccccttgaccttaggtagccctctagctgttgtccagttattttgtttttcttcagagccaacttcctggctttctcattgccctttcacatttcagcttgttataatgtggcttcgtaggccatcattgcaataaacctagtattgctgcagtgagccatgacagtgccactccactccggcctgggcaagacagcaagaccctgtttaa

SEQ ID NO: 235039 - DNA, 482 bp, Homo sapiens
cagcctactctgctgtgcaggaagctgccaggaagcttccttgggttatctcatgctgtcctcagacagtagcctaagacagcagcctaggcatttccaatggaaagaactcttcagtctgagcagctccacagccaagcatttcccccaccctcatacccctcctgccaatgcccccttgagtaaagttgagctaccaatcctcctgccaattcctttcatataaaaactctggggtcccacaccaagaaaagaaggaggcagcattagaggagagaggccaggggcacagaggcacccactgagttagtgcaaaagcgggcatggctcagccctacctgggtggcactggcagttaggggcatgcggaaagcccaagtcagtgattagaagggacgttagtgtaggcctagttggcaagcgtggagttaatttggcacagaatttgggagtgtggttttgggggccagagccaaagctcc

SEQ ID NO: 235040 - DNA, 489 bp, Homo sapiens
agccccctgctttcacgctatctgacagcaccacagcacacttaggttgcacagaaacagaatgtgtgtgaggggcacagccttaagggccactaaaggatctatttgggagacaaggaatggagaaagaaatgagtctagggctacagagaggtagcaccagagcatttttctttggcagagtggctgtttgttacaatttgtttttcttgtgcagaaatatggagtttttttcttgaacaactcaaatgggtcccctgtgtcgatgcctcactacacagattatcggtggtgaaagccccaggttgatgtggcctgagcactgatcctatttccaggagacacttctgcccaagggaagttgctattgccagaggatggggaaggatgatttttggctaaaaagaacataattaagatggcaaaacaaatgccttggcaaaataatcccatgagattcagcaaaagccaggtataaatgactgtttg

SEQ ID NO: 235041 - DNA, 739 bp, Homo sapiens
cacatggtgtttaattacctactgctgactatccacaaacagaaagagactggtcatgccccacagggttggggtatccaagataatggagcgaggctctcatgtgtcctaggttacacaccgaaaatccacagtttattctgtgaagaaaggaggctatgtttatgatacagactgtgatatttttatcatagcctattctggtatcatgtgcaaaagctataaatgaaaaacacaggaacttggcatgtgagtcattgctccccctaaatgacaattaataaggaaggaacattgagacagaataaaatgatccccttctgggtttaatttagaaagttccataattaggtttaatagaaataaatgtaaatttctatgattaaaaataaattagcacatttagggatacacaaattataaatcattttctaaatgctaaaaacaagctcaggtttttttcagaagaaagttttaattttttttctttagtggaagatatcactctgacggaaagttttgatgtgaggggcggatgactataaagtgggcatcttcccccacaggaagatgtttccatctgtgggtgagaggtgcccaccgcagctagggcaggttacatgtgccctgtgtgtggtaggacttggagagtgatctttatcaacgtttttatttaaaagactatctaataaaacacaaaactatgatgttcacaggaaaaaaagaataagaaaaaaag

SEQ ID NO: 235042 - DNA, 2869 bp, Homo sapiens
  misc_feature (821)..(821): n is a, c, g, or t
  misc_feature (981)..(981): n is a, c, g, or t
  misc_feature (1750)..(1750): n is a, c, g, or t
  misc_feature (1891)..(1891): n is a, c, g, or t
  misc_feature (2065)..(2065): n is a, c, g, or t
  misc_feature (2272)..(2272): n is a, c, g, or t
tattgtttaatgtagtagactacatgggaaaataactctactttgaactttttaatttaatataaacatccccttgttgctggacaacaagttttgtttacactgccactaacagaatatcataatatgaaacatgatattcatttgaatatttgaggggtacttcattataagggagtgggattccttttctagctttcttaggcagagtctctcccatctacaacaataaggccatgctcaagtctccagaacaatgatcatactgtattactatttttcactatgtttccagacagactggtaaattcctttttgtttgtttctttttgttaattctaacgttaattgaaaacagtggtttttgttgttgttgtttttgtttttgttttgagacagagtctctctctgtcacccaggctggagtgcagtgacgcgatctcggctcactgcaagctccgcctcccaggttcacgccgttttcctgcctcagcctcccaagtagctgggactacaggcacccgccaccacgcccggctaattttttgtgtctttagtagagatggtgtttcaccgtgttagctaggatggtctcgatctcctgacctggtgatccgtctgcctcggcctcccaaagtgctgggattacaggcatgagccaccatgcctggctgaaaacagtattttaagagcaatgttctgagctctttttgagctttagctacatggttcttgcattaacctatgatgtaggcacccttatagaatatacagctggtgctaaataagtatctgttgaatgaatgggtaaacaaattcantgttacagatgaggagaaaaaaatctggttttgttaccttcattttctctttttctagcacatgccttgtccataggatagtcaggatgacagtgggaagtgtcagaccagcctaaggttcaagttcatctctctgactgaaaaagagctgccggtgatngagctctgctttgagcttggaataatgctggtgctttacatgtgtgttgctaagccccactaaaaccctgagacatggggtattattgtccatatcatacaggtaaggtaagtgactagtttagacttgtacagtaagtaggaacagagaagcatttggaacccaggtttattggcagttgagtcttgtgctctttctagatcccacagcttcccatttgtcttgataagagaagatgtctgcctctccgaggtagtgttgtactggttcccttccctttctcctcaatgactattttgttggttaaagataaacttggaacattctccacagggaagtgatggaagtgtccacgctgacaaaatgctatcatgaaatgccttttttctgccctgtaatgaagagtgtttccgaggcaaattccaagtcgttgagttactcttccacaagccaaccattaaatctaagaaaggggaggtggggaaggcatcaaataaattttgaatacaggagagcttggtattgagtaccttcagaagggcagtatgttgacttcttttctctatatagaacctgaatttgcattgctcctgcttctatataaagctttatcttgggcttcataaagagtagctattttgggctagacacaatggctcacagctgtaatcccagcactttgggagatcaaggcaggaggacaccttgagtccaggagttccagactaccctgggcaacatagtgagactccatctctacaaaaaaatntaaaatcagccaagtgtgttgtcactttcctgtagtcccagctactccagtggctgaggggaaaggatcacttaagccgggaggttgaggctgcagtgagccaagattgtgccactacactccagcctggatgacagaacnagatcctgtttcagaaaaaaaaaaaaagaaaaaaaaaaagctattttgactaaactagtaacatttctcagggtccaaaccttatggaacaaagttatggaacaaattttctagaaagatctaatatgcctcctctgacccttacactaaagacaacaacaaaaaggccaggtntggtggctcacgcctgtaatcccagcactttgggaggccgatgcaggcagatcacttgaggtcgggagttcaagaccagcctgaccaacatggtgaaaccctgtctctactaaaaatacaaaaattagccagatgtggtggtgcacacctttaatcccagctactcgggaggctgaggcaggagaatcacatgaacctgggaggcgnaggttgcagtgagccaagatcgtgccactgcactccagcctgggcgagagagtgagactccatctcaagaaaaaaaaaaagaaagaaaaacaacaacaacaataacaacaaaaaaccctaaaacataaaacaacaaacaaacaaaaacacctcacatgttttcttgaaggagtgaaagtacgagttactgaaattcataaggaagcatgccctggctccatgtctgctccagtgctttcacccaggaagggcatggagtccagatggggcttcaacttgcatcccagctttgcagtcccatcaggaggggcaacaacactttgtgtccatcacaaagcttcatacaccccttcacttctggttcacatgagtgacaatacattttcttcacagttccggttctcagggcttcacattctcgtgacttcagagtttaaaggaaaataatcaatgggcaagtatggtggctcatgcttgtaatctctataacctttgggaggctgaagcaggaggattgctagagcccaggagttcaagaccagcctgggcaacatggcagtactgcatctctactaaaaaatgtataaaaatgtcttt

SEQ ID NO: 235043 - DNA, 420 bp, Homo sapiens
cacgcccatctaatttttaaaaaagtttttgtagagacagagtctcactatgttgcccaggctggtctcaaactcctaggcttaagtgatttgcccacctcggcctcccaaaatgccgagattataggcatgagccagcacacctggccaagttaagcttttctttgcccttagaacgagataattgtaaaatgaaaacattgagattagtttttttggtctgtaaatctcatgttacatatagtttaaattacattgagtgtgattggaatagatactaggtagaaaaatattatctagttaatctataccactttcctgtgaaaagagagaaaagaagacacatatttatttaacagagaacacaattctgatgggctggagatgagtctgtgtaagtctattaacttatatttcaca

SEQ ID NO: 235044 - DNA, 416 bp, Homo sapiens
tacactggtttgcataattgcaacatccattaggtgatctaggttgcttttcctttatcaagggctttatttatcagaagggcattacgcttgacctccaaatttggctgacaatttactgatgagattcttaacctttgggttgctctggcattttgacatatttgctgggttctgggccacatcctggaaggccaccataacttctgaaccctgcatggctgtgagaacctctggtcactaagaattttgagtccatgcattcctgccattccagacatgtcccctcccattccaggcatttctctgagaaaattaccaggcattctcccagaaaggccacttggaaaagagccatactgagctctggatcatcttctggcttcttcctccctctgggatctctcatgcttttc

SEQ ID NO: 235045 - DNA, 447 bp, Homo sapiens
ttgtttctattttgattaatgtctgtcttctccccagctccaaaagacaagaatgtaactttacaggttctttctgttgtgttttggtctctgagtacaatacctggcacaaagtaggtaatttgtaaatatttcttcagcaaatggtgattgatagtagttggtctatcattcctgtgacgaaagatgccgaagtcccagatttctattatcttgagcccctttgaagtcctctttgaaaaccaaaccaaatagtttacttacaaaccaagtggttactctttaagtggtttattttatcagttttctaaagttgcctttatgttacagggctgaggttctttttgaggagtgatgatgtgttttgtggtgttaaggacagtttgtggtcatgactattttacagtcaaagacccaaacatcagatactaaagcccttaatagaaa

SEQ ID NO: 235046 - DNA, 410 bp, Homo sapiens
agctaaagtgttttggggtattgaaagcctaatgtaaatgtccttgggaaaattagtttcttttttttatagttcccattatttaatgaaatgtttcaaatgttatatatagtaaacaacagataatataacaaacacccatttggtaaccatttagatttagcacattttaatgttttactatgatttattcagatcttttgatatatttttaggaaactgaacaattgtgacaaagctcaaatttcctttgcatagaattctcatataagaacaaaacagaatattaaaggcctggcacagtggcttatgcgtgtaatcccaacactttggtaggccaaggcaggagaatcacttgagtccaagagtttgtgaccagcctggacaacatagggtgaccccacctctac

SEQ ID NO: 235047 - DNA, 252 bp, Homo sapiens
tgccacctccctccccctcgtccccgccccctggagcgggagcatttgggttgagctgcgcctgtcctataaatccacatataattctcctctttcctgttcagctaaggaaaataaacgtgtaaggctgtttctgggagcccagctcagggaccgctctaaattctcctcttattgagtaggggctggaaatcattcagctcggcggcgcgccccagaaccaccccctacccccgctccggcccgcggccg

SEQ ID NO: 235048 - DNA, 572 bp, Homo sapiens
tggcagtagaagtagtcttaacaagctgtatctacataaattattatgttattataaatctgactctgaaatgcacttggggaaatggtaatttaaagacaccctaaaggggtttctttgacaaagagaaacagggaagcttccgcctctatcggcctcctgtgagacgcagactttcctacgctgagtctcttagcgggagggatacccacagaacacactcaggaaaaacaaagcagctttctcatccagagtcctcaacaatcaccagtcaccttcagttatctttgaagaaaggactagaaagaatgaaagaagctgtgaaaagtcagataattttcaagaccttttcacttctgtttctgtagaaaaaatgaaatggaaccagttggcaagtgtgtcaggtgtcagggaaatctgattaatgacacccttctatatgacaatcattaataaccatgggataaaataagggatagaaaaaacgcatgcagtaaagcttttcttttattgaattttatatttatcataccagttaaaaaaaaccaagaaaataaaataaatattacagt

SEQ ID NO: 235049 - DNA, 246 bp, Homo sapiens
ggcaccagctgggattccctcctggatgaatggctttttctggtggcctctcacctttcccaggagttttaagggtgtaatttattggtggccctgatttccagcttcagaggtgccatggtcagggagaaccctctgaggccagggggcatcacctgaatggctttttcctgcctccctttctgagcagctgggtcagactccctctgcccaagtcaggtttgctgctgtcctacagggacaggt

SEQ ID NO: 235050 - DNA, 585 bp, Homo sapiens
caatgtaaccatcagctctggggtcaagaaatcgaacatttggcacctcagaagccatattcatgatccctcccaatccttgccacttacctctttcccaaaggtaaccactgttctgatttctaatgccataaattaattatgcccattttggaactttatgtacagtaagtattcttttgtgtccagctttttttgttcaaggtgtatttgtgagattatttcatggtgttgtatatatttgtagtttattttcattgtcatatagtagtatatcacagttaaaatctgttttcttattaatggatatttgggttgcttttagcttgagactcttgtgagtaatgctgctttggatggttttctgcttatcctttgacatatatatgcatgaatttctagtgagcatatacctaggagtggaactgctgggtcataggatatgcataaattaaactagggaagaacaccagtttccaaagtggttatacaagttttccctcttacctacagaggggaagtttcagttgctccacatccttgtcaacacttgatgttgtcagtctttttttttttttgagacag

SEQ ID NO: 235051 - DNA, 347 bp, Homo sapiens
acactcttcttcttccccaattctgtattttctcctatatatagattggtttacccaccttcttctccagtgatctagaagttgggacagtctattttaaattccactttaagccattacaaatttcaaaacattattaagcatatttatataattgtcaaatataaaaacaaaataactttagtttttcatgggagatttagacctagttttaattctattgtttctagcatttagaattgcaaaaaagaaggcaaattccctttcattctgttgtatgtaatttcattttgtgttgtctagaattttttagagtctttctttacttttgagctttaaaagtcatc

SEQ ID NO: 235052 - DNA, 520 bp, Homo sapiens
agcaactttggaactgggtaacaggcaggttggaacagtttggagggctcagaagaagataggaaaagtttggcacttcctagagacttggagggctcacaagacaggaagatgtgggaaagtttccttcctagagacttgttgattggttttgaccaaatgctgatagtgatatggacaataaggttcacgctgaggtggtctcagatggagatgaagaacttgttgggaactggagtaaaggtgactcttgttatgttttagcaaagagactggtggcactttgccccagccctagagatttgtggaactttgaacttgagggagatgagttagggtatctggcagaagaaatttctaagcagcaaagcattcaagaggtgacttaggtgctgttaaaagcattaagttttaaaagggaaacacagcataaaagtttggaaaatttgcagcctgacagtacaatagaacaaaaaaaattcctaaggagaaaacttgcagcctgacaatgcaatagaaa

SEQ ID NO: 235053 - DNA, 455 bp, Homo sapiens
caataggagctgtgatacccacagcttttttcctttctgtcctgccatttagtcagacataagcatagtcaaggaaatgtgtggtatcatagggtaactaaagctccagctttatgactggagaagcaaaaaggggagtcccaggaaactagaaagtaccagataaatcacgatgatggaggactcaggaaaacaacctcatgaagttgtttatgaaatactgagctcaccccctgacctgggcatgcatggatcccatctcagtcacaatgtcaaaaacggtgagaagtgaacaaacaacctgccaccttagactgaccacaggatggaacatacatgagacatatttgaatggcactgcaaaggctttgaaaatgtagctgacattggagccaccgcccatagaagaaggctaaaactgtggaatgaatctagccaggttgtttacatgctaa

SEQ ID NO: 235054 - DNA, 461 bp, Homo sapiens
tcacctttaaaccttcactgacttccctttgcaggtgcactgtcattttggtaactcaacactgtctgcattttattttggtgcatgggcggggggctctggcttcgatttagtccttcagacacatacagtgaaataaataggtactcgacgatagtatgtgttgttgctgtgtagttcttttgctcctgaacagcaaataccattggacttggcattgtcctactgtggctgcaagctgtgtctcaccacagctaacgccagtgcagaggagccatgccacgcaaaaggtccccttgcggcagacacaagcctgaagctcttcagtcatgaaaatcagggaacacgtcattgatgactgtcctggtcctggcacaggttttaccaaaatgcaatcaggtttcgccagaaatgcagtcatgtgactcctttcttctctgagggaggatggtgttcatgaa

SEQ ID NO: 235055 - DNA, 598 bp, Homo sapiens
caagattacctaaaagcactaaccaaaggaaaagctccctcacctcaacctatgactgctcacatttttcagattgaatcatttcaattgtattttaaggttcattgactctttaccacctccaagctgctcctgaacgcaactgattattattttttaattttgaaaacgttctcacttctagaatttccacttaagcctttgttattattgtagtttcttcttctctgctgtgatttcctatccatttattttaagggtttttggggttttgattttagtaagaattacaataactactttaaaaatccacactaattccaacatctgggtcatctcgaggtcagtctctattgattgcctttttctttgaatatgtttctttatatgtttattataatgggattgaattctgaagattgtaaaactagattttgttctgttcctctgaaaattttgataattttttgttgtatttgttgtattgtgcttgattttttttctattgtatactttacaatatattttcctccaatggttttaacatatctatttctcaaaatatttatgtttatgttaaaaattatacaaagtagct

SEQ ID NO: 235056 - DNA, 458 bp, Homo sapiens
ttgacataaataaggtagtagtttaaagggaaagtaatgattagcaaaacttatgaagacaggagcgatcaacgcacattaaatagtgtgtaaattacctaatcctaggcttgctgaatcttcagacacgtatatacataatatatttttgtgtcacaaaccagtcactctgtgttttctatatgaagagaaaataggtttgtgttaagaaatgatctctgaatgttcaagaaaataatactatgggcttgcttacatgggtggaaggaagatctccagtccgcggggaacggcagcacttttaaaactttgagattgatgagtggttaattagaccctcagccactcctatggtaagtcatgatggatgccaagacagcagtaaggggttgtgattttctttgttttcttccttgtgcaccaaagacacagagatggagctggtctcttgttttatt

SEQ ID NO: 235057 - DNA, 388 bp, Homo sapiens
gtgagccgagatcgtgccattgcactccagcctgggcaacaagagcgaaaccttgtctcaaaaaaaaaaaaaaagaaaaaaaaaaagaactgggaagattacataatatcttcagggctcctgcaaattataagaaaagaccaataatggaatagaacaaggggtaaagagtatgaatgagagtccaaaaaagaaaaaggaaaaaatacaaacagtcgtagacataataaaaggtgtaaggtgtacaatatagcttataatagaaatttaaactaaaatcacattgaaataccattgttcattcatcagattggtagtccatcgctggtaggagtatagattggtgtaatattctataatggacaatttagttatatctattgatatg

SEQ ID NO: 235058 - DNA, 1754 bp, Homo sapiens
  misc_feature (102)..(102): n is a, c, g, or t
  misc_feature (689)..(689): n is a, c, g, or t
  misc_feature (710)..(710): n is a, c, g, or t
  misc_feature (903)..(903): n is a, c, g, or t
  misc_feature (1312)..(1312): n is a, c, g, or t
  misc_feature (1332)..(1332): n is a, c, g, or t
  misc_feature (1676)..(1676): n is a, c, g, or t
  misc_feature (1713)..(1713): n is a, c, g, or t
tgcatgctggaaaatggtctgtctttaaagaaaatacctgctttgcaagaatattcatctcatctcttgcaactttttctcaaaaacatcctttatttctgnagggatgaaagttgggggccacacacgacttccccacccattggctggttgccctctagcgatggaacttagtaaggcctcttcccttgagactggacaccccaccaggccagtgagagcacaggacacaggtgcccagactcggccagcggcaaagtatagatggagtgatattaacccagtatcactgtctagcccaggcacatagattccagattctgtctggggggtattcaggaggtgtctaacacatcatcaagagcctgtgtgttttcaggatgctctgcagaatcttctgccctcacaccttcatcagtgtcctctgcccgaggagttccttaaaaatcttcagcatcactgctcctgccagtgccccgttcagtgagggcctgagcgatggtgcccagggttctgtcttctagcatctgcgggcccctggcctcagaaccctgcagccaagtgggatacatgctgccctccccattctgcacagcaccttggccctgaggtagcctgcctgtacctcgcatcacccagcatccctggaacaagcatctgttttccgtagtccttctctacatagagcnggacaagaaacaggcctatgnagtccttgggattccctgattccggaatccaacactaaggacctgctccatgcaaaaggcaatggtgaggctgtctcaccaagacagccacccaaacagcccctggtcttccatcaaaaccagcaccctccacaacagccaaaaggtggaaaaaacccaggtgtctgaatagatgaacaaaatgctatccaanaaacacagggaatattattctgccttgaaaaaggaaggacattctgacacatgctacaacatgcatgaagcttgaggacattatgctaagcgaagtaagcaagtcacaaagggacggatactgtatgagtgcacttacaggaggcacctagagtagtcaaattcatagaaacagagagaagaatggtggctgccaagcagaggaggaagggcaatgggagttgtgtgatgggtacagatgatgaaagatgaaaagagttctggaggtggatggtggtgatggttgcacaacactgtgagcgtagttaatgccactaaactttgcacttaaaaatggttgagatgccagcctgaccaacatggtgaaaccccgcctctactaaaaatacaaaaattagccgggtgtggtnacgtgcgcttgtaatccagntactctagagggtgaggcaggagaatcacttgaacccggaggcggaggttgcagtgagccaagattatgccactgcaccccagcctgggcgacagagtgagactccatatcaaaaaaaaaaaaaaaaaaaaagattgagatggccaagtgtggtggctcatgccggtaatcccacactctgggaggccgaggcaggtggatcacctggggtcaggagtttgagaacagcctggccaacatggtgaaaccccgtctctactaaaaatacaaaacttagccgggcatggtggcgggcacctgtaatcccaactacttgggaggctgaggtaggagaatcacttgancccaggaagtggaggttgcagtgagccaagacggtgncactgcactccagcctgggtgacagagtgaaactctgtctc

SEQ ID NO: 235059 - DNA, 433 bp, Homo sapiens
ctctttttgaccaggctggagtgcaatggcgctatctcagctcactgcaacctccacctcctgggttcaagcgattcttgtctcagcctccgagtggctgggattataggcacataccaccacgcccgggtaatttttgtgttatttttagtagagacagggtttcaccatcttggccagtgggtctcaaactcctgacctcatgatccacccgcctcggcctcccaaagtgctgggattacaggcgtgagcccgcgtgctgggcctcaatcccaccttttaaaggcttctcctactgtgcccatttgtagtcttatcttttccccaggaattcctatagcacttaggtttgtatattgagtttgacccttaagtttttattgtcttgtattgtcaacttttccaggattcctcacccttctgtattttcatc

SEQ ID NO: 235060 - DNA, 503 bp, Homo sapiens
ccaggatccgtcaggagacccctcacaccctaactggcccaaagccatgtaaacttctctgtgtataccgatggaatgtcagatttcaataacattcctgtaccaggccagatacggtggcttacacctgtagtcctagcactttgggaggcccagtcaggaggattgcatggaccgaggagtctgaggctacggttgggcacagtggctcacgcctgtaatccaagcgctttgggaggccaagacgggcggatcacttgagctcaggagtttgagaccagcctggacaacatggagaaaccctgtctctaccaaaaatacaaaaaattatcccggtgtggtggtgtatgcctgtgattccagctactcgggagaatgaggtgggagaattgcttgagcccaggaggcagaggctgcagtgagccgagatgacatcactgcactccagcctgggcgacagagtgaaaccccccatctcaaaaataaataaataaataaattat

SEQ ID NO: 235061 - DNA, 324 bp, Homo sapiens
ttgtacagatgccgtgtggaaggcacccccggagatatgcagtgatggcagggtctattcatcaatcagcaacacccacgcagcctcaccctgcctgggcctgccggggagcctcagtaaaaattcccagggcatctttctaccttggtcacagcaacccagttccccaagcatgtccctcataggccacacggcgttcccatttctcctgctgtctttctatccaccttccctcttcctgaaaacttccccagcatcaccgctggctccagctctatcctctcaccagcaaaacatgcaagttgtggtcagtttgcttagaac

SEQ ID NO: 235062 - DNA, 738 bp, Homo sapiens
gcagattgagaatttagttttattagacacagtctcaccctataaagaaacaaaaaaagaatgggagcttatagaaaataggagaaagaggctgttaaatctaacgtatcccactgtcttcagaagcctggaatctgaaaagcttctttgcatttagcttctaaatgtggtgttaataaaaacatatatgcccattctatataccaggcagtgtgatatgctcacacgtcataggtagagtgacatattatttcatttaggctatccctcattttcctggtagggaaaataagacctacaggagctaaatctaaagtcacacagctagttaactatgcagaacttgagttaatgaccaggtgtctctgtccagttttctttttactttacttcaatactgcccaagttattttctcttttcctccttttaaaaaaagacagcttagcaaggtttttctaaacttgttttgtatataattatgaaagcaagtagttatggcagggatgcattctcacatgaatattaatttaaattattgggtagcctccaaaaggaaataaagaagattctcaaaaattctggaaaggaaatctttctctctgtaaatgattttttaatgcaagcttttgactgtggttatattttagcataatgggatgagttttttgaaagcaagagcatggaaagttcatcataattgctcctgactttgatttgtttttactgtagtcaatttc

SEQ ID NO: 235063 - DNA, 178 bp, Homo sapiens
gctctccttcctagccaggctctgggctccactgtccagtgtaggaagcaaagggcagggctttgggaagccacgtccctccaaaggccaccagcttgggttaaaggctccagttgtaactaacggtcaggctagggagctctaaagacaccatagcccagcagactccccctcccaa

SEQ ID NO: 235064 - DNA, 356 bp, Homo sapiens
acagacacacacagtgagagagacagacagagagagagagagagagagagaggcagagacagagacacacacacagtgagagagaagaccgatgcagagatgaggacaggcagccacagagcagggcagaaaggatgggcagtgaacattcaacactacagttgagggggagaatacaggaaccagagtctgcccagctagaaaagccataggaaggagtgagatgagacctcttccatgcacataaccagcagtgtgaggccggctgcaaaagtgccagtcatctcatgaactgcaagatgaagcactgcctcccagcaaaaaggagagctccagccaatgaacaagagcccaga

SEQ ID NO: 235065 - DNA, 463 bp, Homo sapiens
gaccatgaaatcacagcactaattccggactgcctaatttaggtcctctgttagttgagagacggaatccttgtgtgtttaggccatatttttgagttctgttgcttacgatcaaacataattcctaactgatagatgatacagctattattttgtgcacaaacaatgtagatttcaaaatttcaggccacataccttcacccatatattttcctatggccttgggtgttgatatggggctaggcagaagaggagcctacataaactaatacggcatcttacacctcatgatttccttccaacagctgctctcaataaagggcccactgtagataccttctaccaccttggatgagtgcccaggtcagtgtgaaaacagacacccccccttctctacataaggagaaccttcactaagctggccttaccctgagatcaagagacttaaagaatgcaaaaacct

SEQ ID NO: 235066 - DNA, 381 bp, Homo sapiens
ccctgtaatagatttatatatctaagcccttcactatgtgacttttcaatgtctttttcttggagtagcatatggtcatgctcatggttaacattgagcgtggccatacaacttgctttggtcaagggaatgtgagtggatataacatatgtcatgtcagaaaggttttaaatgtgcttggttcttttcggacctcttggagcttcctccctctgccatgagaagagtatgccccaaatggtcattgtttcttcagcctggatacaggaatggaaacacatggagcattctgaactcagcctggccaagtcagcgcagctgaggtcagacaaaccacaacatatatgcagatttatcagcaataaaaatcactgttgttga

SEQ ID NO: 235067 - DNA, 592 bp, Homo sapiens
tttttttgagacagagttttgctcttgttaaccaggctggagtgcaatggcacgatcccggctcaccacaacctctgcctcatgggtttaagtgattttcctgtctcagcctcccaagtagctgggattacaggcatgtgctaccacgctcggctaattttgtatttttagtagagacgaggtctcaccatgtttggcaggctggtctcgaactcctgaactcaagtggtccacctgcctcagcctcccgaagtgctgggattacaggtgtaagccacctcgcccagctgccatctgaatttttaataatggccccagatgattcttatggacaccaagatttgagaagcattgaatgactgagagaaaatttcttgtaagggtagaagcccagcacagtggttctcagtggagataatttcaacccccaagggacatttataaatgtctggagatagttttgattatcacaccttgagggtagggaaaagtgctgctgacatctagtggctagaggccagacatgctgccagggacaatgtacaggacagtccccacgacaaagaattctctagcccaaatgtcattagtg

SEQ ID NO: 235068 - DNA, 435 bp, Homo sapiens
cctgaatgatgttgctctgaaccctagaagcctgcagaaatgtcaccctttaagagaaaagcaggcatttgccctaggatgctttaaagaccctgtcatcatcaccatcaacaaacacttagaaatgttgccttactatgcaggtctggagcaggaagagagatcagaatcccaagcgattcaatctgactgcaaaaagggctctgatctgggcaaaagccaaggtttctcacattcatccctttggggcttgcaatgtttaaaagtaaatttccccccaccactagtacccactgtgtggaactagtcatgagaagaatggatacccatttccctctgcagcaatccggtctgcctcccgaagctcagaaatgtgctgtgctcagcatttctgtgctgatgcagcatccatggtagaaaaggcaggggcggccg

SEQ ID NO: 235069 - DNA, 414 bp, Homo sapiens
tggcaaaaatcccaaggacttttgatccaaaggcggcagttatcactaagtggtttatttccttttaagacctagccaacggtttcagagccaatgctgctggtacaactactctattaatgggatagttttggtaagtctggatcctcccagctgggtcctcctgatcagtgcaaagcagccttttgttttaaaacccattgcaagcaatggcttgggaagtaaacaccatttgaggctcgctggccagaggcaaggggagacggcaggcagttgagcctgcctgagggttctctcagcagtgacttcctttttcccttccttcttctgcctagtcctgtatgtgaggactattaattgttttttgttgttgttgttgtttgttttgtgagatggagtctccctctgttgccc

SEQ ID NO: 235070 - DNA, 2198 bp, Homo sapiens
gcggggacagggcggtttgggaggcccaggcggcggagcctccgggacggcgagcggcgggcggcggaggaggagacggcagtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagtcctcaagagaaaactctctgcaaatgaaacttcaccagtgccctcactaggttgaaatgattatggtatttattatgatcactcataagccagatgaaattctctgctattgttttagtgattctagcctcatgggccaaaatataaattaactaaaaatttgattaactagaactttgttactactactaagaatgtcagaggagatctgttggctacttttgattgggttaagtaggcattctggttctaacattgacagatttgcaaaccattcttttaaatcaaaacttgttaggactgttttcattgtaatatcttcagatagtttctaacaatttaggaagtgatttttaaattggatttatagtgcttacaaccatttcttttttaaaaccccttgtctggacatttttagtgttgcttgctttataggcctaacaaattaggtaatttaccaaaagaaataagtgggataaagataattattgccctccaaagtaggtaatcttccagccttaataaaggtattttatatcttttgataacagcccatttcctaacatgtctggttgtaggtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttaggtagggaatcttattttattcatgtattaacatgctgtggttcaggggaaattctaggtcagattataactttcataccataaaatgatggcttttaaagggagggcttttaaaaaaaatctggatgataaaggcatataaatacataaatttaacagaggcaaagtttgaagaattttaaagcaattaaaaaaattgtcatattgggaacatgttgctaccttcttttagtcagataccaagtggctaactgctcacaaaaatatggccaaaccgccaggcgctgtggctcacacctgtaatcccagctctttgggtggctgaggcggacggatcacctgaggtcgggagttcgagatgagcctgaccaacatggagaaaccttgtctctactaaaaatacaaaattagccgggcgtggtggtgggtgcctgtaatcccagctacttgggaggctgaggcaggagaatcgcttgaacccggcaggcagaggttgcagtgagccgagatcctgccactgcactccagcctgggcaacgagaacgaaactccgtctc

SEQ ID NO: 235071 - DNA, 1290 bp, Homo sapiens
gcggggacagggcggtttgggaggcccaggcggcggagcctccgggacggcgagcggcgggcggcggaggaggagacggcagtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtaagcatttttagtaagtttagcttaaatataaattttggcttttatcaatctaatggcatagttttacactgtattaaaaaatgtatttccaaagaattttgttccctaggaaattatt

SEQ ID NO: 235072 - DNA, 1337 bp, Homo sapiens
gcggggacagggcggtttgggaggcccaggcggcggagcctccgggacggcgagcggcgggcggcggaggaggagacggcagtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagt

SEQ ID NO: 235073 - DNA, 1572 bp, Homo sapiens
gcggggacagggcggtttgggaggcccaggcggcggagcctccgggacggcgagcggcgggcggcggaggaggagacggcagtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagt

SEQ ID NO: 235074 - DNA, 1545 bp, Homo sapiens
ttatacaatgtggcctgaaagtttccctcctctttccaaatcaaccataatattctgaggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagt

SEQ ID NO: 235075 - DNA, 1595 bp, Homo sapiens
ttatacaatgtggcctgaaagtttccctcctctttccaaatcaaccataatattctgaggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggaggttaggattgctgcattgcttgcgtaactgaaggttattgtttttaatatattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagt

SEQ ID NO: 235076 - DNA, 580 bp, Homo sapiens
caaaaagctataaaggacatggggacatttgcggaaatttatggattgtatgttactactgtatcgatgttaaatttcttgagtattataccttgtttttaggagatgcatgctaaagaatttatgcataacgaatcccataatgagaatgcaaatgtggctagatgttaaagtttgtgatctagctgggtgcagtggctcatgcctgtaatcccagcactttgggaggctaaggcaggcagattgcttaaacccaggagtttgagaccagcccaggcaatatggtgaaactccatctctataaaacataaaaaaaattagcttggcatagtagcacgtgcctgtggtcccagccactggggaggctgaggtgggagaaacgcttgagcttacgaagtcgaggttgcagtgagctgaaattgtgccactgcactccagcccaggcaacagagtgagaccctatcttaacaaaaaaagaaacacacacacacacaaagtttacaatctagtaagagtcatagacatggacagaaataattagaaggcactgtacaaagcattgtagggttgggaaaaagca

SEQ ID NO: 235077 - DNA, 443 bp, Homo sapiens
tgatgttatcgccccacacctggtgattccaaaaaatcaagacagaggctgggtgcagtggctcatgcctgtaatcccagcactttgggaggctaaggcaggcagattgcttaaacccaggagtttgagaccagcccaggcaatatggtgaaactccatctctataaaacataaaaaaaattagcttggcatagtagcacgtgcctgtggtcccagccactggggaggctgaggtgggagaaacgcttgagcttacgaagtcgaggttgcagtgagctgaaattgtgccactgcactccagcccaggcaacagagtgagaccctatcttaacaaaaaaagaaacacacacacacacaaagtttacaatctagtaagagtcatagacatggacagaaataattagaaggcactgtacaaagcattgtagggttgggaaaaagca

SEQ ID NO: 235078 - DNA, 913 bp, Homo sapiens
tggtatccaaagtgctccattagcatctttaaaggatcgcctgagaagtcccagctgtctggcttcagctctgcttagcatgggtacccatcggtgtccacaggggctagcagcaagtctgctgaaggagatgccccaccctgctcttttcagctgccttagagcctcaagcctgagcctctcctgctgttgggaggaacctggcaatgccatctttgtcttcccaatgccggtcatcccaagccactcagagagataaagagccattgcagtccctcttagggctgtcttggagcagaaagactggcacatgatagcatggtgttggcagtagtctggccttgggtctccccagagctggtggtttatcgcttattagttactgtgatacaatttgaggttcagaaaagacagtcactgtacccttaacatctcttcgaattctaagttgagtgaaaacccagaaaaaaaataggctgttcttctctaagcgcttctaaataagcagcagccaggccagggactaaaatacatcgccctgtagagccactggacactgggatgcaggtcttttgtgtctttcctgctcagtaatagatgtggaccttagtttgtaattttaggtcggctttgttttttaataacctattttttgctaaaatccatggcattcgtttattaaagaatagtatcacttagtcacgaagtctcagagggtaattccagtgtttctgaaggctaaaactgtaattgacagtcttggtttgattgaaggtttggatgtcagtacgtctcctctctctccctccctctccctctccctgtctcttcctctctcatcctctttcttcttctttctctccgtctcccttccctcttcttttcctgctttgtctctgatgcaagaagtctg

SEQ ID NO: 235079 - DNA, 949 bp, Homo sapiens
ggaattaataattactatcttatgcctggctcaatttttcctaattgtctgaaaaatgcctttttatatttggtttgttagaatcagattccaaccaagactctcacattgtatctgattgatgtgcgttttaagtctcttttaatctttaacaaatcgtctgctttttcccgccttgccattttttttttttaaaacgaggtcatttatgctgcaggatgtcctaccttatggatttggccatcatactcatatggcaatgtttagctgttcttatatccctcatttctatttagatctgtaacctgactagattgaggttcaatttgagggggcaagaatacttcataggttagactctttttaaaaaaataccttttttcgctaaagctgatttttacccatttttattactatgcagacatactaaaaggtcatcatatgagctttataagtagaattggtgtatagtacttgcgtttaataataaatgctaaatcatttcgatttcaattgtgtaactatatcacctaacatttttgaagcactttctataaattaggcagagccttaattcacttaatctcaacatatgaaggtaagtactattatccatgttttccaaataaggaaacagaccatagagtttaagtaatttacttaagattacaccatgaagtgctttacatgcaattaatattctaaagatttatggtttaatataatttctcttctccttgctttgtgctgtaccatgattaggatgcgaaagtaagtttattactggatgccaaaaatttatattattttccatcattaaaatatagtgttgccttttaattacaaaattcgttgctagtaatacctgaaagttggcctccttggtcctttattttgtgatttgcaaaatcagccactttggaaaattattaaataattttttcctgga

SEQ ID NO: 235080 - DNA, 530 bp, Homo sapiens
  misc_feature (477)..(477): n is a, c, g, or t
  misc_feature (480)..(480): n is a, c, g, or t
  misc_feature (482)..(482): n is a, c, g, or t
  misc_feature (515)..(515): n is a, c, g, or t
tttgtgtggccaactttgaaataacacaaaaatgatttttggtgaccttttatgagcagggtggccataaacaaaaacaaatacttgttctaggcttataaactggggttcactgaaggtacctgacaaccttgaaatgacacagaaatgaattttggtggccttttatgagcagggtggccttaaacaaggcttataaactagacttcatcgaaggttacctgacaggcttagcaaagaattttaaccaagtaaatgcctatattttattaaagcagagttttaatgtcttgggattcaaattaataatacagttatatattacaataaaatactgtcttttttttttttgtggcggagtcttgctctgccacctagggtggagtgcagtggcaggatctcggctcattgcaacttctgcctcctgaggcaggagaattgcttgaacgtgggaggcggaggttgcagtgagccaanagntngccattgcgctccagcctcggcgacgagcaaantccgtctcaaaaaaa

SEQ ID NO: 235081 - DNA, 1436 bp, Homo sapiens
agtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggaccgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttc

SEQ ID NO: 235082 - DNA, 461 bp, Homo sapiens
cctatattattgggacaagggtaggtcagagaatttctagacagaatttctgtctaggccagttcctagacagaaaggtgaggggaaggttagagtagtaattgtagtttttatggctggctttggagaagagagatctagtctttattatctgctttggtgaggaggaattctggtgtctgtacttgctttgggggagaatgaggggcaagagacaggagggcaggagaagatgagagagatccaggttctgaggctgcttctgataccttccagtgcaaagtactttgtgtgctgaagtgccatattttggagtattgttttctgagctccagcattagccctatttgccagtagaatatggtgtggcaagtactttaaaagaatgctttacatgcttattttctcaagagtatataccgtgagcttttcggaatagttggaccatctgggaatacgta

SEQ ID NO: 235083 - DNA, 362 bp, Homo sapiens
tatacttggctgtggttttgcttacagtaaattcctgaaggcgtttctgttgctcagtggaaatcactggcagaattcttgttactgagcatcagactgtggggcaccgtcatggtgtcttaggggtgtcaaagcagatgcatttgaggggagatgtattcacattttccagtatatcattaccacattcttgtgtgatagcttcctggtaattcaacttgatttagtgtagtacagcagcacaacttttcctttctgagttgtggagatttaaatttgttgagcaaaggaaacactgaagaggactcagaacactccagttgagtgcacacactgcatgaagctgatggctctgcctcctg

SEQ ID NO: 235084 - DNA, 488 bp, Homo sapiens
tctctacaagcttacaaaccgcatgggtgtgtgggggtcttatttaatattgcgaacagctggttcctgtatctgaagttcttgccctggagcctgggtgtttgttgtagttctgcaccatctgccttggttgataaggcattttggaggccactgattttaggcagcagtgttgttaggatacggaaacagcaggatgtttgtggattgagccttttcagctgaatcttctggccagttctttctggctgtgtgaagttgtgtcgactacagagcaggatgctcatgttgcctgctgggctctgttagggtggccagacgtgcttgtagcagccttactgccagaggaacgtacgttggcatccagagtccagtgctgccgccagttgcagtgcagcaaggctagccccaaacctgatttgctgcaaggattagctcaactctagtgacatttattgtgttttctcatagcccaaatcacagccaaa

SEQ ID NO: 235085 - DNA, 559 bp, Homo sapiens
gaagggcttttgtagagtatggttaagaatgcagatctgcagtgggtcacgcctgcaatcccagcacttggggaggctgagacaggaggatggcctgagcccgggagttcgaggctgcctaccccctgcaccccagcctgaatgacagagcgaagagaaatcctgttgtctctttatttgaaaaaaatttttaagtaggttctggagccggaatgttgcagagaaccaggcgccggcgcctcccaatggtcaccagcaggtggcgccgctgacctaggtgctgggctcctctgcaccccgggttctggatggggctgggaggagccagtttaggcgggatggagccctggaccacttgctctggaccaaagtcaggtggtgagcatgggtgacccggcttctttaccttcctgaggccttggtcgaggggctggctgcctgccctgtgcagaggactttgtccctggggtgggtgggtgcaataaatgtcagggctctgatccaggaacagaggggcacagagggtaaagggtccctcactctcccctggcagcggccc

SEQ ID NO: 235086 - DNA, 435 bp, Homo sapiens
atttattatttcatttactcaagtaaatagtaattttaaaaaaaatctgtaaaccttttacataaagttatgtcacaaaggttacagcaacagaatttgaatcaagtttgcaatatgacatgagggttctggcatctattttgtcccttggtatcaagtttatttctctaaatagtttgtttttaactttggttacctgccaaaaggggaaaagaaaattctacttgtaagtataaatataaagcagaaatcctgtagttacgtatgtaacgatcttataaaatataatcagactgttgtgattgtttcatgtatcagtggatgtatatttacagtaatacatttatacatgtaaactttaaatttgagttatagttctatgtatatgtattttactgagcctctgagcataataataatgctgttactaagtta

SEQ ID NO: 235087 - DNA, 807 bp, Homo sapiens
ttcttgagatgcaaaactagatgtataaggcctgtttaagaaaaaaaaaagtgggaggcagggtgagaggaggaaacagtctatgtttatacatatacaaaatgtaactacactaacataaaactgttacaacagtagctgtttccgtggtggtggagagtatggaatggaaaggggagggggtgatgtagcatggctgaaggggaacttcacagaggagggacacttgagctgggccccaaacctaaacagcctgggaaaatttttctctttgtgtcttgaagttttctgatttatcttagtgatttatatgattatttgataaatgttagtcacctatgactgcaagtactgggatgtcatagtcagtctctctttcttgcttgccattattcttgattcctaataggtccccagtaaatacttggtaagtgaatagaggtggtgggcacagaaagcctttgtgaaacaggaaggggaagggtattctggggcaaagtaccttgtctgatttggtaatagagcagggcacaggcagtggttcatgcctgtaattctagcgatttgggaggccgaggtaggcggattgcctgagctcaggagtttgagaccagcttgggcaacatagttaaaccccgtatctactaaaattaaaaaaaaaaattagctgtgcatggcagcctgtagtcccaactactcgggaggctgaggcagaagaattgcttgaacctgggaggtggaggttgcagtgagctgagatcgtcgtgccgttgcactccagcctgtgtgacagaacaagactgtctc

SEQ ID NO: 235088 - DNA, 550 bp, Homo sapiens
tccacagggccctgctgcccccagaggctctgggcagagcccttccgcctttccagctccccctggttcccgtgctcctcggcctgtggccccatcactctggcctctgccttcatctcatgccgagatccctgaagcgggcccagctccgttcactgctcccccggcctcctgctgtttcccacacgcagccatggtacagggcagctcatcccaccacctccccaaccgcagcctccagggatgtacaccctgcctcaggggctgtgcctgggccctggctggtggagggcacagccgtcagggaaggccctcagctgcaggatgccgtgcctcagagaccaaccaggccctcgaaggcactgtggccggcccagatgtcagcagctccagcaattaggctgggacagatggtgcctggtgacacaaggggactgtgggggccacaggggaccctgctcacctggacctaccgtggaggccagggagggagatggactcgaagggcggaagggcccagagaaggcacatttgcagagcagcggccgct

SEQ ID NO: 235089 - DNA, 431 bp, Homo sapiens
ggttctgttcccttattctaccccctgccctaggccgagatccctgaagcgggcccagctccgttcactgctcccccggcctcctgctgtttcccacacgcagccatggtacagggcagctcatcccaccacctccccaaccgcagcctccagggatgtacaccctgcctcaggggctgtgcctgggccctggctggtggagggcacagccgtcagggaaggccctcagctgcaggatgccgtgcctcagagaccaaccaggccctcgaaggcactgtggccggcccagatgtcagcagctccagcaattaggctgggacagatggtgcctggtgacacaaggggactgtgggggccacaggggaccctgctcacctggacctaccgtggaggccagggagggagatggactcgaagggcggaagggccca

SEQ ID NO: 235090 - DNA, 771 bp, Homo sapiens
gaggaagagaaggaggagacagagaacaggagagttggggatgaagcctttgatgaggggagtgaggaggggcagaagtaggagacagacatgaggaaaccaccaactgaagtcccagaaacccagcctccgtcccctctaggtcctactgccgtcatcctctttctgtaaaggtgagagtctaggtgcagtgtcccaggttccaaacacaagttcatactcattgactagtgggatgcccactgtgagagcaggaaggagggctagagagatctaagagggcagaagccctgccctgccagtattttttgcctccagccacctgctctgttctgagacatgcctgagaccagctgcctacagggggaccagggtctgtttctgctgttaaccttggttccctcctgcattcctgcatgtggggatgtagacaggaagcctgcaggtatggagcaattgaagcagagtctagatagagcccagactccttacttcccatagtactattctgcattttgtagtgctgcttatgcttttcagtgtttccacatctatttactaataacatcatagtacaacagcaagaacatggcctcagaactcaaagttctggaattctaatattttatttgattgtcagtatttctgtgagatagataaaataggaattatttcctctgatctgcaggtgaggaaactcagtcacagggagcacatttatccatacttgtggagctatagtataactagtattaggacaaggatagccaa

SEQ ID NO: 235091 - DNA, 450 bp, Homo sapiens
gggactactcataatacctcttttaaccttaatgaactcttcaaagtatctccaaatatagtcctattctgaggtacaaggggtaagacttcaatgtatgaatttggccaaggctcgggcagaattcagtccataaccattatgttagctaataatatatgtaacaatatattcaacttcactaaccatcaaggaaatgcaaactaacacccaatacagtaccattatacacccaccaggatgttcaaaatgataccaagttttggtgaggatgtatggagcaacttgaacactcatacaatgctggttggagtgtaatttagtacatcttttggaaattggcagtttgcactaatgctgaatttccacgtgccctgtaactcaacaatttcagtcctatatatctataatcaccaaaagaaccccaaataaactagtatacatacatgc

SEQ ID NO: 235092 - DNA, 491 bp, Homo sapiens
tgggctcaagctatccttccactgtggcctcccaaagtgttgggattgcaggcgtgagccactgcaccttgcccataccatacattttgaaccttggccgctaggtccaaaagctggccgttgtgactatagctgttggcatttttgttgggatgacaatgttattttatttaaaatttcttgtactatttaaaataatctgtttggaaaatgttaaccaagtaatctttctgcttccacttccccttcagtattttagtggactgaatctctcagcctggcattcaaggccagtcacagtgtgacattccagcctcccagttagagctcagctaacaacaagccaagtcagaaagctgctctgcaagactgatttgcccattatacttcccaaataccctgccttcctttcctgcttctgcttttgccacactgttttggctttagcaggacaaaccaaggaataataaaatagcctgtcttgtgatgta

SEQ ID NO: 235093 - DNA, 393 bp, Homo sapiens
ttatttatttatttatttatttatttatttatttattaagacagggtcttgctttgtggcccagcctggagtgcattatagctcactgcagctctgacctcactggctcaagtgatcctccaccctcagcctcccgagtagctgggactatagtattttagtggactgaatctctcagcctggcattcaaggccagtcacagtgtgacattccagcctcccagttagagctcagctaacaacaagccaagtcagaaagctgctctgcaagactgatttgcccattatacttcccaaataccctgccttcctttcctgcttctgcttttgccacactgttttggctttagcaggacaaaccaaggaataataaaatagcctgtcttgtgatgta

SEQ ID NO: 235094 - DNA, 84 bp, Homo sapiens
cttaaaagtccagaagtaaggctcttgtagggttagttcagtagcacaagaaaatcattatggggctaggttctttccatcttt

SEQ ID NO: 235095 - DNA, 339 bp, Homo sapiens
gcctggcagcccacttgtgtgcaaggggggtatggcagatcaccgccagccagtgccaacactgtgaacgtgaacgctactttaaatatggaaaatacttcccagcgtggccaataatcacaagcagagcatgcggacgctgtgtggacaagcccacgactctcattcagaggacaagccccagaagaaaagcaaaaccaggaaaagcacatcaggggagcgaggctggaagaatgtctgtaatgaggtatttcatgttatgaaattcattagaaataaaaatgagtggagataaaacatctatcttgatatggaacaaacatctttgtgtaaatgcaa

SEQ ID NO: 235096 - DNA, 538 bp, Homo sapiens
ttgtgcgtggcgggctgtcgctgcaatgtgcagcccattgacactgatggatgcgccaatggttggacggacagatgttagggcggatcgcacagcgctcggcgcctgagcgggggagggccaggcagcgacccagcggcggcggccggctacgcggagacccgagttcaggccgcggcccgcagtgggagggggccgaaggaacagaggtttgcaagaacagcgaggggatggaaaggaggagaaaagcgcgaccagggagaactacacgcttccgtgtgcggcgccccgcgctgtgcacacgccgcaccgggcgcgcctaagtgggagcttcgaaggtgagctgggagccggcgggagctgaccccgtgcggcgcaacccgcctccaggcgacaggagctcagcgcggccaccagaatggtgaggccgccggcggtgtcggccaactcaccgtttcctcgcttgcaagaagcgtttcacgctccacggccgcgtctccccggcctggaggagtagcggttctggcctctgcggccg

SEQ ID NO: 235097 - DNA, 351 bp, Homo sapiens
atgactctagcctatgttttttatgtttaagacagctctactgataaacaatcaagtttaatggattctatttgtcactgtgacatagtttaagcaattagtaaagattacagtcttaatgtttagaagactttattaagaaaaactaagttaaatattgaggtcagacccatcactcttattcttaaacatgatgtaaaggaccttgactatacagtcattactcctgtctacttctttaatgtttttcttagcccatctatatcacatttataaaatgctgttatttttcctctctgcttatattcatttcccattcaagtcttctaactggtcattcttacacttggt

SEQ ID NO: 235098 - DNA, 519 bp, Homo sapiens
attttttattccataaagagaaatgtattctacaatgattaagtcattaattctcatagcatctcgttataaaccaggagtcagcaatctctggcccaagagcacaaaacggttagctacctgtttttctacaacctgagagcccagaataatatttacatttctaaatgactggaaaacaaatgaaaagaagaatactatttcttggcatgtagaaattatatgacgttctcctaccattcgacccagcaatcccactactgggtacatacccaaaggaatataaatcattctgttataaagacacttgcacgcatatattcactgcagcaccgttcacaatagcaaaaacatggaaccaacccaaatggccatcagtggtagactggacaaagaaaatgcggcacatatacaccatggaacaccacgcagccacaaaaaagaatgagatcatgtcctttacagggacatggatggagcaggaagccatcatcctcaacaaactgatgcaggaacaga

SEQ ID NO: 235099 - DNA, 1077 bp, Homo sapiens
gtgctgggattacaggcgtgcagctgcacccagctgagtctattatttccttatcaccaagaaaaagaaataccatcaagtaattttacaatgccacaaatatgatatatcccactgtaggagattttaaggtgtgatcaatgtatgtattaaaattgatgaaatatgggagttgtcacctatgtaaatgtgaacttgattgttaactctggcagaatgtccactcagcagcaacccttcagtgtttctgtcaacaaaccatatgagaagtcagatgagttgtattgtttgaaaatgtttcattggataacaaaatgttgatggttgctaacgcttagtgatgggcatttggaatttgtatgtacactccacttctgtatatagtagtaagttttttataataaaaagattaaaactagaacaagcaaccttccattggcactttctggcatgatcaagaaagcatctgcattaaaattttcagtgtcgtgttagtggatggaaagaaaattccagagacaaaagtcaaaagaatgttttaaagaaatgttgggttatgatctcagtgatgtttttaatgacacataaggtagaaatgtatggaaaaataggacacagttgacaaatttgaaaagatattcagaagaatctaactctaaatatgaaaaagttttaggaatacctacaccaatttattttgcatctgtttttctttttacaggctgtatgagagtgattttaataatctctgtccaaataagtctaaaggagcttatcaagaagtaaagcataacattctaggggataagtcatagttggtcgtagtttaagcagcatactttttagtatctcttattttgaataaaaaaaaattaagtaccatgtatatagttaatcatttttagtgtttccaagatactgcttttcttcataggctataaaaagcttttgttgcttatattagtaacaaaaacaattttgcaaatggaaacatttctagaaaccttactatttatattagtattatataaatttatccaatttccagaaatttgggtaatgctaaaatcactttcc

SEQ ID NO: 235100 - DNA, 953 bp, Homo sapiens
cagtatatctgctgttgaggatcctgcacttggagacaagaagacctgagttccagactctcactaccttggacaagtcacttaacttctctgtggctgcattattttaattgaaaattataaatagtaaacctattcttcctaacttataggattactgggaaaataatacgaaatcatgaatgtgaatgtatttagtgaaatattacacgcattgtggaaatttgggaagtttgatgttaaccccctctttcccactctggaccctggatataacagagatcctacttcatcttctaaattatttttggtagaatatacactgttcatgtagttttaatgtaaatcacattatgcaactaaataatatgttcaaattcattgaaattgtacagttcacctagagcatggatagcaactttattaattagaacacctaccatgtcaaggaaacattgctttcaacattatcattaaatcaggcaaggtcataggagtaccattctgccaggaattagtttaaaagtaagataattgtttttgctcagttaaattctgaaatagttcaaatcagtgtaacgattaatatgtcagggtgaaccaggactagtagaagtttccatctttgtcataacaaggccgaattcgttagatcttgtggcgtgaggttaataaatgtgaagggaccgttggagggaaggtagtggacaactctagaggcattgcggaggtcatgcttttttgacagacaatgcacgtggatttgttttgccatttaccaacagtgtgactttatgccagtttcctttctccttcagttttcatttgcaaagtgctagtatgatgataatgttatggttttgagaagaataaatgtgctaacatctgtaaaatgcatgtcacaatgccgggcacacaacaagcagtcattcaacataaggtattatttttac

SEQ ID NO: 235101 - DNA, 1129 bp, Homo sapiens
aaaccaaacttcaagaggagcaatttaatcttcatacctgactccttgtccctcctcaggcatgctgttgtgcaggacagagccctggcttctcctggatgtcacacctggcctgtctctgacccttgctttccctttctctgctgccctcaagggtcattcacacccaagagggtaagaagctgccctctcatcccttcctctcccaccctgggcctctgccctctgcctggccccagcagcacagtcttctccatagagaggggctgggccatgggaccccagttcctggggtctcggtgacacagttcactgtttgctgcagaggaggccccactcgcagccttggcctctgccctgcagaagaattccctgtaactcactcaccagtggccgtgggagccagtggcctcggcgagggtcagttggactgcatagctgccggctgagtctctctggccaccctcactggccccatcactccaggttgcactgctgcccagggggtttgtgccaggcctgggtcacagtggaagagagtctggaaatcacaaggcagaggaggagacctctgccaatgtgagagaacaaagttaaggggcagtccatgggggcattgaccttacttaggtgaggaggactcagggaacatctacagactctagggctagggtgagatcctcctgatagtgctggtagctccagctgctgctttggcaagacttggtcgtctctatactgagagagcaaaagctcttttcctggggctgcatgttcttccataggaaagtgggcttcaggtgctgcctattaaacctcctgcctcccctgctgcagtgctttgatgcctttcacctgtgtctacctgcgaacctctgcccaccacggaagagcagctcacatttggaaggggctaaaatttttacctagtttgaatctgctctgcaatgtccccatcaagttcttaaccatcccgggttccaatggttacagagttctgccctggggagggaggaattgcttagcaaatgatgttgagaatagtgattatttgggggaaaattcaggtaagatctcaccttcataccatataccaaaatacatctcagtagattagtaagctaatgca

SEQ ID NO: 235102 - DNA, 1540 bp, Homo sapiens
  misc_feature (318)..(318): n is a, c, g, or t
  misc_feature (559)..(559): n is a, c, g, or t
ttctctcttcccaaaactcagacactgagagaggttctcgtcagagtccaaaatgcacattaagttgtggggatcttattaacaatgatgattctgatgctgtaggtttgaagacgactcaagattccctggagacatcaatgctgctggtccatgggccacggcttggatagaaagggtttagggagaggttgacaagtaataatgcagggtgggtgagtactgctctactggcattctaaaagcagagtgagacagagaggggtatggggagtggggaggaggcaggcaaagcctcctagaagtgagtgacttggnccctgaataggtgagtcaatttaccaagcagaaaagtaggaaaggcctttggtcagagggagcaccatggatgtggaccccggctggctcctgcatagagtgaagaatgcagaggaaggtgatgggacgatggccagagaggaggctggaaagctcaccagggtctggatggtgaagggtcagctctgtttgccatggtaagacctaagactccagtcagcagggagtcttgaggtttcanagaggtctggttatagtggacatgacaaactgctttgaaaatagccaatactacatcatgttagagaatttgcataacccagcagggcgcggtggctcacgcctgtaatcctagcactttgggaggccgaggcgggcggatcatgaggtcaggagatagagaccatcctggctaacacggtgaaaccgtctctactaaaaatacaaaaagaaattagccgggcgtgggggcgggcacctgtagttccagctacacgggaggctgaggtaggagaatggcgtgaacccgggaggcggggcttgcagtgagccgagatcgcgccactgcactccagcctgggcgacagagggagacgccgtctcaaaaaaagaaaaaaaaaaaaaaaaaaaagagaatttgcataacccaaaggagattgtgcttgaacactcccaggcagtgaataatctgcaaaggagtaagactgtagttgagaggcaggtttttagacttccacaggcttgggggacaaacagaacagaaattgatttctggttccctgctttctagctatataacctcaagaaaattaattaactttctgaatcttagttttctcacctgtagaaaggatgcaataaatcctgtctcatcaaagaattgtgaagaggaagtcattcatttaattaattgaagcactacattttggcaaagcatgcagtttgttgataacaggaggtatttgttaacttattattaatgttgatttggagctcccatgaatttttgcctaggaaatgacctggtagatcggatagttaccatgttgatagattgccaagtgccttttctcatgtgtggggttctgatgccatcatcagctggaagctcagttggtcttgtgggtggcatgctgcaccagttgtctgattcagcaatgctgtgagagaattgagagggcgttcattcagtaaagggtgggaaggattttcttaaatgttt

SEQ ID NO: 235103 - DNA, 585 bp, Homo sapiens
agaccatcctgaccaatatggtgaaactccatctctactagaaatacaaaaaattagctgggtatggtggtgcacgcctgtaatctcagctacttgggaggctgagaaacaagaaatcgcttgaacccgggaggcagaggtggcagtgagccaagatcaggccactgcactctagcctgggcgacagagcgagactttgtctcaataaataaataaattcttgtaaatattcgaaaataatctttaatatccaattaggtagatagttgactaaactactcccttacatatgcacatatatattaaattgtttttactttattattattcatagttaatttgtctctgtgcataattgtccccatccttttgtgtgtgtttttgtttctgatacgttttctttggaaaggttctcagaagtagaaacatttggaaagattgtacacattcacttttcatggtgggagcatacttttcacccgcttatttatatatattcttgatccttaggaggttttcagaggcttagttgaagtctgtctatggcttatagtggggctctgttcttctgcttgattgctggtg

SEQ ID NO: 235104 - DNA, 719 bp, Homo sapiens
aattttaagagaccaacatctcagtacagagacagcagctaaaaatctagattcttacctttttattattatttttttaaagtaaaagatctgggagcctttgacctatagacctatgtagccaacaaacaaacaaaaaaacaaagcaaaaaaaaaaaaaaaccatctgattcacctttagataaggaagattctgtttgccaagtccctcagtgttgtctccccaacacagaggccaggtagcacttgacatttatcattgggcctgcaccattgttttttcttgtgcttgcacagcttgcattacctacttggcctctaaatatctcaagttgcctctccttgtagagactaaaggatgtctcaatttttgcctgttttaccttaactctattacccttctgaattcagtacctgttagagttgtagaaatcagtaaagaattagtgggagtgtgagcaactgagactctgactttgcttgaggccctaaaatactatattaaagtatgtcaataaagtctgttgcttgaattttaaaacaaggaaatacctataacttacccttgcaaaaatgtattcccatcctgaaatatggtaatatttaaaaattgcaagcatcgcatgtttaatattttctgcctctggaggtttgtaaaatattttctgggaatgaattgttatattcttgatgttctcagtggccaaagataaatgtga

SEQ ID NO: 235105 - DNA, 265 bp, Homo sapiens
ttcactaaaaaacagtgcagtgaagcatataggacagatgttgtgtatgagaaagaaaatggaaaacaaacacaactgtgcattggggtgcatgtgggaggagatataatagaattcaatgtggttatttctccagaacatcccagccaaggataacatccatccttgaggccagtgaccttattgctaaaactgcctgcctaaatataatttaagttactaagaaatttgtttttggaaataaacaagggactctagtgtatta

SEQ ID NO: 235106 - DNA, 470 bp, Homo sapiens
agctttgagactatgttcaatgaataacatcactagagtgctttgactttgcaaataatgctttgatggtttctgacactcttggatggcccatttatgacacctgtctgcagacactttaaagatagagcagttgttctaaaaagtttctgaaataactgtgcagtgagtatcaacttcaaacatgcacagggaatgttttaatatcctgttcttatgtaaatgccaggaccaggctggctgaaggtcactagagaggacacaagctaggctgagagaatttgacctgggcaatatttgagagccatagacaactgcacttgttaggggtaatgacaatgcattggtttaggactgaggcagacattcaaaggacaggaaaagcttcaacatcaagacagtaggagtcttgatgttggagattattgatccatttgtcaccaaaaataaaaaaggaccctgactcaatc

SEQ ID NO: 235107 - DNA, 371 bp, Homo sapiens
gttgaaccccgtgctggctactcacttctaaatcctctgaggtctcgggagcttcgttgtccggtgtttctctccacattttctcgggaatctttaagtgccagatacttcagagctgggaatgctgctggtaagggatccgggatgctggcatccttgcattgtgggcatgaataaccctgacctacaaaaattatcaaaaacaaccaacacaccaagtgtagaagaaaagaagtctctctcgggagagagaactgcttctgaaaagaacggacacatgagtgctttgatgtctaaaatctcaaagaacctagaggccttggaagagaaaactttaaaaatagacatgtttttaagttctcaatgcttca

SEQ ID NO: 235108 - DNA, 352 bp, Homo sapiens
ggttttcaaagcaagacaatgccccaatccaagcctgtgtgagcagttcgctttgcagcctcttgcggggattaacaccccttcttcaccaggctccaccctctctgcaaggtctatgctgcaaaattagcaagtccaggaggcttgctccctggcagagctgctgagtcctctgtcttctatttattcactttttgaagaaccctgaattaaaggcctgtctaaccactgttcagcctactccttctgggtgggaggggtcagaggctggcttctagaatcacacagtgattgggcaagtgaaggctggcatgcccagctaaacctcatctcctttttttttttttttttt

SEQ ID NO: 235109 - DNA, 1099 bp, Homo sapiens
cctggtactggttgctctgagaagccatgggtttccttccttggacaatttcagagcccatcattatggtttatggaaaggaagtggcactgagagagacccttgcttctcctggcagctcttctcccttgagaaagctcctcaacttctcctgagcttagtttcagaagtgattgttcatcctctcccactgggagtcctgggatgggctccgtatattttactccagccacaggcggatgagtgagatgaccttttcaggtcactcaggagatcctccagtttctcaggataatctaagcatctccctttcctttagaagctgtcagagctaactcagcgtgggtgtgggctctttgcagctacaccacctcccctccaatatttagaagttctttgctggttcttagggtctcctaatcacaggtctttttttctgggctctgcctgaaaggccacatccgttttttccctgaaagctagctaggtcctctgggctaaacaccaccgcccctcagctctagaaatggctgattttcatgacgccctttgccaaccagattatttcttaaattgctctcccccctgctgggtgttctgggacacagacgccagtgtgtggggtccccggctttcctttctcccagagcagctggaggagagcctcagtttctccaccgcacaccctggcctgagggtagcagccgacccagtcgggggagtgggcctcctgcgccctcggaggcacaggaccgcggggccccaccgaggaccccctgaacggcagcccgccgcgaggcagcgtggggaccaaactgccgcgccccagagcccgccgccgcctgtccccgcgtctgaggtccgcaaggaagagctgcgggaatgcacgcccggggaagaggctttgtgaaccgaggctcggcgcgccccccacccgcgcccctcatgggcagccgggcccagcccgccgcccgggcccctctgggaagggcttggaggcgacgcggggggtcgggggaggagggagcgttcctgcaaatcacatgattttcccgcttatataaatcacagcttgtttttctcaaccagaaacagactt

SEQ ID NO: 235110 - DNA, 444 bp, Homo sapiens
ttcccagtcaaggtgggccacacccactcggggatggcaagcccagtggccacagctcaggccccacagccagtcccagctctgcaacttctaaactcagatacttcatcctcaaaatggggtgacgagttcctgcctcacacgattgtggggactcatggaactgggcctggcgcgggttacaagctgcattccaggcagttgttttccctcccccaggacattaggattccatgataggcaaagtgtgggcgttgggggaaaagggggtgcgtagttcctttggtgaagtgcataagaattcccccactgtttccatcagcccctccaacggggatgtgtggacggtccctgtgtctctaggaaaaggacagagccttggtctcatgaccgactgactccctccctcgaaggcctgttggcgtgggtgggtggcagcggccg

SEQ ID NO: 235111 - DNA, 387 bp, Homo sapiens
ggaggggaggggaggggttgcattgggattttgattggaattgcatagaaactccatattaacgtgggacattttacaatgctaggacatcagtttgaaggtttgtctaagtctttgtgtcctgcagtctgattttgtttatttctagggcatgtggacagttttaaccaggtcctcttcccgtatgatgcggggaaggggacagtgcggtgaactttgcagatggcgaaaagacccaagttttatgcgcctagactaaggaggaggatacttcccaaatggtagctaatttctagacgcttggtagttaagtttatttggaggtgataagcatgttgttgggaaatgatctggcttacatgtgctatgtgtgatctataattacat

SEQ ID NO: 235112 - DNA, 430 bp, Homo sapiens
tacttgaatttattaacaattctgtttttaattgtttgcttttctaccaagaaatgatgtattttcatctgtacttgttttatgactttaaaactgtgttctttataacactttaatccatctgcaatttttaaataaatattatgaggtaggaagaaagctttatcttttccaaataatcaacaaattatgccattccccttcccaatgattaaaccattctttcctactaattaagatggatcctttatatcatattagtaagcacatgtagtttctgattatctaagtctgtttattcatctgtcttgcttgacttctgtatgcaaaacaatacatttgtgttcattcaaatatggtatgaatttcagatttgcttcatgtgatattctctggctataaacaattggactgaggaaaataatgaatg

SEQ ID NO: 235113 - DNA, 513 bp, Homo sapiens
ctcctcgctcagccgctccagccgccggtccacctccagcttctccagcgcgcggatcttgaggcgcgccaggccctcttcgtaggccacatcagcgggtgagggggacgcgggcgaagcggaggcaggcccggggcaagggccggggccggggccaggcggcggcgtcgagcacgccgaggacgccacggacttgcgggcgaacagctcccccagcgggatctcgatctcgcgcagcgcatagcgcgctgctgcggcgggcacaaggcccggctcggccaactcctcacagggcaggctagcgggcaccaggtcgccggggaagtgggcgaggggagcgtggtgatggtggtggtgcagcaggtgcggcgccgcgggcgacggcccggccgcctgctccttgccctggaaggaagtgctctcgaagacctctcgccgggcgccgggcacggccagcagggcggcgggctcgggagccagcgggaaccccgaggcagcggcggcggcggccgc

SEQ ID NO: 235114 - DNA, 441 bp, Homo sapiens
cggttttttttgctacaagttctatattgcattgcattgatttatgcaagtatctgtttctttatctggggtcctaccctctttcaacacagtgcttggaattcaataggtgataaatatattttttgttaaattgaagctgcctgggagtggtggttcatgcctataatcccagcactttggaaggctgaggtaggaggattacttcagcccaagattttgagaccagcctaggcaacatgggagaccccatccctactaagaatacaaaaaaatacaaaaagccagatgtggtggcacacgcctgcagtctcagctactcaggagggctgaggtgggaggatcacttgagtccagatcaaggctgtaatgagccaagatcgtgccattgcacttcagcagcctgggccacagagcgagactctgtctaaaagagaaaaa

SEQ ID NO: 235115 - DNA, 379 bp, Homo sapiens
tttttctagtggggcggggcggggaggggggggggttgtgatcttgaagagttaagtaccagagctaagctgagctttcttaactctattggcctttgtacctgcctttgaccctctttgtagtagcgatcccaatccaatatccaaaggggtttgggtcttgtataacagcagggttctcctgacctgatgtctactgttgttcctctgtcagtcccctcaactcctgctttccatgtggctctgcctgggataacacaggcctgggaccagtgaattgtagggaactgagtattccagaaatacctctgtgaaagggaaggtgcacctaccactgccttaataataagggggtgggagagaggctgtctcacccagc

SEQ ID NO: 235116 - DNA, 438 bp, Homo sapiens
cactgcttcattctagcttcactctttatctcactcctcatgattcagctcttattttctgggggctgggaaatttggttataaagtattggaaattatgtcacagatgttaacaaagctaggagtggagtgctctttttagaaaaatagcagaagccagccaggtgcagtggctcatgcctgtaatcccagcactatagtaggcccaggggagtggatcatttgaggccaggagtttgagaccagcctgaccaatatggcgaaaccccgcctctactaaaaatacaaaaattattagccaggcatggttgcacacacctggggtcccagctactcaggggcctgaggcataagaattgcttgaacccgggaggcagaggtcacagtgagccaagattgtgccactgcactccagcctgggtgacagagtgagactga

SEQ ID NO: 235117 - DNA, 336 bp, Homo sapiens
aggagttcaaggctgtggtgagctatgattgaaccactgcactccagcctgggtgacagagcgagacatggtctcttaaaaaaataataaaaataaaaaatacctatgcatatatgtataaaatacacataaaatatatctatagaaaaaagaaaactgtgctttctatattttctacagagaacatgtattaatttcctaaacagaaaaaaatagaaattatttttaagatggtactatgaataaactgggtgagatgttcttggggattgaagaagggcttgggatgggaggtggagaagaaagctgggtgaggggaagggtagcgggttgctg

SEQ ID NO: 235118 - DNA, 410 bp, Homo sapiens
ccttgtcttcatagtttggagacataccactgtcattggagtagaagatctgctgtgttatgtacttaccatgggagaaagggaggaagcttcctgggtttcaattcccactcagagccaggtgtggtggctcatgcctataattccaccactttgggaagctgaggcaggaggacttcttaagaccagtgtgggcaacacagtgagaccctgtctctacaaaaagtaaaaatttagccaggcgcagtggtgcaagtctgtccctcctcttgggaggctgaggtgggaggaacacctgagcctggggagattgaagccacagtgagccatgatctcaccactgcactccagcctgggcaacagtctaagaccctgtctcaagaagactctgtctcaagaagaccctgtct

SEQ ID NO: 235119 - DNA, 207 bp, Homo sapiens
caacccccgccccgtcgcccgccaaatacagcagatggagctaagagagagaaaactatattttgtttatccttacaagccaaaagcttgatgttgcaagagttggagtagtttggaaaaaatggcagtaatcctgaatgaaatccaactatctaatattccttttcctcaataaaaaattagtgatttttagcccctttttccagc

SEQ ID NO: 235120 - DNA, 518 bp, Homo sapiens
gcactgggatggggcagtggcctcccatctgtccccagaggcagcagctggctctcctgggcaggctcttaaggcaccgctatacaagtggcctgagggtcgctccttccttgctgacagccctggtgcaggacgcactgtctgcagcttctgtcacctgcaccacagacattgggttgagggccccctttccaggcactggagggacaatggtgaagaggtccttgccctgtgaagccttcactcttgtggtccagggaaagaggtagctgataggccatgagacgaacagagaagaaattgcttgtgacaagtgctttgaaggaaggaaaccgtgaccagaaccttctctaggctgagtggtcaaggatgaggggattcctgagctggaagcggaagactaagaaggggctggtcctggtacagggggacccatgtggctggggggtggcagaggctgagcctgcggaggggcctggggaaggagtttgcatttcctctggattttgagcacagtt

SEQ ID NO: 235121 - DNA, 494 bp, Homo sapiens
cattatatatatatggttcatattaggtgtatttatcataattaacgttgcttgttattgccagttttaatctgctttgaaatattaaaagtataagaaggatttcataatacagtggcagttttctcctgtgaatttctaaaaaagctagatttaaatttttatggttggcacacaaaagtaacttaaaaaaatggcttcctatggtataaataatatttagtaaaacagtaaactactctactagatggagttcttgtttgcttctgaaactgttagcaactgcatgtatttgtctgccaaaacttcacaggcattttatgtgacttttaggaatataaagaattcttaaaagagcaatgatgagtggagacttagcctcaacagataatgaacctggactaattgggcttttaagggagcagagaggaacataaaggaagaactgtaaaatgaagaataaagtttgtgtaatacatgattatttccaaaat

SEQ ID NO: 235122 - DNA, 490 bp, Homo sapiens
caaacagggctgagtttccaccatttattgccacatagtattataataattgcagaagttggaagaattctagaagctgttggaggaacatgaaaactgctgttctgcagattccgctgaccattacagtcatatggagatgacagagggtgtgacagatctagatgtggccatggagggaatgtgactaaatttaagtaactttctcccagtaggcactcaggagagatgagttgaatggaactaaatggtagatagagccacacaggagaagatgttttgccataaaggcaacaatggtgaaatgaatatctgaatccaataaattaattgctctaataagtaaatggcctctgtgggctactcaaaggaactttatctttgtgcatttaaatgatgatatctaatagagtcactgtccctgagctaactggcagtattactgaagagttgtttttggactgtttctatgtgtagtggaaagtatctt

SEQ ID NO: 235123 - DNA, 646 bp, Homo sapiens
ttttgtggcaactatttctgcattttctgcatttctttctgagtctgctttgaaatgtttttatctatctatctatctgcctacctacctacttccaatttcgatgtccaataatatggtgattatatattatagagtattaactcactggcatattaagtgaccacaataaatgcaaatgaaaatatcatctgctgtgtagctccatggaacagcacatctgaaacatattaagtgaccattccgtatatttaattatagtctgaaaaatttatgtaacatgtggataaagtttagacattttctcaaaaagaagtaagtgaactagaagttcttaatggcctaatatgtgctggatttatctcatttaacccttagaacagtcctgtaaattaagcgtcattacctccatctgaagatgtagaacctgagtctcaatggatcaaataacttgtctaaagtcacacagctaatattaatataaaggtacagccagagttctaggttggtccaaaagctggaatctctgctcttttcattatgccgtgctacgtttagagaaatctaagcaatgatagacttatgtaaagggcttagaattgtagcattttgggttaaaaataaaaataaaagtaaatataaaaat

SEQ ID NO: 235124 - DNA, 416 bp, Homo sapiens
gagacagtttcacccttgttgcccaggctggagtgcagttgtgccatctcagctcactgcaacctcagcctcccaagtagctgggattacaggcagccgccaccacgtccagctaattttttgcatttttagtagaggtgggatttcgccttgttgagcaggctggtctcgaactcctgacctcaggtgatccacccgccttggcctcctaaagtcctgggattacaggtgtgagccaccgcgcccagcccatggtgctatttcaagtaaaagaaatgagagaattatgaaaaaactttatgaaaatttcttgcctctctcactctccgcttcccatctcttccctctttccacactccagcaggagttctgttctgtaaatgcacatctaattgtatcccttctgtcgtcttctc

SEQ ID NO: 235125 - DNA, 385 bp, Homo sapiens
gggcagcaagagcctgtggctgtgactctgggcatcacgctttaaccttggtaatttctagacacctggattagtccagatcggttctttatagttgtgtggttgtcttttaacagttctggtatggacaggcaggttgtgccttatgccaagtgatacattgactttgtgggtgactgtgcagaaaaatattgaggtctctgaacacctccccaataaatagcaccttattcctcactcaaggtttgaacaaattgaacaaacaaacaaacaaaaataaagataggggtgcacaaatctttcgctacggcatcaagccaggcagagggacctgactgtgctctgctacctggaccagggcaggcggtgccctgcagggatggag

SEQ ID NO: 235126 - DNA, 512 bp, Homo sapiens
aagtttttatgttaacatacatatgttttatatagtatgaacatacgtatgttttatatgttaaggtacataggtttcagttctctttggcatatacctaggactggaatggctgggtcatatagtcactctatgtttaaccttttgaggaaatgccaaattgttttctatagcagctgcaccattctgcatttccactagtattgtataagggctctgatttctccatatcctccccaacacttatttttctgttacttttttcattttctagtagccatcctaatgtacgtaaagtggcatttcattgtggttttaacttgtattttttgtgattactaatgatgttgaaccccttgttatgtgcttactatatatttgtatattttctttactgaagtgtcacttcatatgttttgtccattttaaaattgggctgtctgtctgcttaatgaattgtatgaattctttatatattctgaataaaagatctttataaagataggtgattt

SEQ ID NO: 235127 - DNA, 381 bp, Homo sapiens
atcatcttgattactgttgctttgaagtaggttttaaaatctggaagtgggatcctccaaatttgttctttttcaagattattttggctatttggggtcccttgagattccatatgaattttaagattttttttttctgtttcttcaaaaatattcctttgggatttttttggtttttagtggcaggatttcactctgttccccaggctggcctcgaactcgggcttgagtgatcctcccacttcagccttccaagaatttaggactaaggcaaatgctacaacacccaacttgccactgggattatgataaatactgcattgaatctgtaaatggctttggatagtatggacattttaacaaaattaaagtttttcaatc

SEQ ID NO: 235128 - DNA, 85 bp, Homo sapiens
ttatctttaccccagaggcacacaggaccaggcatgttgtatacatttaaaaatatcaaattttaacattacaaaactggccaat

SEQ ID NO: 235129 - DNA, 550 bp, Homo sapiens
ataataacaggcatatctttggatctcatgcattttggagacaggccatcctcacctgtcctagagtggtgcttgtggaatcactgtggtgaggcacaagcgcagcctcttcttggtcagagcctcatgtgagcttgttgtttctgcctctcatggtgtttctcagcctagacttgccagccaaggcatggggcactctgaggtcattccaaggggagaaagattgctaagaaggaggccttgggtggatggagacgagagagcagatgctgagctgctgggcgccatggaccacctagggtttcagccaagggctgggctcttcctaggcccgagcaagatgagttcattgttggatgcacttgaacttcaggaaagtgctgacaccagcccagagcaggggcctcattgtccctccccacctcctctcagtgggaatgtggcacgtcgttgccagctgcgaggtgttcctggaatgatggtgtccacagctggagcaggtcccggtccctggagacagttatcaggtctcagggctccagtcaatgca

SEQ ID NO: 235130 - DNA, 360 bp, Homo sapiens
catttcagacaaagggaagtcataagttaaggaaggcgtattggaaattatgtgtgtatagggaatggtgaggtcaagtttgattcagagatacagtgctaggtacagtggctctcatctgcaatttcacctccttaggaggctgaggtgagaggattgcttgagcccaggagtttgaggctgcagtgagctataatcatgtcacggcattctagcctgggtgacagagtgagaccctgtctcaaaaaatttagtaaggaatacagtgtttgagaggtagtaggctatagaatttagaaatgtctagaccaatgcttgacacttaaaagaagcctggtgaatatttgacaaattgatgga

SEQ ID NO: 235131 - DNA, 839 bp, Homo sapiens
gttaaatgtaggagagtcccaaaatttattctcaatgccatttaagaggagaaaagcatcactaaccctcctaggtacatagcagggacactgtaactacagcctgcatgaatgaataaatattgagtgttgagtggtgagtggttcttacctatgctgcaggcacagccctgtgctgcagtccacacaagtcctgtggaatcatctggatgcaagtgcttggaaagggccaggggaaggctattgtctgctcgcacaagttacttgttattgggcagttgtaacccatactgctataagcattactgcaaatcccataacaaattttacgatgaaaatctcatgaacttgactgtttctgcaattttgagccagtgatccactcattccaaacaacattgacttcccaagcaacagaatctgggtagtccctgggagtttgctctaatgaagcttgaactgtgtcgcaaactcttattttgccttttaaaagaaaagaagccagttggattcatttggtagtagatataggaaatctgttaatagtttttcatgtctttattgaatgatcataatttaaaatatcctcaaaggcggccttccaaacaccagaatgctggatttttttcttctgcattcatcacaagtaacaatgttgagtttattctctcgtctgtaacctcagcatcttttactcatgctaaaaatcctttgtaaaatctaatgaaaaaattagatttcatttattcagtagatacttaaattttctaagtattgtcaataaacatttggtggtgtgtagtattttccctcactacattttttaggaataggaagca

SEQ ID NO: 235132 - DNA, 430 bp, Homo sapiens
tgggagggacccagtgggaggtgattgaatcatgggggtggtttcccccatgctgttctcgtgatagtgagtgatttctcaagaaatctatggttttataagcatctggcatttcccctgcttgggttcattttctctcctgctgccctgtgaagcagtgccttccaccataattgtaagtttcttgaggcctccctggccgtgtggaactttcagtcgattaaacctcttttctttataaattacccagtctcatatatttcttcatagcagcgtgagaacaaaccaattaccataagtgggaaaagaaagtatttcttttctggtagaaccagatctagaaaataaatctttttctctttcatagtttatactacatgttgtctttttaaattattttctcataaagccttggatatgtttaaatgta

SEQ ID NO: 235133 - DNA, 450 bp, Homo sapiens
ggtggaattgactagaaatgaataagatgcccccagtggtttcttctcagttaataagagaatttagcattcatgttattcttgtcatggaagactgagttccagtttttattaatacccattgccattcattgattctcccattcttctattcaaaatgcctttatggttaccatgcactaggcacatgccaggtaaaggggatataaacacaaatatgacagtctcaattattgagatgcagagaaatgcagtaagcaagtgagtacagagtgggataagtaccaggctagatctgtgcacagggtctaactggaacacactgagaggcacttattctaaactggggcatacaaagcagaaaagcttgctagagtagatgctgtctgggctgaattctcagggacaagttgcagctatgaaggcaaaggaaggaaggtcattgagcca

SEQ ID NO: 235134 - DNA, 966 bp, Homo sapiens
cgtggcctggtggccgggacatggtgtgtggcctggtggctgggatgtggctgtggcctgtggctgtgaacgcagcgcatggcctggtggctgtgacgtggcacgtggcctggtggctgtgatccctggtgcacatgagggagttttagttttgtgcttgcgttcctagtcatgtcataatccagctcagacctggacatgacctcagcccaggccgtgcccggtccccctactccgtggttcccccgtgggactcgcattccttcatttttatcccgcgttgcacgttcctccaagtcctgttgtttcctcggggccatttttaactttctgaaaagacttgaggccatctgtgatcttccaggacttccttttatgtatttcttgttaaacttcatctgcagagcactgtgtggctataatgtggcacctgctgtgtgttatcccgtcgggtgaaacgctacatttaaatccccgcttgtgaggggactgaggggtgcgcaggtgtttcctggtgtgtacaccaagaatacatcttggcgaggtttctctagggtgcatgcccaggaggaagtgtggctcgtggggcaggtggacgtacatctgttcctggaactcccccaactgcaggcccgagaacacggtgtgaggatcgctggctcctgcaggacgtggacgtggcaggggcctgggatctggggtctggcctggggtctggggtctggcctggggtctggctcctgcaggacacaggcgtggcaggggcctggggtctcacacacaggacagcaccgcgctgcatctccttcctgcgtcataggggatgtgggtgaggagtgcctctccagtgaagctttataaccctaaaaagtattgtctgcccctaagagcgtttgcttatgtgcgttctgtctcttcatgtttatgatgatataaattaaaaccaagacattttaaattatctat

SEQ ID NO: 235135 - DNA, 552 bp, Homo sapiens
aaccagggtcaccagaccgacagggaagctgctatagaacccccaccctcttgtataggtgaggaaactgaggccatagcgctgacactagccagatgcagggaaggcaaacggaaggattaagaaagccccagaaggatgccttgaggaatgtcgggtaggagcgctcgtctgaggagctagaaggctaactccagcccgctacaatagcccaccccaaaggagtctgcacacctggaacccacccctacggcgcgccctcatgagggcgctcccagcgcctctaaccctccaagtagcgagagggttaagcttcctcgcagtacttgccgcagtaagtggaaaggaaagaagtgtcaactctgttctcaccacagcggggctgtcggatggcacctccccccgccccgcgcaccccgcccggcctgctcccccgccctcccctcggagcgcgcgcgcacacacctcccaccgctttgcccaaattattttcgatcccgggagactccggatgccagacgcgctcggcggcggcggcggcggcggcggccg

SEQ ID NO: 235136 - DNA, 240 bp, Homo sapiens
tccccaccacaccccacccccgcacccggccgactccagcaagaggcttcccgctcggtgtgcagcggccacagtggccaggaattaaaatgcagcgaggaggagccgggcgcgtcagcaccgcgtctccaggagcgcacggcgctcacggccgccgccgccccgcccgcccggagccgcggggccagcgagctgaggagcaggtgctcggagcccagccgcgccagcgtcgcgcggccg

SEQ ID NO: 235137 - DNA, 171 bp, Homo sapiens
taggctctgccctcatggagtttatattctagtgggagaaacagagaagaaagatatagacaaggtaaataatcaaggtaatttagtaaaataagcatgaagaaaactactgtggaagctgtaagggataaatttccaaaatatataaggaattcctaaaactcaatagca

SEQ ID NO: 235138 - DNA, 326 bp, Homo sapiens
gcagctatcacttccactttcccttgccccatacaaccgctgtcagattccaacccagtgcttctaaaaaggtattcttgggtttctgggtcctggtggtctttaggcaaccaaaagattcagagggtcccagtagggagccagagttacactgactgtgaagatcctggctgtctctcctggggaccagggacaacaccccaatacatgcagaaatgtgcacgcgagcacacacacacacttaggggtaggaaattattattaaaactatttcactgtttttttttactgtgttctaatgtgaccaataaataattttaaattac

SEQ ID NO: 235139 - DNA, 931 bp, Homo sapiens
gaggggagaactgttttattaccctaaaatagtgagaaccactgttcaaactaactagctaccaagtgacttctaactcatgaagaaaatttgtatttaagagcaagttcaaatgtagcaggctctcttctgagagtattctggataccacggaaagtttcatttatatattgcttacaagtacgtggtaatttgaacttcagtaggtgatatgtgcaaggagaaaaagtaggtcaaggagaaagttggttagtgcagaggactgacttagcatcagtctgtgaaatttcattaaagtagcactaaggcctggctgtttgcttagcatgtaaatgctgcagtgtccaagaaaatgcctcctatgccttagaaaatttgctgaaggcttcctgttactggtggagtagaaaagcaatagcctttgagactccaaagagagtagcccccttagggttttcatactgaagaaccttgtggagtactgtgaaacattgttgaactttatgcaaattatactgcactggattttaagattttatggggagagagtagagcagagtggggaagtaatgataaaagataaatacgtaaacttgtactatattttaagcaaggaatgaaacaaattccctaacaggaattccctgtcagcactgtgaagtttggtcaagttctgcctaatgggttggcttgctgattcctcttaaacctctaggaaatcctttctaagacagcaaaacaaacgttagtttgagtactactatttcaccaccctgctccatccccctactctcaacgaaagaaaagcattcccaaactataggcaaaagaaatgtgttctcagtccattaatttttcatctgctatgatctctgttcacagttttagcacattgcattattttgtaatctgatagcagaacatcaggaac

SEQ ID NO: 235140 - DNA, 410 bp, Homo sapiens
agctgtaatgtttgcaaaactctggggttctgaatgtagaaaaacacaaccccagtttaagacgtcctcttccgatccctcagtttcttgctgttcatacttgccatctccatctctgtagtcttcctgattaacaccttccagcttcagatctggaagtagtaatccgagcactggactggaaatcagatcagacctgtttcacatttaaagctttgcctttgtattagttctgtgacaagtcacttgacctctctgtggtctcagtttatgaaattggaaggagattggttaatatgggaggatctccatgagccttttctgttttggtctgctaggattctaaaagtattctctgttcttaatactgtacttacaatagagtccaccccaactttatttattcatac

SEQ ID NO: 235141 - DNA, 883 bp, Homo sapiens
agtttaataagggttttctttttttttctgtttctagcctaagataaaagtggctgcatatgagcacaaaatatgcagatcatagcattccaacaaaaatgtaaagaaggccgggcatggtggctcatgcctataatctcggtactttggtaggccgagtcaggaggatctcttgagcccagcagttcaagaccagcctggggaacatagtgaggccccatctcttccaaaatttttaaatatgaataaaactagaaatacaaaatctgtgttaagaaagctctcaaactttaccaaaagaccagacctaaataaagaggggccaggtgcagtggcttacgcctgtaatcccagcacttcaggaggccaacgtgggtggatcacttaagccaaggagttcgagaccagcgtgggcaacatgcgaaaccccatcgctacaaaaaatacaaaaattagccaggcatggtgacatgcacctgtagtcccagcactcaggaggctgaggcaagaggatcactttgagtccaggaggcagaggttgcagtgagctgtagtcttgcccctgcactccagcatgggcaccagagccaggccctgtctcaaaaaaaaaaaaaaaaaaaaaaaaaaaaaaagtgtaatactgtattccttgtaatactgtattcctcgtttggaatgtttactgttgaagatttttttattttataaacattttagctcgtcctttgtgttctaggagttacaggtagagctatgaacaaattaaggtcccctcttttatggtgcttatatcctattaggtaaattgcgggggagggggttgttgaagagaaggcaggaaaaatatagtaaaatatatagatgtcagatgatgagaagctct

SEQ ID NO: 235142 - DNA, 517 bp, Homo sapiens
  misc_feature (451)..(451): n is a, c, g, or t
ttcacctttgcatcatcttcaatactggaggtttaccttgtgtagaggccttgagagagttctaatctgttcagtgcattttctgcaaatgcagctccgtagaatacattctcgccatgttttcattgtgcgtgaacactgtgcgtgtgtgtcttcctcagtaaatgaagagatgtccttttcccacatctgcattgtgagtgagaacatttcgccagattgtggctctttaggcgcggcacacacgtggtttttgatccgtctcatcaaaagacttggaatgtccatcgcggtgcggcagaaggtggtggttatacagctgggtgcacagttgcccatcacagtgatacgtgcttagagagtaagcttctgggccgctttcttagacggcccctctgttttgcttgtaactggcatgcccgtgtgaccacgtttgtgtacctgggtgtgnatgcttgtgaaaatatgaatgctgttgctgcctatcttatcaagtaaaggacctattagtgttgtc

SEQ ID NO: 235143 - DNA, 242 bp, Homo sapiens
caaaatcagagaccagcacaggtaaggatcttattaaagttgtatagatgagagatagttatggctggaagtgaggcaatagcagaggagggattgagaagagtgagattctgggtgtatttttaagatagagtcaatatgccttgctgataggatggaatcaggagaagaaaagaaggcaatgttgacgtcaaggatttgagccacaaaaagagacctctggggatgactatattatttaa

SEQ ID NO: 235144 - DNA, 1248 bp, Homo sapiens
  misc_feature (1110)..(1110): n is a, c, g, or t
  misc_feature (1162)..(1162): n is a, c, g, or t
tccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcnttccttcataaatgctaaattttatgtcatcatatctttcagtccttttctntattatttctggctttgatggcatgcattgaaagcccttttccaccccagagttatcaactcgttggaaaatgatgttgaaatgtc

SEQ ID NO: 235145 - DNA, 537 bp, Homo sapiens
caaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtaaaaat

SEQ ID NO: 235146 - DNA, 459 bp, Homo sapiens
cctagaaggttggaaagtgtctgggactataagggttaacatgcataattgcaaagattgtccgaaggctgatggaaagcagagactgaatgggattgagaacagatgcgaagcttgatttaaattacattttattggatgctgcagccttaagagacgtgactgctttacagtttgtttccacactgtgggcagctgctgtctgttctgtgtccacagtaggatcctgcccaataaggagcagcctccccacctcattgtgtttgaggcttggcgccttcctcttaactgtagggcttgagtcaggaacatggcttgactcgcagtggggctgctatgtatcctccctggcttccagccaaaatcacattggtagattcaaaggggccaaatttctttcccctctatctttccctttcccctggttttggaaatagagttttctgtctactgatttgt

SEQ ID NO: 235147 - DNA, 351 bp, Homo sapiens
tactatgagccaggcagggattttatacatttaatatgtattccttccttttatccactgaccctactttatggaagaggaaactgaggcatctcagtgactgaagaattttcccagatcacatacagagtaaacagagaaaccaggatttgtctccaagattctgcagtgctgccccaaacaactggctgccctgagagtgaaagagggtcaaggaaacagagggtatatagacagtctgtcaggaagtttggaagaggaagaaagctagattgttagccaaagaggtcaacatctgaccaaagtttttttaatgggaggggtcattaaagatcttctaactcagtcctt

SEQ ID NO: 235148 - DNA, 544 bp, Homo sapiens
tgggtggtgctgtggcccacaaaatccagtatggcccatcattgtgtctatattttggccatttggaagatgaaagaaaagggagaggtgggactgcccttctgttaatgcacaacctggaagttggacacattgcatctattctattcctttggctataacctagttgcacttatctgaaaaggagtttgaaaaatctagtctttatcctgtaaagtcatgggctggctactgccatggaacaaggggagaatgggtattgggagacagctctcagtctgtctaacaggtggtgaagagaaagtgggacttgagaaggagaaaggggagggaatatggtaaatttctgggattggacagagatagctccctatggctaaaacaaagagtaaggctagcaataaagctatcattggagaagctaggcttcattacagttgttaatatctagcaaatgcatgacgagctagacagatgaaggaaaatggtgcccttcagagatagaggccttccagatttctgagatagaagctctccaggagga

SEQ ID NO: 235149 - DNA, 474 bp, Homo sapiens
ttcacgtcaccttgatgaggggactcgaaggtgaatttgcactgggttccctttcagccaagcatcagtttgctccaacctcttgagcacacagaagttgagaaaaattgttattttagcaagaacactagaggactgtgctgttctctgaaccacgttcatctgattatgcatttgagggtatgaattaatccacgacacaggaacactgaataagttgtgctttgccagtcgggctgcctgtgttttatctgaacaaaacatctgactttaaccccaggcagatttctcttcaggttgtaattattctggaacaaacagagaatttgggaaggggcatcccagtgggaacaatgatacctcctgtgtggaaggattcccactggaaattttcaaaacacagtgtactgaagttgacccggataactgctggctgcaatccagcttaccctcttttatgtagatgagttctca

SEQ ID NO: 235150 - DNA, 153 bp, Homo sapiens
gagacaggcatgagccaccgtgcccagcctgaaaggataatttaaatccttaatcagagcgtactcctcctctacctttatcggcttcttattcttccaaattccttgtccatggcctggctacctcttagatcccatccaataccactttcc

SEQ ID NO: 235151 - DNA, 392 bp, Homo sapiens
ctggtctcgaactcctaacctcaggtgatccacccgccttggcctcccaaagtgctgggattacaggtgtgagccaccacgcctggcctaacatcactgacttttcaatcctcacaatttaaatctgacaaaatgaagagaactattttttaaaattgtgttttatgttcattgacaattaagtagaagtcattttttttagttatgtatctatgattatcaccaatcttcatgtacaaaacagtttctatctctggacctcattatataataagaggaaggatagcattgttctaaatataggtataaagaacacttacgacttgtgattgattaggctatcatgaaaataaagtattttactactgtgtgatcttatgaaggctgaatta

SEQ ID NO: 235152 - DNA, 957 bp, Homo sapiens
  misc_feature (874)..(875): n is a, c, g, or t
  misc_feature (921)..(921): n is a, c, g, or t
gatgtgcattacagagttactgagagttttagagaaaaatgatagtcacacttcatgcagagtgaactggatagagatcagaatgtattttgtataaaatgttaattctcataatttttgaagcttagactgcctgtttgttacagtatagatgctgttgtttccattttcagaagactgtgcagtctttgtaactgatgaagagcaaggctttgtctctaattctgcccagttaaagtgcaggcgttaggctaaagctgggacaaacctggagcggcttcattggctttcctacttcttttgcatcccaaagcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttagactagaatgctgtgcgatggaaatagtgtatctgaagggtaatnntagatcttgacacatctaatgacatcacaagatcatcaggacactngactctgtgacttgacagatgcgtgttgctactcat

SEQ ID NO: 235153 - DNA, 658 bp, Homo sapiens
  misc_feature (604)..(604): n is a, c, g, or t
  misc_feature (628)..(628): n is a, c, g, or t
  misc_feature (651)..(651): n is a, c, g, or t
caattatgtagtttgagaattcccaagatctacagcttggaagctgaagacccaggaaagccaatgtgtatatccagtcttagtctgaagacctgagaaccagaaaaccaatggtgtaagtcctggtctgagggcagcagaagaccaatgttccagctcaagaagtcaggcaagaggacttcccttttactcagcctttctgttctatctaggtctctaattgcttggatgagcaccccacccccacattagggagggcaatattcttttttttttaattattattattatactttaagttttagggtacatgtgcacaatgtgcaggttagttacatatgtatacatgtgccatgctggtgtgctgcacccgttaactcgtcatttagcattaggcatatctcctaattctatcccttccccctccccccaccccacaacagtccccagagtgtgatgttccccttcctgtgtccatgtgtcctcattggtcaattcccacctatgagtgagaatatgtggtgcttggttttttattcttgcgatagtttactgagaatgatgatttccaatttcatccatgtccctacaatattcttatacnatctgattcaatattaatctcatncagtacagacataccgagattgnttggccc

SEQ ID NO: 235154 - DNA, 605 bp, Homo sapiens
  misc_feature (551)..(551): n is a, c, g, or t
  misc_feature (575)..(575): n is a, c, g, or t
  misc_feature (598)..(598): n is a, c, g, or t
caattatgtagtttgagaattcccaagatctacagcttggaagctgaagacccaggaaagccaatgtgtatatccagtcttagtctgaagacctgagaaccagatcaagaagtcaggcaagaggacttcccttttactcagcctttctgttctatctaggtctctaattgcttggatgagcaccccacccccacattagggagggcaatattcttttttttttaattattattattatactttaagttttagggtacatgtgcacaatgtgcaggttagttacatatgtatacatgtgccatgctggtgtgctgcacccgttaactcgtcatttagcattaggcatatctcctaattctatcccttccccctccccccaccccacaacagtccccagagtgtgatgttccccttcctgtgtccatgtgtcctcattggtcaattcccacctatgagtgagaatatgtggtgcttggttttttattcttgcgatagtttactgagaatgatgatttccaatttcatccatgtccctacaatattcttatacnatctgattcaatattaatctcatncagtacagacataccgagattgnttggccc

SEQ ID NO: 235155 - DNA, 337 bp, Homo sapiens
gagtgcttcttcactacagcttcatctgccctctagatgttatgccacaactagctacgaaggatagcagccctatgttttgctttggaaaaggccagtgcaatgctgaatatcatcaggaatggtaatggaaactgaagagaaacatagccctaatcttatattggaaactatagtgcattcaccccctcagagcccttgcttgtaggttttaaatctctgactcacaggaatgctataatgaaatcagaagtaggaaggacaacttctgattgtccttctgacctgattgtcagcctgaccaacatggtgaaaacccgtctctactaaaaataca

SEQ ID NO: 235156 - DNA, 675 bp, Homo sapiens
tttgatgtttgctcagaattcccctgtaggcagagaggagggttccccatgcaggggatttgatgccgtctaagttcacagtttctattagggcttatcattatgtattatagccagatgttaatctgcctgttttccccagtagactgtgagagatcagggagcaacacatctgcatctggcaatagaggaattttggacaggggtgtgtgtaggagttaaccagacgtgggacatatcatgataaaccagggagtaggaaagaaaccctgaataaaagcagggcccagagagatggaaaggaagagatggagctttttaggatgtggaatctgtgtcaatctctacaacgaaccagggaggagtcaagaacgagctctcagattctagtttggacaaccaggtagattcatggtaagaccttgatcagagctggggagcataggagaagatgcatcatggatggggaaaaccgggatggtttagttctgaatggattgagtctaaggtacctgggggtctggagtacagatattctggtccttttagtgccacaggctgagctcgtctctgtaactactactgggtcctgatggtctgatgtcttactgactcgtttcctgtccttgagtctcacattttgtagtccgcccttgactttgagctctagatggg

SEQ ID NO: 235157 - DNA, 2805 bp, Homo sapiens
  misc_feature (1686)..(1686): n is a, c, g, or t
agatcaagcattacaagcatcctacaagcctgcttatgtctcctcccaatcatcacttccttccttctcctaagagataacctctatactgacttctaacagattaatattacctatcttttacatttatataaatggaatcacatagtacatatttcatgtatgcattcttgtactaaacattctttgtgagattcatttatgttgtggcacataacagtaattttctgatttccagtactgtatagtatgctattgaatggatatacctgattttatttatctgttttcagctgttatgaataatggtgctagaagcattcttctttacttctcttggggcattcatgtaggcatttatctcagagcagaatgaatgcatacttcagcattcttaatttcagttactatattttttgattctagaatttgcatttggttcttttttatagtttccattcataagatggagttctacatcttgttaacacatttctcaaatatgttaatcaaacttattttaaagcatttagctcacaactccaatatttggatctatatgtaggcctagttctattatctgtttatttttcccttggtcttgtctcttggtatgcctgataagttttgagttaatgatggacattgggtatcaaaacttaggaaatattttgaggctctaggtggtgttttcttcctctgaagatataaaaccaaaaaataagagaaataagtgcaaaagactaaaaataggatggaaatgctaccaatattaggtattagtccacggagttcaccatcagagtaaaaggattccagaaagagagactagaagaaacagaaatataagatttcccaaaattcaaggacagatattttcagattgagatagctcatcacatgccagaacaactaatgaaaaagacttagcactgtgaaattttagaacaggaaagataaagagaagatcctttaaacttccacaatttaaaatacaatttatgtacaaaggattgggaataagaatgatatctaacttcttaatagcaatgttagatgatagaagaccttgaaactacctttaaaagtctaaggaaaaattattatcaacctaaagttctatatgcatccaatctatcaatcaaatgatgcagaatgaagatacaaggcctcaaaaatttatttacatcgtttctcagaaaatatctcgaagatattctccacaaaaatgagtgagtgggtgaagaaaaagaagtatataggattcaagaaacagaaaatttcatccaggagaaaagcaaagagagaagctgctccaaaaaagtaaagtcttaatagcaaatacatggaatcaacccaaatgcccatcagtgatagactgaataaagaaaatgtggtacagatacaccagggaataatactatgcagccataaaaggaatgagatcatgtcctttgcagggacgtggatgaagttggaagccatcatcctcagctaactagcacaggaatagaaaaccaaacactgcatgttctcactcataagtgggagctgagcaatgaaaacatatggacacagggaggggaacaacacacactggggcctgttggggagtagggaacaagaggagggagaacttcaggcaaaatagctaatgtatgctgggcttaatacttagatgatganttgatagatgcaaccaaccaccatggcacatgtttacctatgtaacaaacctgcacatcctgcccatgtaccccagaacttaaaattaaattaaacttaatttaatttaaaacaagaaagttaagtctttaagaaaagaaagcaaaaggatttctagaattaagcacaaaagaattcaaaggatgactcttggacagcacatctataggcagactgtccagagtttagcagaaaatggaaactttcaggagaaaagtttccaggaaaaaaatgtatctgatagagtatgatgtgtttgaacatgaagaataaaattgattgtggtgttgtagtgctaatggaggatttagaaagaattaatgttagaagtgtagaaaacctacaacaaaacaaagcaataatcaacatcaagaaaaacaaaaagttgtacaagagaagaaatatcgtaatatatcatgtagctcagatatgcacaactttttttttaagtagactttatttttttagcagttttaggctcatagtaaaatgaagcggacagtatagagttttcatcatgtcctttgtccccacatgcatgtagccttccccactgtgaacatgcataacagaatggtacatatgttacaatcgatgaacttacactgagacatcattatcatccaaagtctatagtttacattagaattcattcttggtactatacgctctttgggttcttgcaaataggtaaagacctgtgtctagctagtactatagtatcacacagaataggttcactgccctaaaggtcttctgtgctccagctatttctttctttcttcccctaacccctggcaaccactcatttttttaaattgtcttcctaattttccttctccagaatgtcatagttaaaagtatatagtatgtagccttttcagattggcttctttcacttagtaatacgcatttaaggtccctccatatctgttaatgccgtcatagctcaattctttttaacaccggataatattccattgtatacatgtaccacagtttattcatccattcacctattgaaagacatcttcattgcttccaggcttttgcaattatgaataaaactgttataaacat

SEQ ID NO: 235158 - DNA, 347 bp, Homo sapiens
tcaaaactgcgtggatgatgttagtaggcagatgccatggatgctgtgaaaggtcctacaatgcataggtcagccccccaccacaaataattatctaactcaaaatgccaataatctccagatttagaaaccctattcttcctaatgaatagtcatattttaccatctttaaaaattgagagccatgtgacagaattattttggcattccctttctcagaagaatgttaaacatattttgctcactctttctgagtgatttcaccacagacactacttgcatctgttcccacttaactttttagcatcaaaccaaatatagcatttcaaaaactagttactttttct

SEQ ID NO: 235159 - DNA, 512 bp, Homo sapiens
actttgacactttgcttagaaacctcctctgccaaatatccaagttcattccttacaaattctgctttccatattactgtagaacacaatttagctaatttttctgccagtatttgaaagatccacttccctcaaattcccaagcatgttcctcattttcttccgagtcctcatcagtgtacttgaaaattcatatttctagcaactttctgtgtatgatgatatatgtattctctgcatctgatgatacaggctttctctgacttcttcattttcttctgaaacctcaccaacagtaacttaatttttcaggaatgcaagattgttttcatattataaaagcaattaatgtaatttactacactaacagtgtgacaaagaaaatcttatctcaatggatacacaaatttatatatgttttaaatgtgaaaataaggaatagaatggaacttctttaatctggttaatggtatagtcataaaattctatataaaacatcataattaacagag

SEQ ID NO: 235160 - DNA, 388 bp, Homo sapiens
gtcattgtttgaagcaattgctagtcaaaccagcttcaggggatgtgcttttgtaatcaccccgtgggttcttcctgccccctgcacaaagtccattcactgagaccatggcattgcagtagagaaagtttaattgatgagagtctggcccatgcaagagaaatggagttaacactcaaatcattctctcaggcttggagcttagagtttttgtagacgatgtggtgggcagggagctatgaaatgggtgctactgattggttgaggatgaaatcataggggtgtagaaaactagcctggtgtattgactccacctctgggtgggagcacaggacaagctgagtcatgagtcatgagtctgggtgaagttagtctgaaataatctaaa

SEQ ID NO: 235161 - DNA, 502 bp, Homo sapiens
ctgggacccagaaaccctcttaccctgcacctctgtcatacttctcaaaaaaaaaaaaaaaaaaaatctaaaagactattttaaaagtctattcaggtgggtgggcaaaattctaacatgatcctcaagattccaagcctgtttcacacctgctgtgtaatcctttcctcttgagtgtaaaaaaactgtaactgtggtgtgaaattactcataaaattaggtcactaatgtgttgcctttgtggccatcaaaagggagattatcctgattgggctaaactgaatcagaggtgcttttaagagaaagggacacaaaaacacttcagctggcctggaagtaagtgatttctaggtgggccatgctgtaagctgcttatggtggccacgtggcaggaaatatatttgtatattgtcatcattcctgcctcccacatggtgcttccagtagagaggacagaaggatctcatggcagaggaaaaaaaaaaaggagtctaatttatgc

SEQ ID NO: 235162 - DNA, 395 bp, Homo sapiens
aaagttgttgggcaaaagttcttgatttaaaaataactaagatgaattaaggcaagcagtcatcgatttgaatggccccctttaaaagcaaagcatccctttattcctttgattgaaaggaagcccttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaacataatgagacccctatctctttca

SEQ ID NO: 235163 - DNA, 362 bp, Homo sapiens
actttaaatgtcctgtatgcaaaaacagtcacactggggattagggattcaacatatgaatttgggtggggagggacacaatttagtccataacactctgccttctggacttccaaaattcgtatctagccgtgagcgcctgccataagagtgctctcttgaattcctttcctttctccataagtgtgaagatggcagaaatcaataacagatgttccactttcctgatatggaatggaggaaaaagagttgctttccttcattgatcatgagatagttggtttatgctttactttctgcacagtggtcctttgtattttatggtcttttgttttaataaactgcttctctacaaagctgca

SEQ ID NO: 235164 - DNA, 453 bp, Homo sapiens
ggtgtctcacccctgtaatcctaaggcttcgtgaggccaaggcaagaggattgcttgaggccaggagtttgagaccagcctggccaaaatatcaagaccctgtctctaaaaaaataaaaataaattaggcagacatagtggtgcatgcccatagctacttgggaggctgaggtgggaggattgcttgagcccaggagatagaggctacagtgagctatgattgcactgctgtactccagcttgagcgacagagcgagaccccatgtcataaataaataaataaatacctggaacaccttgtgatgccagaaataagaaagtgtcaaaaaggatggagatttattgaaaggacactagagccaacctgaaaatgttccaaacagtccaagccagaacaatctgaacaataaaataatgatcatattggattatagattatagaataaaataagc

SEQ ID NO: 235165 - DNA, 559 bp, Homo sapiens
atatctgcacacttacttcctggcttccccttagactgtaaacatcatgagggcagatacttgcccggcacatggaaggtcctcgggagaggaagaggcaccatagctagaccagaaattctccctagccacgtgcagccccctttgggacaggactggcacaaacgaggactgctctgccatccaccgtgcagctactggcgtggtgcgccctcctggaaccccgtggtatagctgttatgatccctttcacagtagcataatcaagactcccaggagagacgcggcttgccaaggtctcatcgcccttcagtggcagagacagccttggagtcggccggcctcactccagggccagagccccgagagctccgcggctcgcgtgtctcagtgccgaaggcagaaaagccgccttggaaagtagtgtcatcgtaggctccgcgcggcgcgtgcattttagcaacagacttccaggtttccagcgcgggccaggaaggggccggcgccccgcgccccgccgggtgtgtgactttgccgcgagggcgcagccgagcggccg

SEQ ID NO: 235166 - DNA, 373 bp, Homo sapiens
aggctgcagtgagccatgatcacgccaccgcactccagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccacta

SEQ ID NO: 235167 - DNA, 264 bp, Homo sapiens
gttaacctctctattaacaatggcttttcctttgaaaaggtcttaatagggctggcatccaagtttcatgggatgccctaatagggctggcaaccttgttttcatgatctagtttggtagaaaagtttcatagaaagtgtccatatagctgggtgtggtggctcacatctgtaatcccagcactttgggaggctgagatggaaggatcaatgagtccaggagttctaggctagcctgggcaacatggcgagactctgtatctat

SEQ ID NO: 235168 - DNA, 338 bp, Homo sapiens
gggattctcccacctcaacctcccaaagtgctgcgattacaggtgtgagccactgtgccggacctaaaggactctttgagcatcaaagagtgatgctgaatgtgtgatttctcctttctgagatgttatcttgttatctgtgaagtgggggatctggctgagccactaggggtttatcagatgtgtttttgaacttgagcaattgatggctaggaggctcagttttgtcatttggaaaatggagttgctgatacctcaatccttggagaacaactgcaagcactagagttcgagtggaggttgcagtgagccatgctctcaccattgcactccatctc

SEQ ID NO: 235169 - DNA, 224 bp, Homo sapiens
cacacacacatattacttcctggatcattcaggacacaggtcaaatgtcccccacaccataaagcctgccctaacttcccaagtcagagtaagatcctcccttctcactgctcccacagtacttggctcagtgtgatctccatgtgaatgcttactacttggtactcaaacttcccatttacaaatttctataggccagagagtatactctaaatgctaaaagt

SEQ ID NO: 235170 - DNA, 404 bp, Homo sapiens
gttggtggccggtccaccggctcctggcacaaccttgcagaggtggccggttgctttttgagccagcttggccttgcccggcatgcataattctgtgcaacaactgtgacacaaatggagccacacagagaaaatgagcagcaggctcaggaacagggtgtgtgcttcctcaggggctccagtccatgcctaagggttcatatggcactgtgggcttcttggttgcaaagaggtagaccacaggccatcttcaggaggtctttatgtggaagtgcagaaagcagccaggattaccacccgtgggactcggccttttgtggccctggcctgacagaatttggcccaaggcaggacaagctcactcggagcaacatgtcagaacctggggccgtgcatgtcaggca

SEQ ID NO: 235171 - DNA, 397 bp, Homo sapiens
caggcttcatctagcacaagcactcgatttttcagccttcaggctgttttaggcttgaagatggggttttgtccaagacacttggctgttttctaactctgttattttccactgtcaataagtatatctaactgctgttagaataaggataaagatgaggacaaaaaccacttttaagtgcttcctgatgacagggggcactgttgtgaaataaatggcagtcagttattccttagaggcctaagtgtctccagtgaaaggggccattgtctcagcctatggtagtgtgactgtttgaagtttgatagcctgaaggtgaggagaatcaaactgtgttactaaaaagcacgtattaaaatgaaccaagggaaatgtggaagagacagctcaaaaaaaa

SEQ ID NO: 235172 - DNA, 261 bp, Homo sapiens
caacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgatt

SEQ ID NO: 235173 - DNA, 625 bp, Homo sapiens
agcctctcaaagtcttggggttacaggtgtaagccaccacacccagctcatattttttataatagccatcttaatgacttgacaatttcattataatgtgtcttggtgtgggtctctgagtttatcctacttgggacttcctgggcttattggatttgtagattcacatcttttgttaaatttgggttgtttttggccattatttagataatttttcttcccctttctctttccttatagggacttccatagtgcatctattggttgacttgacggtgttccataggtctgttaggcgttgtttacttttctttattttttctttctattccaagacttgataatttcagtgtcctatcttccagttttctgattctctcttcttcctgctcaaatctattgttgtgctcctctagtgaatttttcatttcagttattcttttcaactccagaatttttattcttctttgtaatttttgtctctgttgatattctgattttgttaatcattgtttttctgatttcctttacttatttgttcatcttttcctttagctctttgagtatatttaatacagttgttttaatgtctttgttgagtaaatccaatgtcttggctttctca

SEQ ID NO: 235174 - DNA, 822 bp, Homo sapiens
gccactttctaagtccttgacccaatgaaatggatattgtcatcataccttttttgaggacaaagagagtgggacagaagtaatttgcccaagaaagtaggaaaaagaatgccctggagtttagtgtttggggcctttgccaggtggcagaaataacagaagtaggtactgttggtggagagccagtacctttacataaagcgttgtaatacacaggttagcccagcagggcattcccatgacctcagatgtttatcaggtgaagccagtggctctcagatttcagcgtgtatcagaatcactcgaaggctgcttacaacgcccagggctgggacccacctctgccagagtttctgaggcaaagagcttggggcaggtggcagtgggcagttgacatgtctaatgtgttcctggatactgtcatgctgctggtctggggaccactctttgccaaccactgccatcagcagtgcccatgtcagcgaggagccagctgctactacttctagttacagtcaggtgggatgatttcagatttagacattggaagtgccttccgcctcatgaaataaaaactgaactcatgtggtcctgtttatctaggacagcagaggggtgtctgagccagtccagagcagaaacttgcttttcctgctcaccagtggttctggcatggctcaggagagatgatcccaaggtggagagaaaacttggaaatataagtcagcactcattagaagcttggagtgccatcattacatcccatcttaggaagatggcctcatttatttttgttatttttcattcccccttccattggca

SEQ ID NO: 235175 - DNA, 369 bp, Homo sapiens
ccttcactccccacccggctcctttgtgaagtacttctaagacactcgtgccggtttcccagttaatcaacacccacatgctagccatcccacctccccagggccccgaggtcttgcagattaaaacgcacttgcttctgggttccaggggatgtcagtgggtggactgcagtggactgctgggtgtagtgctctgggaagccagaggtccaacctggcattatcagcaactggtggttaaggggccatattctgtttctgagctttctgtaaaacgggataataatctcttctcctcggcaggtgcactgtgaggattaaataggatcatgtaagtaaaaatccaaaaacagcagaatgttattttga

SEQ ID NO: 235176 - DNA, 933 bp, Homo sapiens
tgtttcaaatttgattcatatattgcttatcagtaacataagtaattcttatttttttcatttctactcacttttgtgaaatgaaaaggacaaaatatgatgaaacattcaaataatttcatatacattactatgttgagagagatagaagcactgctgaaactgaaatacatattggcagactagcagcaccaacctaccacatttaaaaatattattttaccatgtgaatgttcacattaaatataataaagataatttaggaatatcaatgtcatgcctagtcaagtatatgaaagccatataatctcattgatgctttatttctcatatctttgattgctagcaatggtgagcccatttccataagtgttttggccactgaggttctttgtgaattttcaattcatgtattttgtctgtattatgttggaatgtgcataatttgtttattgagttataaatgctacttacatattcagaatataaaaaccattatagttgatgtgaataaaaatacctagttggctaaatgtctttaggttttatgttgttttttttataatggatctgcagacatttttaattttcatgtatatattcaaatatcttgatatgatttggctctgtgtccccgcccaaatctcatgtcaaattgttagacctggtggaaagtgattggatcatggggatggtttctaatgacttagcatcatccccttaatgctgtctcatgatagaattctcgcaagatctggttgtttaaaagcgtgcggcacctccccttctcgctctcttcatcttgctccagtcatgtaagatgcacctgcttcctttttgccttctgccatgattgtaagtctcctgaggcttccccagtcatgcttcttgtacacctcatggaaccgtgagccaattaaacctcttttcttt

SEQ ID NO: 235177 - DNA, 589 bp, Homo sapiens
ccagcctacagcttattttctacctatgtttaacaggaagcttgataacacaagcaaatgtgatgccattctgggactgaaatgtcgtcttatgagtgtattcagatgaggtataccagtgtttaaagattagttggaagttattctcctagtgtgcatatttaatttctacttactccatttccctttaatgagaaaagaatcatattgtctgaattttcctgtataaagtttaaaaaagttaattattaggacttgtttttaaaggagtaagcaatggaaggatcaaacatttattaaatatattcagcaaatatttagaattaaatgtattcagcaaggaagagaatgggattcatactgcttggagtttataaaagcggagtttttttattttttgagacggaatactctgtcacccaggctgcagtgcagtggcacaatctcggctcactgcagcctctgcctcccaggatcctttccgggttcaagcaattcttgtccctcagcctcgtaagtaggtgggattacaagcttgagccaccacagccaactaatttttgtgtttttagtagaaatgagttttcac

SEQ ID NO: 235178 - DNA, 349 bp, Homo sapiens
attccagtggtattttgtatattttcttctggtttcatatgtgtgtgtatatacacacatatatataaatatatacattaacggccaggcgtggtggctcacgcctgtaattccagcactttgggaggccgaggctggcggatcactgagattgggagttcaagaccagcctgatcaacatggagaaaccctgtctctactaaaaatacaaaattagccgggcatgaaatcccagctacttggaaggctgaggcaggagaatcgcttgaacctgggaggcagaggttgcggtgagccgagatcgtgccattacactctgggctgggcaacaagagcaaaactccatctc

SEQ ID NO: 235179 - DNA, 534 bp, Homo sapiens
ttttttaatgccagtaccatgatgttttggttactataggctttgtagtgtaatttgaagtcacataatgtgatccttccagttttgttctttttgcttaggtcctttttcttttcttttcttttctttttttttttttgagacggtctctctctgttgcccagtctagaaagcagtggacagctcactgtaaccttaaattcctggcctcaagtgatactcctatctcgacctcttgaatagctgggactacagggatgcaaccaccatgcctggctaatttttatttatttttttgttgagatggggtctcgctatgttgcctaggctagtagaaacttcttataaggatgtggacactacttcttcaaaacataacagatttccctaatcaatatatttcattgaccatattatcttttgccttcacagcaaacaaaaacttctctttgtgccttcagtgttgacttaaaaaaaaagtttaatgcttacctgaatcaaagtgatctttctccaggatatccagaggttctg

SEQ ID NO: 235180 - DNA, 513 bp, Homo sapiens
cccgagtagctgggattacaggcacctgccaccacacccagttaatttttgtatttttagtagaggcggggtttctccatgtcggccaggctggtttcgaactcctgacctcaggtgatctgcccaccttggcctcccaaaatgctgggattacaggcgtgagccaccagggctggcctaaaatttaaaaatgagttcaaactaccagattaatatattcaaagagtgaaaataaaacacaaaataaatatttataataatacatttattcacaccttagaatgggggtataaaacatgggagagaggtattgtcctttaacctacaagttgaagaaagtctaggcttatctctgcttgcattaattttcattaaggaaagactccatactgaatgaatgaatgcttttcacaacaaagggaggtatggatgtattcccaaaggaatattccttgtgtgtgtgtgtttgtgtgtgtgcgcgtgtgcgtttcaataaagtttgtcccctttcca

SEQ ID NO: 235181 - DNA, 1732 bp, Homo sapiens
  misc_feature (740)..(741): n is a, c, g, or t
  misc_feature (786)..(786): n is a, c, g, or t
  misc_feature (841)..(841): n is a, c, g, or t
ataggcgaccctaatgggttttgtgagatgtcgtattaagtctgtggtccatagagtaatgcccttcgctgtcagggaatgcaagggaagagcagggaattccagaatgggaaggtgtgtgaatgtagaccttcaggttggtcacaaacagtgtctcgagattccactggggaagcgttcacttttagaatcaggccaagctgagggttctctgtcctcaggtattttcctttgtagcagtcactggctcgaaatggagaatgagagaaaaaggagcttgtttcaggccagagacctcactaaccgaataacaacactaaggccctgcagcagggggcacaaactacccagcctgtttccgtgtggcctatgatggtttttttgtttgtttgtttacattttttaatggttggaaaaaatcaaaagaggcatatctacctatttcataacatgataattataggaaattcaaatgtgggtgactataaagctttattggaacacaggcacgcccattcgttcctgtattgtctatcactgcttttgtgctgcgatgacagaggctgcatgtggcctgcaaagccccaaatttttatcatccagccctttacagaaagagtttgctggtccctctcataaagtatccttttttttaaatgtgacagagtctagctctgttgcccaggctggagtgcagtggcgcgatctcggcttactgaaacctctgcctcccgggttcnngcgattctcccgcctcagcctcctgagtagctgggatcacaggcncgtgccaccatgcccagctaatttttgtatgtttagtggagacagggtttcaccntgttggtcaggctggtctcgaactcctgaccttgtaatccgcccgcctcggcttcccaaagtgctgggattacaggcgtgagccaccgtgcccggcctaaagtatcttttttatcatgatagttcacgcttattcattgatgggctgccttcttaccacatgtccttgacatgttttaattccttaagtcctcatagtaaccctagtacatgtactcctgtgattgccattttactgatagggaaacacaggcagagtctcatgtaatctgccttctgtcacccagccagaaaagggcagaactaggatgcaagcacagggagtctgaagccagggtacccattcttgagcaccctgtcacgctacctctcattatcaggttctgcaatactttatccttggagcaagcaaggtgaggtgcctacattttcccatgcaagtgccccaatctgtccctgagaattaaggcccagagagaatgatgctttctcagaccctcaggaacattccttcctgatttgccagtaagtggcagagctgggaccaagacccaggtggctctaatctcatcttcattctcctcattctccaagatggtggccctccctcttgtgccagggactcccagatgcccactcttgggcacagcaaagaacccagatgctcaggcctcatggattccaaggccccagcaagtgacatccctattagccggggagaaggccctggctattgttctgtttgctttcctttgtgatgtattgttacataggaaatttatttcttaacaatttcacttacagcccttaaaacaaaatggggctctggagaactgcatcattagcattgataaacattttacaataccatcatgagcaaatggaagtgtct

SEQ ID NO: 235182 - DNA, 376 bp, Homo sapiens
gcaaaagagacaatgtgatgattgatcttttgcatgtttgcatatttaggacttttagatgattggctcctttaactctcaattcccaggaaatcatcttgccttatgcatgaaattgcaaataggtttgttttgtaatgcagctttggctagaccccatgtttttcactacttatggaaatctgcctggccttgggttggtacagttgatgtcagtattagaaagcacatccttagcactgaaacaaccggacaagtggttgatgagaaatgtctcacttctgtcaatttacagttattgaccactcggttttgtttttttaaaggtgtagataagcttatttttagtgtttacatctattcttttgggtctgat

SEQ ID NO: 235183 - DNA, 374 bp, Homo sapiens
aggtgtgtaggctcgaaaatgtggtcccaaggaaagtcatattcaacaacatacctaagagcctttgttgttagttatccctgaatgtgtctcactgtggatccatcccagaaatgactgatcttgtttacgaatgtgaagggattgtgacatgtggctgggttgggcgcagctgggtgagtttaacagtgagcagtgcaaggagcagctgtagagcttccaagcaaaatgctccaaggtcttcctctccctctctctctctcttcctctctctctctctctctctctctctactaagctgaaatctgaccctccctcacatacagacagtgagttttaggagaagcatcaaggccttaagtcagaaagctggg

SEQ ID NO: 235184 - DNA, 494 bp, Homo sapiens
aaacttttagctccatgggaactccagggaacttttagcttctctgtttgtgaaccaggagaatattatctggatgatcgccttcgtgtttcttctaatttttttttgttttagacttaaatagtgtgttcactttagctcaatcaattcaagcctgacagcttcaaaccgctttatttcagatgaagatgcatggctaagctaattatattttctcttcttcatcaacagttttctatacttatacagtgactttataaattcatcattattccatcccaaaacaaatatgaatactcttgttatggtaatgccactgcgggatatgaaagggcagtcctctaccagctcgtttttttcctagtatgtacccatagttgcttttctttgacatagtcagtctgttctccttctactccctctagttaaaaaaaaatagctaaaaaatatttaaagattttccatctgttacttgtgggaaagaaatacttaaa

SEQ ID NO: 235185 - DNA, 125 bp, Homo sapiens
cagcacagccatgttccttacagaccttcagatggagatttgcaatgagtgcactaaaagagactccatgtcagatgccaatctctgggccaaatctttgtgggatactttactcatagtaggaa

SEQ ID NO: 235186 - DNA, 2050 bp, Homo sapiens
agtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaagatgaagacacatggaaatgatggcactggaggtggaggaccttgcacgcatactctttgtgaccacagggttgcaggacgttcttgaaagatgtgtcactaaatgtttgtttttgctcatctctttctgaggtcatctgcagagagtgccccatgccttctttaagaagtccctcattaagccgcaggaacaatggaaaactatttaagggaacattgcagaaatatttgatgactgtttcttgtggaagcccaaagtccactctaagagcagaagaaataccaaaatgtttccaaaatttttttaaaagctgagatttccagctttataaccaaagcttgatatatgtcacattgtcacagaagagagaaaagatcattgaggacagttgccttgggagagttcaagtctttgtcgttacacactgctgttttgattattggtcttagttttgatcctgttgcagcaaaatcctgcagcatctttctctccaataatgttgcaactcaccaaaactattcttgaagaggtccaagaacatgtattatccagactaaaaaaatgattttttgttgttatggtttacgtgatgaaaaggagaaaaaacagaatcatacctgggtggagagagggagacaaatagccataaacttcatcctggagaacaagttaccatgcaaggagttgacatcagttgttaagtgaggcccattcttgtttttacatcggtcctttgtggtttttctgggccagcagagattctgcaccccaactcccaggagaaaatgtaatacctgagcaagcacagccttgggtgtgcttggacaagagacccagcggcagagcaccttttacattttggaccgttcatgaatgggcaatgttgtgttgatacgcagccgagttctacgttatgtgctgtgactgtgcagctggacgacccccatccccaggaggcagtttccagacaggagagcaaatgcaactcacagcacctgctcatgaccttggctgataggcatgtgaagtaggatgaagcaggactctttaatgtcaaaaaaactgaagggcagaaaaaaggttccttacatcaaaatgaaagtaattacattaatagaaaacttccaagtggaatattgttcacaggcagctctttctgaccctggctcttgagtcacataaggaaaccacctttgacctctctgacacttttgtctttaagccacgtctctgaaatcttgtgaggggtgaagaaagaggactggagatgaatggacaatatgatcaaagactcatttttaggccttgaagaggccgagctttctcccccaattggtggaggacagtccagagatgagcagaaatcttaaattccttcctgatccagcctccacatgtggcctgccccttgccccagcatctttccagaacccctggacttgccaggtgcctgagcatcttcccaggatatgcctgccagccagcagcccctcaggaatgcttctataatagatcccagtaatgaaagcagcaccatatcctaatctaatgtcagcttcgagaatgaagactgcagtcaggatcaaatcaagtcacagaagccatattcatgcaggtgctaaccgccttttctactggtgcaactgaaaggaatatggtaacatggttggatttttaaaattcacaatgaaggaacgagacaagcaaaacagaaaagctgagaaggaacatgcatgactaaaaaggcttgaagttgcttgtgagcaagaagctttttatgctgctttcttacatagtttctcttcattttcacttaactctgaagacaaccaaaagaacggatcaattaaaaactgattccactta

SEQ ID NO: 235187 - DNA, 1766 bp, Homo sapiens
  misc_feature (340)..(340): n is a, c, g, or t
  misc_feature (1089)..(1089): n is a, c, g, or t
ggtgaacagaaaatcagcctcaaaaaacctccatcctttgccaatttacttaaggaaaactctccatagccaaacactgttgctggtaataaaagctgcaagctgtcactgaattctgctttcttggcagcacatctcgatatactgattgataaagactcagataatcaaatcaagaatgctacaggtggttactcctcagaaaccttgaaaggatttaaattcattctgcttaaagtcatgccatacaggaagccatcagaagttgcctggtaaggatttaagaaaaaaggaattaagtggttatttgggtcataaattttagggcatcaggttatgngtatctgatgtatttatattaataattacagcttaccatgggccagtcactcttttaaatgccacagcaaatttatgaagtaggatatattattatcctcatttgcacatgaggaaactgtgcacaaagacgttaaatggactgccaaaaatcctaaagctagtaagtgccagtaccagtattcaaacctaggcagtctagctcttaaccgctatactatatcttccattgaaatggacagctggttattttgactaaatatcctaagatatgtttggaagggaattaccatcactgacctcttaaatctcctttttctgtacttccaagctgatcaactctttttttgtgaaagactcaaattgttgtgttgtattacatgaatcgatatatgggataattgctaaacattatagacctgagagtcattctatctcttttagaaatctttttctttattccataatggataatgacaaattcaaaagctttaggaagtaggcagataacataagtgagggagatggcttggtataagtcaatttgaaatggcgagaactgtggcaaaccactactcactcgtcacttggctccagctgctctgtgcaaatgtggatccaatgttatcagatattttaaggccaggaatggtggcttatgcctataatcccagcactttgggaggccaaggtgggaggattgcttgagcctaggagtttgagacctgcctgggcaacacagtgagaccntgtctctaccaaaaaaaaaaaaacattagcgacatgtggtggcatgtgcctgtagttccagctacttgggagggtgaagtgggaagattgcttgagttcaggaggtcaaggctgcagtgagctatggttgtgccacagcactccagcctgggtgacaaagcaagactctgtctcaaaaaaaaaaaaaaaaaagatatttgaaattttaccttaagggtaagttattacctctgcaaatagctcatttcttcatcgtctgttttactctattcagtttcagagagagaccacagtcttgactttattttcaagttctgtgaatccattatttttagagcttttacctctttacagtctccatgtatatattcaataatgtaaaatatgttaacagttcattgtttggactgtgtcctttttacagacaattgactatataaaaggctgaagggcttttccagtatatccctagtactacaaagtacgttttggagtcagacaaatctgagtttgaattctgtttctgagacattaacttgtaatttcagcaagatgttttttcttcatctgtacaatagggttacttatacctcctaattagatgaggattaaatatatataaatacactgatcatagcagctgtcatatgcaaattctgcagcaaacaaaaaaaaag

SEQ ID NO: 235188 - DNA, 153 bp, Homo sapiens
aaaataaaagatgcctgctttgttcagattcagaaagcttaacctgtataacaacctattcttacaacccaccctttctctgcataaaacctgttaccaatgtggttaccacactataaatcacctccctgttcaaatcagctacttgcatca

SEQ ID NO: 235189 - DNA, 1798 bp, Homo sapiens
caggctttgcctgtaagagggctggtctggggggacatctgaacccaattcaggaacacctcacaggtctgccagcagggctagacccggggtgagatccagggcaacagggtctgcctgggaagctcagctccggcactgcctggggcgtctctgcctacacaggaccattcctctcgcctggactcctcttggagtttgccaaggctggcctctgcagaaataggagactcctggaggaagacagtggacttcagcaagctgcaccaaggagaatccacagcggcagctgccctgccaggcgcgggatctcggtcaaggtggatcaacacagcctcaggtgtgtgctctgccccactgagatggcaagtgcattcttttctattcctacgaggaaagagcatccgaaagagcctgccttcacataggatgaataacagtggaccttggctttgcctcagtgttatgtgctaataaaccatgtattctatgccctaaggaagcccagagagaactggacaagctggatatcccaaagagcatggcactggcccaccacattgattacattgcgctggccgggtgctaaccaagaagcagctaacacactgggagtcttggtaagatgcctgagtgcctgcagctggcagacaaatcctacaaagattctgggaactgccactaataacactcttggtggggaggtcccatatcccataaccaggagcatactgggcctcctgtccacagcaaagagccaattactgcatcttgcatctcccatgaccaagagagacagacaatgccagtacgccttctggaggcagcacgttccacacacatgaagactactccagcctatgtaccattgataggagaagctgtcggccttccctgagcctgcagcaggtcgaggctgcagtgctggcagccctgtgactcaggccctgcagctggtcggaccctgtgttatgagaggtatcagacgtgggaaagcaatgctgtgtgtttatggcaagccactatgccagaatcacagtgcaggcccctgggattcagaaacaaagccgtgccatctgcggcagaggattctgcgaaaaattctgaaaagtccctgttgatgtgctcctggggcctggggtgatggaatacctgattgtgcatgtggaactgctcagatgagctggattctgtctcacccctgggtcatgaggttggggactcagaaataacccatcacaggtgggagtgtgcgtgtggcagcagcagaagcaggagcaggaggccaagcagcggcagctgcccagtacccccccccaccctccacagcagtccccacagccccagtggaggaaccttctggtgaactgaggagggagggacaagcccggcctcagttcatggaggtgtctgctctgcctgtggggccagcccaaatcgcctggctgccatactccagtctcagcaagctgccctttaaagagggtgatatggtttggctctgtgtccccacccaaatctcatcttgaactgtaatccccaggtgatgagggtgagacctgatgggaagtgattggatcatgggggctgttttccccatgctgttctcgtgatggtgaaggagttctcatgagatctgatggttttataagtgtctggcaattcccctgcttgcacttgtctttctcgcccaccaccacgtaagacgtgcctgcttccccttctgccatgattgtaagtttcctgaggcgtccccagccatgcagaactgtgagtcaatgaaacctcttttctttat

SEQ ID NO: 235190 - DNA, 355 bp, Homo sapiens
ttttctccaggcaatatactcaggtcctaaatgaacatctactgatggaacgctggcctttagtcagttatctttatatgccgttataggtcaacattccgaaaaacttcaacagactctctaaaggggatgggattattggattggcaatttctcttaatctgagaaaactcatctcccactcccttccccatatcccctttccatcctctctcttccccttatacacacacgcacccgcatgcacacacgtatattctgaccattttattagagtggaaagttgaaaggaagcaacccgccagctacacccacccagcgctcctgggggtggaatagcaaagttctagggcag

SEQ ID NO: 235191 - DNA, 1266 bp, Homo sapiens
gatgtgcatataattttattatttgatttttaatatacatgaatagcatgcagttccaactttgctcgagacttcacaattaccattttaaagggctgcaaaataatcacatttcctcctcaacagccccactttacagatgaaggtagaggaatgctaacttgcctatgctaacccgcagagctctgaatcctccggatagcgcccccgctgtaatccacccagtgcttccctccagacccttctccctctcgtgcgcgcggaggtttcggtttcctcttttacgtaggccgccccactcgcttgaaaacaaagtccgcgatcctctagcccgcaagagagctccgggactcagaccccgggcgcgaggtcccacgagcggcggggcggcgctctcgcggtcctcctccccggcaagggccggggcagggggaggaggcagcgcgaacagtccacgccctccagccgggcgcgctcgacgcggacggcgggccagctgccggagcgcggcgactccaggggacccacagctggggcgccagagcgcggccatccgggcggggccgacggagcgcggcaggacttggctggacggcgcggccacggagaagggcgcggtgagcggactggcaccgcgcggggaacattccggaggccgccgggctcagtcccggtgacccccctggtcggggttcgcgcgccctcccccagcacgcccgggcaaggctgccgcggcgtcggagtaatccccaaccctccgccgccgcttcttccctcacccgggcctccagacgtttgccgcggaaacgaaagtaacgctcgggtgcttgcgtggaggccggggcggccgcgggcttcccggaaggagagggactctgcccggggtgcgcgcggcgggcgggccccgccggtaccggaagtcgggcggtgggcggggccgcgggcgctcccggaagtcaggggtgctccgctaggtgtctctgcttatccggagtccgctggccgcctctgtgccagaggtcggggcgctggactggtagcgggcggagacctgcctttgggccgcggttaccgcgtgagggtggaataggcagtcccacacgccattaatgttgttttggtggagaaggtgggctcctagtgccctatcattaagaaaaaacagtttgggctcttcccttaccagccctttgaaagggccttttactgttgcgcttgaggccgcagcaggttccaaaaacaaaagcatttctgcgtgatcttaga

SEQ ID NO: 235192 - DNA, 759 bp, Homo sapiens
gataataaagaagagtcagaaaagcaaagtgaattagctagccaataaatgtgtaacactctctaagactacatttgcaagcccatgtttctgcctagttttgttgggtttcacaaaaaatatgggtacttccaaagaattttacagtcgactggggaagaaaaggctaatgtgcaagaaacaattagagaactctatgtgacagatggtatataattagaggtgaagtggtgcagtgccaggggagttatgagaggagagagattctgctctgtgaagttttgatttggcttgggtggaactagtttagggaggggagaaggcgctggagaaaccaagtagaattatcatttctgttgggagccttgagggcccagcattgaatcccatgacagtggatattgtgcccaaacataagtatccaatagctctctgtcttatagtacagtggtgaagagccctgaccctggaccctgggtttggatctcagcctcatcgtgtagaagctgtgggaccttaggcaggttatgcaaaccttctgcacctcagtttccccaactctctggtaggtgtcataacagcagccatcttacagggttattgtggggactatattaacatttataaggtactgaatgcctggcatggtaaccacaacataaatgttagctgttattatgacaacttttgttaatattcatcaccttcctcctgtacctctcttgaggtgtgtgaggctttatgccccagaattggatg

SEQ ID NO: 235193 - DNA, 469 bp, Homo sapiens
gagcgtttggttttcgattgttttaaagacaaagtgatccatattgcctgtctacatggttggattaatccgatagttgccctcctgggggcagacctccacgggaagtttgtgtgatgggataatttaatgtcatctaagtcccctggaggggcggttcccctaactactcacccaggagaaagccagccaacacctacctgctcgttcccgcctcgggatggcccacctatcgccccttggcaggaaagcccccgcctcgaagggcgtttcgggggctcagagccgagctaagctgcaagagggggccatggggaatgcgggaagtgaatctttaactttggtgcccggcttcaaaagactcagggcttcttgtgttcaggcagaggtaaatggagattcaaactgtcgtcttgcattaacaatccggaataaaaataaaattcgtaaagggatagatgatcggaaa

SEQ ID NO: 235194 - DNA, 333 bp, Homo sapiens
tttcaagtagaggatttgtcagcacagtccctccaattcagccccgtccttagtagaaaaatttctgctcgttcccgcctcgggatggcccacctatcgccccttggcaggaaagcccccgcctcgaagggcgtttcgggggctcagagccgagctaagctgcaagagggggccatggggaatgcgggaagtgaatctttaactttggtgcccggcttcaaaagactcagggcttcttgtgttcaggcagaggtaaatggagattcaaactgtcgtcttgcattaacaatccggaataaaaataaaattcgtaaagggatagatgatcggaaa

SEQ ID NO: 235195 - DNA, 521 bp, Homo sapiens
ggaaccagagtaagacagtttctacttggacttggggaaccagcaaactcattcacttacaatcaagaacaaaccgattaaattgaataaaggtcactcaaaggagccaagcccctttgtcaaatcaggagctccatcagccaatcaggaacccagatgccagcgtgggagtttgtcagtggaaataacattgcatgacttccaagtctggtttcttcatttgcaagatatcaacccaataggattgtgactgaaatcaaatgaggcacccaagtctaatatgagaaaaacatgagaaaaattccaggagggggacattctacaaaatacctgaccagtacatctcaaaattgtcacgatcatcaacaaggaaagattgagatactgtcatagccaagagacgccaaaggaaaaatgacaactaaatgtaatgtggtatcctggataagatcctggaatggaatagaaaatgggcattgggtagaaactgaataaagtagagactttagttaataacagta

SEQ ID NO: 235196 - DNA, 1895 bp, Homo sapiens
  misc_feature (1341)..(1341): n is a, c, g, or t
  misc_feature (1355)..(1356): n is a, c, g, or t
ctttatcaaggaaattagcacaccagtctgacagaagagtagattgtgtttgtgcttacccttcttctcctaaaattaagtgttagctttcaaacttgcttttgaagtgctaagaaccctgatgataaatgatgaacaaagcctcctgtttacattggaagcatcaaaacagcaggactgggccaattcacccattcctgttgatcattagacattaactggttgtccaacttcaaccacatcaactacaaaatcctgaagtgaaacaaagtctaagttagttgacttttctttgattagtctctagtgcatttatcactttctatgaaagaagcatctaatttagatggcagttgatttgtgtcatgggatttcttctgacaggaggcagagttatgtatgtgtttatggcttctttgcctttaaaagattaatgttgggcaaatataaatcacaagacctggatagggggctgggaagatggagcaggagcttgccagggtgatggattgagacgtattttagaggattttcattgctagaaaaaacactgggaagatgtggcagaggggtggtggggcagggacagtgaagagagatggctttttctccctaagcacagagaaaggacaggatgggcacttgagccagggcaggtggctttctggctctgtttcagaagcaaaatgaaattgaattggtaacttcctgaagcttctttcctgccctgatacccagaagacaggattggaggacaaaggagggttcacagcacagctggaagtgctcaaggtacccagctgctccaggagataaagtactccctgcctgccccagtcacaggaactggcccctgaagccaggctgccacaccctatcttcccatagaccaagtctaggcttctgtcccctgaggctgtgtgtgtgtgtcagtgtgtgtgcatgtttgtgtgtgcacctgtctgtgcatatgtggaaaagtgtgagaggaatgtgcatgagagtgtgtgtgtgcatgtgtgcctgtgtgtgcatatgtgggagagtgtgtgtaagagtatatgtgtataagtgtgtgagtgcatgtgagagtgtgtgagtgtgttagagtgtgtgagtgtgtgtgagaatgtgtgtgatagtgtgtaagaatgtgtgtgtgagtctgtgtgtatgtgagtgtgtgtatgtgagtgtatgtgtgtgagtgtgtgagtgtgtatgttcatccttaaatatatgaggacaataagaatagctcccatgtgccgggcaacaccccgagagccacactcagtgctgctttgtatgtgttgcctgccgtaatccttcgctagggangagcacacgagggnncgggaggggtgcttggagttgggacccagagcaccaggacttactgtcaaatctctctggcaccaaaacgcatgctccctatgccacctatcaggatgcacccttaaagcacttttaagatgctttttggaaagagccatttgttggtgtgcatttgtcttcaccactgccccaaacatagctgtccaatattcaggtgaaaatgtcccccatcggccgggtgcagcggctcacgcctgtaatcccagcactttgggaggccaaggtgggcggatcacgaggtcaggagatcaagaccatcctggctaacacggtgaaaccccttctctactaaaaatacaaaaaattagccggccctggtggcacgcacctgtaatcccagctactcaggaggctgaggcaggagaatcacttgaacccaggaggcggagcttgcagtgagccgagatggcaccactgcactccagcctgggccacagaccaagactccatctcaaaaaaaggaaaggaaaggaaagaggaaagaaagaaaagaaaag

SEQ ID NO: 235197 - DNA, 1957 bp, Homo sapiens
  misc_feature (811)..(812): n is a, c, g, or t
  misc_feature (952)..(952): n is a, c, g, or t
tcactagaatgtaaaaatcacaaaaggaagttgtttgttttgttcacttgtgtatctctaataactagaacaatgctcagtatatgctggattgttagatgaatggacaggactttaaataagtgcttctttagctatgatgaatgactagtttttaattacgaatctgtcacaacctagtacttttgtaaaatgcggtggaaatagtatatatgtatttattagtgtcatgttattaaaatcaacaggcattaaattgtcagattgctataaaaacttctaaatgttttcaattttttgctcataatgaccttctaataaacttgttgtggtcagcacccatttgcagacgacactatcagtaccactgtactagaacatatttaccattttatagtcagcagttaaaatgtgaaagctaaatgaaggacgtattcttctccttgctagacaagaagaagccacttaagagctgatgtcacattatgatggctgaattcctgcaggattattaacttacaaaaaggtttttttagtaataccaggaaaatttgataagtaccaattctatgcagagataagtctttttcagtggactcaattaaaacatcataatcctcattttatgtctgtcatttaatttgaggtttgtttttaatagctgtttatgtgttattcaatgaagtctcagttttacaggtttaaaaatattttatctcagtaaacactgctgtattatacctaatatgtttccgaagatatattgatcatttttaacatgtcttgtctgttttagtatgttgattacttnnctgtttatgtatctgggatggaaggagagtcattaaataatgacatttggagtttgggatctgggttcacaagaagatatacagctgaaagtaaaagctatgaagtttttaaaaagccgtgcctcagtttccactggtgnattgcaaccagggttggtgttaattttaatgcttttcagctcctggatattcaagtcattttgcgttaggtatgtagaggtagatactgaattaagctcctttgggtgtcacttcatatgctcataacaaacactgataaactagtattatcagcttgagtagttggaatgctccagattcctcttgtctttgagctgttctctttccttatacagtttaattttacaaattattttaaactttcatagtgtagtccaatatactactactggcaacacacaaaactcaaaatcactgtcttatattttgaaacacaagaatatttctcagtttactgtttgagacactaccacagggaaagaaacattttcatttaattcatttctaatgcaaaaatcctgaaaaatccatttctggtcactaatttaaataaatttgtttttcaggatttttgcattataattttgcattgtaatggtcactaacttaaacacgtttgttttttcaggatgtttacatttgtttttcaggttttttaccttatattttggtttaaggacagcagcaattatttaataacatagaactgatcaaaatgtagatagagtttccgaataacaaattgagtatacgtgtagatagaaatacagatacagcatacatacatactatatgtatttagaaaacacatatgtttacatatgtaattaagaaaaaataggccgggtgcggtggctcatgcctgtaatcccagcactttgggaggccaaggtgggcggatcacctgagatcgggagttcaaaacccgcctggccaacatggtgaaaccctgtctctactaaaaaatacagtaattagctgggcgtggtggtgcatgtctgtaatcccagctactccggaggctgaggcaggagaatcacttgaacctgggaggtggaggttgcagtaagccaagattgcgccattgcactccagcctgggcaacaagagcgaaactccaactc

SEQ ID NO: 235198 - DNA, 425 bp, Homo sapiens
ctcagacccagagggtttggagcctggggtattgtcaccgacagtggccttagcctagctagcacagttagtgctgtgcatcacagcatagcttttagaggcaggatttgtagtcagtatagttgggaggcaccatggagcagggatcaccctccacctcacttgacaaggagatacaaaactatcagttcatagacaccatctgatagggaactggctcagcataggccaactgggacccaggttgccatcttgaagactttccatcacccaaatatcattcagctcttccaggtggtgagggagtaaaccagaggaggagagttgcaccaccagatataccactatggccacatcgaggaggaagaggaggcccggaccatgttcaggcagattctgtcagccctgcagtactgccacttaaa

SEQ ID NO: 235199 - DNA, 793 bp, Homo sapiens
ctttaagaactccaggagatcagaaagcaatacgaaagccagagcattgcacatgggatgggctggcgggtggcctttgggtccctatcttatggacgatttttgtaaatggggcattggagatgagtatcacctggatcacatttttaggttgaattcctccgtggggggaactttagcaatacgcatccaaataagaatgtagattgcaataattgtagtaaagtgtttgccagactcatctcagaaaaagacattatcaaaaggcatttattatcttcctaatgcgtgtctggcactgggcagacactgtagaatactatcttgattagagtctcaaggattttgtacttaaagtcctttacaaataaaagtattcaagtataatctattataaagactcttttctccactttggggatatacggtgtggcatcgattcattggtcataccaaaactgttacttctgttttggaggaattaacaaggaaaacccaggcttagtaaatcaacatcgaagttcagaagttcagagtaatttgtcttgggaacaaagtcctccctagagcgaagaggcattcacaggagctcttggtgttaatgggattattcaagatatacctgagaccagataaatatttgatgattttgccaagcactagggtttctttgcagtttgtctttggctgacgttttccccccgtggggtttggactttgtggcttcaccagattttgcaaatgaaagaaggctggggtttcccaagagtacacttgtgcaggaaacaacaga

SEQ ID NO: 235200 - DNA, 699 bp, Homo sapiens
cagtgttgactgccagagtatgtagagtgactatttgtaatttgtatattcaatatgtatatttcttcagtataaaattctgctatccaagtgttaagttttagtggctagaagaaataatgatatgttatggtggaagtgtggagctgtctgaaccatatgaaagccaggaatctatagtttgagacataccgggtaaacagttggtcactttcagcatcaagcagaaaaaggctaaccactcaagtacagcacagtttacaagcagtatgatgatgaacgttagttgatgacctgtataggtgattggtaccaccaaagtgcctgtcttagagaatgaaatctggacagaggatgtattcaacaatcctactagtgaggtaagtggcttgtggcaggatcagtactgggttcaggtacatgatcctctccctgaaggaggtaaagtatgacgggaactaaaaaaaaaaaaaacgaaaagtcacatgttagagcttgaacaaaggtcatgtccagggatgaatctctaaggatggatttgtttgaggtcatgtaggtgttgtcacagtcattggtagggaagaactttggggaagagttagatgggttactatgataatcagagctgtcattcactgatgattatgctttgttatatgttttttatatgctagtatgttttatcttcttcttaaaaaa

SEQ ID NO: 235201 - DNA, 2206 bp, Homo sapiens
ttcggcccatcctctctgcattcatgggcatgtgcttgtgtgtgtgcacaggcgtgtcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttcttttatgtaatgagtatcaagataatcctttttgcaaagtggtgaccctatggtagagtttggatctggggattgcagaatgtcactgggtgcattgaagctgaaggcgtgcatttctctgagtaatgagaagcacccttgagtcaccaaggcactggcatatcaaaaagcggtgccgctgtccatatcttgacgattgtagacacagttgtagctgtagagagatgatgggattccgtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttggttacaggatgggttgctacaggattcactgtgggatgagggagaggcagctggacatgatgtgaaccatgctctcgaagcctccggagatcaggtctgcgttgggagagacaggcacccctgccctggtagcaccgcacccctgcgaacgtcctagcaagcaggcaaagaaccagcccagggtcttgccactgggaaggctttcaagcccaaaatgccccagtaactgctgttgtggcacctgcccctgggatgcccttgttcacaggtctgccattgctgtccttgttctctacatggccccttttgttactttcacaatacacacattttttaagtacctatttgcttaggccctatgaggctggagggtgttgtgaggatagatggctctctaggtgttcacagactagcagcagagagagataaggagcatgatgatggaggttcagggcagtgctgctagagtagagcgagtgcttagtgttgtcgctccgctgctttaccaggagggaggcaccgaggtcagctggctggggtctgggctgggtgcaggggtcaggcagttcagagaggaggaagtgctgcctgagccacactacattgaggagcatgccagtcccgtgttggggtggctttagggcctgggcctccagacattcaaaggcatggaccaggggaactgcgagcaggttagaggcgtgtatggggaatgtggctgaagatgaccctggaacggtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctctggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcaggctgctctgctgtggtctgaatctccctgcaactttgtgatgacctcctttggcctgttctgttcagggctttttattaatgacttggccgagatctttgagagtgtgctgatctcatttggggatgctgggaagacagaatcattatccaaaaagatcgaaatggacgagcaggatatgagaagggcattatatcgtttcagacttacagggaagaggtgtggacatcgatgagctgccaaccaaacaaaaaacacaggagagaaaaacc

SEQ ID NO: 235202 - DNA, 432 bp, Homo sapiens
ttcggcccatcctctctgcattcatgggcatgtgcttgtgtgtgtgcacaggcgtgtcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttcttttatgtaactattatctcaatattactgaaagctgcctttgtctcgtgtgaaaaagtacgactatacaattaggct

SEQ ID NO: 235203 - DNA, 475 bp, Homo sapiens
tctaaaatgaaatggtgtaattcattcagaaggtgccacctctgatgaacaaaatgtcagtcctagatgtttaattacaggcccaagcctgtagttgcctaattttccttggcactgataactccttgggtaatcaagtccaaatgacccttagcttttcaagacaacataattatgtcttaattactataatatattttttccctcaaactaatgggacaggacctggatatgtagggtattaagtagttacttacgaacattttaagatgctagatgatacagaaatgatttattgatccaaaatacttaaggggtaaatgtcaaacagatttagagtgtggattatttcaacgtgaactaaagtgatggtaatttgtacatcacactatttgtttgaaaatgctgtatttgaaaatcaagaacgttgtttcaaatcaaactcagttctggcaaactattaaaacacatacac

SEQ ID NO: 235204 - DNA, 533 bp, Homo sapiens
gcctcccaaagtgctgggatcacaggtgtgagccaccgtgcccggccccattttccgcatttctaagtgtgctgggaaggaaagggaggtggagggggctcccagcctgctccaagagcatatgctactgtcaacagctcaaaggtcatggcttgtacttcctggcaacacagggtacatttgtccttgagatctaagctgggaggctgtccacagtttgttcattttgactctgactggggtccagccccagggagttggaaagtaaaactctcaaggcgtgacatttaaatgcttggaatgctgccagccatctgtgcagcttgatttaactttggtgctattatcaatgtcattaataaagacccattccaccagggaagcagtgtggtggtgaacagcctgagctgggtttgaattcagccccaccacttaccagttgggtgatcctaaccagtcaattgacaacagtgatatctcctccctaatttgttcctttttgtttcttggagatggagtctcactctgttgcc

SEQ ID NO: 235205 - DNA, 204 bp, Homo sapiens
ctcatcatagatgtaaaattttagttaagcaagatgaataagctttagagatcttctgtacctcattatactctcttttgtcccactgaacctgcagccggaatcaccccaaacacagtggcaggggagtttccacaagagagttccccaaactgtcccaagatggggccggttgggattccaaaaagagaactaagtccacag

SEQ ID NO: 235206 - DNA, 351 bp, Homo sapiens
agtatccgccctgagctaggtaaaagtggcggtcaccttcccttcttgaggggtacctcacttctccagatctttctgaaaggcaggctcttcgaagcccctgggagggttttccttccacaggtgggcttagtgacccagcagggcctggagcttatgtgggaagcaaaagacctctttcctcctcccagtagaagggaaggcaaaataggaaacacactcctcgagtatctttcctcattgttaatcaggtgactgctcccagggatctgtttgctgtaaatgctgtgtgttgatggtgttgttctaatatagtcacccacgtgcaagtacatcccagtaaaaaaaaaa

SEQ ID NO: 235207 - DNA, 508 bp, Homo sapiens
tcatgatcatcaaaaacagacaacccaaatgttcttgagctggtcagtggataaacatactgtggtacatgcacagtggaatactactcagaaataaaaagaaaatgaagcatgatacacttaacaatgccaatgaatctccactgcattatgctgggtaaaagaagctggactcaaaaggctatatgatttcgttttaatgacattctggaaatggcaaaactgatagagctggagagcagatcagtgcttgccaggggtttggggcgggaggagcgtttgaccacaaagggatcacatgagggaatgtttttagggtgatacaggtgatacagtttgttctgtatcttgattgtgagactgatttgaaaaactatgcttttgttagacttataactgtacaacaaacatgtaaattttaccatatgtaaattttaaaatttaaaaacagtcttaggaaatcaaggtatggtatattaaatactaaaatacagtggattgttaagga

SEQ ID NO: 235208 - DNA, 450 bp, Homo sapiens
cctttgcccaggatgatgtttacacatagcaggtgctcaataaatatatgtgactgattgtgaaagtcatcattatctattaaatattactatcataagggcaaaatctatagggagaaaaatcagtgcatctatttatcgttctttttgttcaatgaaaatgtacttagaggttgggcgtggtggctcacgcctgtaatcccagcactttgggagaccaaggcaggcggatcacaaggtcaagagatcgagaccatcctggccaaaatggtgaaaccctgtctgtgctgaaaatacaaaaaacttagctgggtatggtggtgtgcacctgtagtcccagctacttggtagcctgaggcagaagaattgcttgaatctgggaggcagaggttgcagtgagccgagatggtggccactgccagcctggtgacagggactctgtctcgaaaa

SEQ ID NO: 235209 - DNA, 656 bp, Homo sapiens
gtttgccattgataagtataattactcatgtccttgtataatcgtcttccaccagtgagaccactcaggcaggaccatcaaggttcaaatgaggcattgatgattagagctgaggaatgacatgaaacaggttatgaagagtaaccccaaatatgcaggaggaatggggagatggtgcatgggagactgtagtcaaatgactaggttggtatggagagtctaagttatgtattaatatgggacgaggtaggttaaattaagtgatgacagtgaaaacctgcatctcatataattgtcaagcaaagctaccattagttcttgagcaaagatgtctttaacatttttggttaagtttattcttaaatactttattccttttattgttattggggatgggattttgttttaattccttttttggatagtttgctgtttgtgtacagaaacctgactgatattttatatgttgatttttgtatcctgcctcttaactgaattcatttattagtttgaacaggtttttttgcggcacttttagggttttatacatatatgattatgtcatcggcaaacagagataatattacttcttcctttctgatttgaatgccttttgttttctttttcttgtttaatggctctgattaagacttctt

SEQ ID NO: 235210 - DNA, 477 bp, Homo sapiens
ctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagca

SEQ ID NO: 235211 - DNA, 729 bp, Homo sapiens
  misc_feature (399)..(399): n is a, c, g, or t
  misc_feature (433)..(433): n is a, c, g, or t
  misc_feature (457)..(457): n is a, c, g, or t
  misc_feature (683)..(683): n is a, c, g, or t
  misc_feature (728)..(728): n is a, c, g, or t
tgatgatgtctgcaactttcaggtgttccaggagaaaatatgtctatgtctatgtctgtgtctgtgtgtctgtgtctgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttntttcttagttttccaggcttaacatttttgattntgttttttaatgtttggaacatanatgaagatttgatacattatttcattatctaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttataccttgactcattccatcatatntcaagaggattcagagtgctagttattttggtagcctgtcacacng

SEQ ID NO: 235212 - DNA, 405 bp, Homo sapiens
gtcgtgttgctagttaatgaaagtcagagtcaggttttgaacgagatctatcttacttcaaatcctattattttcctgctgccacagaatggcatcaggaaacaaggaccatagggccagacagtgctgggttccatcttgactctgctacttcctaacgtcgtagactcaggaaagttatttaacctccgagctttagtttgttccttggaatatcagggctggtataatatatttacagcatcttgtacagtatctggcacagaataggtactcattaaatgatagctgctattattcattcattcattaaacaaaatatttattgaaggcctattatgtgtcaagcagtgtactaggtactatagaaacaggtgttgtgggaggacagacaacaagtaagca

SEQ ID NO: 235213 - DNA, 163 bp, Homo sapiens
tgaactgagttgaatcctctttagttaatgaagtgtcccggtggggattgaggaatcttgtcaacataggctgactttctcacaagccattgtctgttctttggcccattcaactctcctgaaaacacattcactacccctcagaactgcctacgcctcctcc

SEQ ID NO: 235214 - DNA, 1381 bp, Homo sapiens
  misc_feature (435)..(435): n is a, c, g, or t
  misc_feature (975)..(975): n is a, c, g, or t
gtgttactgatgtcaaccttaaataacaatatccagataatattgttaccagcggtgagtccagctatctggagaaactccagaatggcaactttgtggcaatttcagttctttgtcttctggaaggaaagatttcaaatgagagacacaggcaaggtttaaagcaggagggagaatttattttaagcaaagcgagaatttattagagagagtacacttgaaggagagccatgtgggtgacttgaaaaatcaagtgtgttgtttgcttcagtcacgccccccacagccatgcctgggcagttgtttaaaggtattttgttcctaactgcctcccccattatcttcatgtacctggaatttgtgatacaatgaacaataatatagccaatccatagcttatgttattttaatgtaaattctttgtaaacaacttangaacagcctcttcctttatctttaaaatcccacttgtaactgctactaattgaagtgtatattcagggcacttgaatctatgctcccactgagctgttcttaagttttgggctcaggtgaactctaaacttagtcatagaatagggtgttagacatgagcagggcaggagagagggcccccaagaatgttgggcagttgtcaagccatggtcaggcaattataaatctgtccccctgaaataatgagcaggagaagggaggaaccccagagctgtctggttctcattaagtaacggacaggcaggcataaaaccgtccctctaagataataagtggccatgactggtgcctggaatgacaggagtcttagaacagacagaagacacctggaattagcaagccataatccccgatagggttttaagcatgtgcagtgaaagggcaagatggtgaaatttaactggtatatgaccttcctctggagcgctggaccagtgagaactgcccctactgagcatgtgcaccacttcaataaacacnctgcacatgcagctctcccaagtgctggcagggccactgcacatgtgatagataaaggcccgcccaggggaagaacaaaaggaggacacagcccaggaaaagatagggggtataaaaactctaaacaggccaggcgcggtggctcacgcctgtaatcccagcactttgggaggccaaggcgggcggatcacgaggtcaggagatcaagaccatcctggctaacacggtgaaatcctgtctctactaaaaatacaaaaaattagcaaggcatggtggcgggcgcctgtagtcccagctactcggcaggctgaggcaggagaatggcgtgaacctgggaggcgaagcttgcagtaagccgagatagcgccactgtactccagcctgggcaacagagagagactgtctc

SEQ ID NO: 235215 - DNA, 478 bp, Homo sapiens
ctcctttgtcagacttcactttggcaaaatgatccttggtacattggcaatggatggaacaaggaggcatgggcactcttgacacattctccaataggcccctctgcctttaggcagaaccacctgcccattccagccagatggcaacaatcatgttgttgttgttgtttagagaaagggccccactctcttgtccagcctggagtgcagtggcatgatcataggtcactgcagccacaaactcccgggctcaagtgatcctcctgcctcagtcctgctaattcctttatttatttttttttttttttgagacacagcctgggtgacagagcgagactccattgaaaaggaaggaagaaaaaaaagagaagagaagagaaaagaaagagaggagggagggagggagggagggagacagggagggagagagagggagaaaggaaagaaagaaaaagaaagagagagagagagagaaaga

SEQ ID NO: 235216 - DNA, 220 bp, Homo sapiens
gggaatcacttagacagcatttaataatgtattatccgacaatatagataatagaaatatacatacatgctaactttagagaggataaaaatatgtatagatacactagaacatgtttcttaaacactatactcaatagtcttggctcctacttttacaatacctcgcatccattcttattcattttctcgactttctattttcctaattttagttcgca

SEQ ID NO: 235217 - DNA, 415 bp, Homo sapiens
agagtgctcgccgcccttggtcccccgggtctgggcggtgctgttggtaaggactgcagccaacccccagggacctggcaggagaagatacctgccctgcccttctgctagggccaccagcatcggccagacctaaccaaagacgtggagtctccaggcagtctataaaaaccagctcccatggcccggggcagggcaaagagtcagtctggaggggagaactgaagacaactggcactgctaccgtgctgagatgcctcggggacttgtcttactcgccgccaagcacttggcccctgcaccaaatggcccccaaactgtggccttttaaaatttgtgtgtccacttctcacagtttcctctctcttcatgcatatgaaaataaaactattttatgtatctaggacttggattc

SEQ ID NO: 235218 - DNA, 367 bp, Homo sapiens
ttaaaataagcttttggtaattgaagaataacatacattcagaaacgtacagaaatcaagtgtaaactcagtgaattgttcacagttgatgcacctgtgtaagcagcaacccagaagccctctaccagtcactgcctcccctgagccaaaagaactactatcctgacttctgaaagcattgattagtttggcctggttttgtttttgctttttttgttttcgtttttgagatagggtgttgctttggagtgcagtgatcatagctcactgcagcctcatcctctcaggctcaagcaatcctcccacctcagcctcctgagtagctgggactataggcatacgtcaccgtgcccggctaatttttttt

SEQ ID NO: 235219 - DNA, 450 bp, Homo sapiens
agcaagtatctagctcccttagagttttttgatggcctcctttgatgctccctgctattcttgggataaaccctaaagtcttgaggtgatctgtggggttccttcttctctgtgccctagctatctttgagcctcagtttttatttgcttcccccttctaccctcaggtttgtcatgctgccttatgggcagggcccctgtgcctgaatccccacctcacctacctcttcctgcttagtgctttctttctctctgatatcaggtctgctacacttttctaaggaaagcagttctgacccttttatgcatgtcaattctccttctgttatatgtcttatttaccacataactcttggaatcattttattatgttgctgttgatttgtgagttacctttttttttttaaaaaaaagagcataacaataaactccataaggtttgagatcaaa

SEQ ID NO: 235220 - DNA, 1820 bp, Homo sapiens
ttgatacttattttggggcccctgtgatgaggcactatcttggctacccggtggctgtaacatggacctgccaaaaagaacctcatagtttagtggggaagacatacccaagaggacaatttagaactctgtgcaaagtaaagtattctagttttgcacaagatttcgaaggcaaaacttggcagattttgtcaatactaattaggtgaatcctttaaaacttcatagacaggagtaatggtttgttttgcggttttgttttgttttttatacatcgtttgatggcagatcattctgaaagtcgttgttgtgtatcattgcatgtctggtgtcatgagataggcagaactgtggggtagtagattaattttctatggtatggtgtgtgactgttcttcaaagacagcttctttctgcctcccttatctctggtccttaagatggcaataaactctggggcctaagataactccagttcttctctggggctatcaacactgtctttggtttctaatactgcagtcatgaccagttttctgtatccttttcacttactgttacccactttgccttgtcttcaccctgtcaaaacaccggtctccctttcagcagtcagtctcattcccttttgactttacagtctcttatttggcaatctcatccagtttcttgcccacagttactgctatcctcccccagaccttgaacatcagtcttacagttatccttttcataggaaaacagaaattaaagacttttaacttacttgttcgttgtattctgggaaagggaaacaggataaaatttaggcattagttaaattgaagggattggttaaagtccctaacttataggcaccccagagaggacagatgtatggaaaggatcagaaaagattaaataatattatttaaaaacaaatatgaaaatgctgcaactcaacactacttttattatgattgctgttaatctgcagagagactgaattatatgactgcttattaatgcaattaactactttaagaaagaagaatatatagaatatcagatctataccaggaataggagatggaaattttttattaaaaaagaaaaatcagatctaagtgcaacttggtgggaggtagagaggccaatgtagagaaaggggcatccttcacgcaataaaggaaaggatccaacagaaaattcattaaggaatctttacaagggtctctgcgataggtcttcaaatacatcaatataaactagagaaccatacccatcccctagagagatgtttcagaaagataatatcaggtgaaaaaggtagccaaaagatgaaattattttccatggtcttagaaaaggattcagaagattcacttaaattattttttgaaacagacataagaaggtattaaatagttttttgtacgtaaaagtcaatgataaatggtgagagttagaaagggagcatagataaaattcttcacacttttgcagggcttttgacaagttccacatacaaaaggtgcttttaaaaaattaaagtattgtgggccgggcgtggtggctcacgcctgtaatcctagcactttgggaggccgaggcgggcagatcacgaggtcaggagatcaagaccatcctggctaacactatgagacctcgtctctactaaaaatacaaaaaattagccagtcatggtggcgggtgcctatagtcccagctactcgggagactgaggcaggaaaatgggtgaaccccggaggcggagcttgcagtgagctgagattgcgccactgcactccagcctgggcaacagagtaagattccatctc

SEQ ID NO: 235221 - DNA, 315 bp, Homo sapiens
gagctcaatgaaattttgcagcagaaaatgttggcatgctgccccaaagggtgagaagaccaggatcttgatggacagaaaactgacacaggctcctctggtctttagagtgcacggcagcactgcttgctctcgagtctgcctcatgtgccagttaacatgggcatagcagtcgactgtgagaaacattgttgtgtttagacaggaaggaagtccttcctttgggaacttagttctgggttcagagactgtatggagtgagagtcctttttaaaaagtggtagtacatagaggaaacaaataaacaaacaaaca

SEQ ID NO: 235222 - DNA, 373 bp, Homo sapiens
gagggagttcaggtctcccaggcctgcctgagcctgtccatgtcagggcgggaggctgtaagtttggggagaaagacaaagacacaggcctacgaaaatcacttccttactttactcattatcttccctttcccacccactccaagccgttcattaagaaagtggtgggcaacttgcccagatctaatggctgcttgccaaggccacatgaaccctgtacaggatccacagaggaaagtgctgttgcagtggcttctggcgctcaacccccaccacgatgcacagtccagccctctgttgctctcagcaccttcccacccatgtgtggttagcagttgtgtgcagtggttcccaattagcacttgggttggga

SEQ ID NO: 235223 - DNA, 648 bp, Homo sapiens
caggagaatcgcttgaacctgggaggcagaggttgcagtgagccgaggtggcgccactgcactctagcctgggcgacagagtgagactgtctcgggaaaaaaaaaaaaaaccttgttactttttcatagcgtagtttagttagctaaattgtacttgatagaccaagtactttgattaacttcgcaatataggaaacatactggaagaaaacttttaaaagagttttaacatcaacgatgctacttcaagataacttgaatgtggatgtggcagccagaatcctagtgagagagtaactgacttaaaatgagaaggaaaaggttgattgtcagaatttcagttattatagcaggcactaaaaaagatgattttttggccaggcgcagtggctcacgcctgtaattccagcactttgaaagccaaggcaggtggatcacctgaggtcaggagttagagaccagcctgaccaacgaggtgaaaccctatctctactaaaaatataaaaattagctgggcgtggtggcaggcgcctgtagtgccagctgcacaggaggctgagacaagagaattgcttgaaccagagaagcggaggttgtagtcagccgagatcacgccactgcactccagcctgggtgacagagtgagac

SEQ ID NO: 235224 - DNA, 272 bp, Homo sapiens
gccaaaatggcttctttgtgagcccttctgactccctggccatcattgctgccaacctctcttgcattccatatttccgtcagatgggggtccgcgggtttgggaggagtatgccaaccagcatggccctggacagagagacatctggtgatactatctgttgattgcaaagaaaaatatacccgactaataagaagaaaatgaatggtgcataatgacccaatctcctttggatataataaaactatgcctgatttgtggtcttcatttac

SEQ ID NO: 235225 - DNA, 513 bp, Homo sapiens
agactggatcctctgcaacactgttgcagtcctgaagctgggtactgctttcaccctccagaccctacagcatagccttagtgattaagacagagagctctggaagcctctaggatttggcaaattacttaacttctgtacgcctcagttatcacatttataaagtaggaaaaataagaacccacctcacagagtttgttgtgaggatcaaatgagttaaaagcatgtaaaaggccgggcacggtggctcacacctataatcccagcactttgggaagctgaggcgggtggatcacctgagatcaggagttcgagaccagcctggccaacatggtgtaaccccatctctactaaaaatacaaaaattagccgggcgtggtgacaggcacctgtaatcccagctactcgggaggctgaggcaggagaatttcttgaatccaggaggcagaggttgtagtgagctgagattgctccactgcactccagcctccacgatagagtgagactccgtca

SEQ ID NO: 235226 - DNA, 907 bp, Homo sapiens
ctgagatgtttgggtggagagaaacataagtctggcctacgtgcacgtccaggcatagtactttcccttgaacttaatcgtgatatacattcttttgctcacatgtaatttgttgaccttctccttattatcaccctgctgtcctactacattcctttttgctgaaataatgaaaaataataatcaataaaaactgagggaactcagaggccggtgccggtgcaggtccttggtgtgctgagcaccagtcccctggacccaccgttgtttctttatactttgtctctgtgtcttatttcttttctccgtctctcatcccacccgactagaaatacccacaggtgtggaggggcaggccaccccttcaataagtaaaatttaaaaacaacaaaaaagccacttagctactacagtctagatttgattccccagcaacagaatatcccacaactcacactggggtcatccagtcctttttgtttcagtgttgtcctttttggtgtatgaaacaaggacctgagaagctggctctttggtcttccttttcttttcactgtctatgtaagaaaccatctaaatctaaaagtgcctcctcctatctttaccagtcaaatcaaccaaaccttggaattgccttgtgtgtgtatgtttgacaatttacaaggttcaaaagtaaaaattaggctgggcacagtggctcatgcctgtaatctcaacactttgggatgccaaagtggaaggactgcttgagcccaggagtttgagaccagctcaggcaacatagtgaccctgtctctacaaaaaatacagaaatagccaggtgtgatggtgcacacttatagccctagatacttggaaggctggggtgggaggagaggaagtgtatactctagagtcggccatgagc

SEQ ID NO: 235227 - DNA, 711 bp, Homo sapiens
ctgagatgtttgggtggagagaaacataagtctggcctacgtgcacgtccaggcatagtactttcccttgaacttaatcgtgatatacattcttttgctcacatgtaatttgttgaccttctccttattatcaccctgctgtcctactacattcctttttgctgaaataatgaaaaataataatcaataaaaactgagggaactcagaggccggtgccggtgcaggtccttggtgtgctgagcaccagtcccctggacccaccgttgtttctttatactttgtctctgtgtcttatttcttttctccgtctctcatcccacccgactagaaatacccacaggtgtggaggggcaggccaccccttcaataagtaaaatttaaaaacaacaaaaaagccacttagctactacagtctagatttgattccccagcaacagaatatcccacaactcacactggggtcatccagtcctttttgtttcagtgttgtcctttttggtgtatgaaacaaggacctgagaagctggctctttggtcttccttttcttttcactgtctatgtaagaaaccatctaaatctaaaagtgcctcctcctatctttaccagtcaaatcaaccaaaccttggaattgccttgtgtgtgtatgtttgacaatttacaaggttcaaaagtaaaaattaggctggtaaagacaggaaggttgctaggg

SEQ ID NO: 235228 - DNA, 837 bp, Homo sapiens
ctgagatgtttgggtggagagaaacataagtctggcctacgtgcacgtccaggcatagtactttcccttgaacttaatcgtgatatacattcttttgctcacatgtaatttgttgaccttctccttattatcaccctgctgtcctactacattcctttttgctgaaataatgaaaaataataatcaataaaaactgagggaactcagaggccggtgccggtgcaggtccttggtgtgctgagcaccagtcccctggacccaccgttgtttctttatactttgtctctgtgtcttatttcttttctccgtctctcatcccacccgactagaaatacccacaggtgtggaggggcaggccaccccttcaataagtaaaatttaaaaacaacaaaaaagccacttagctactacagtctagatttgattccccagcaacagaatatcccacaactcacactggggtcatccagtcctttttgtttcagtgttgtcctttttggtgtatgaaacaaggacctgagaagctggctctttggtcttccttttcttttcactgtctatgtaagaaaccatctaaatctaaaagtgcctcctcctatctttaccagtcaaatcaaccaaaccttggaattgccttgtgtgtgtatgtttgacaatttacaaggttcaaaagtaaaaattaggctgggcacagtggctcatgcctgtaatctcaacactttgggatgccaaagtggaaggactgcttgagcccaggagtttgagattgtactgagccgggatcgtgccattgcactgcagcctgggcaacaagagcaaaactctgtctcaaaaaag

SEQ ID NO: 235229 - DNA, 511 bp, Homo sapiens
ctaaaagtagtgagcagacaggattgtaagaggtgaaaaataggagcttgtgatcagagactaattgaaaatgaaagatctttgatgtggacaagttccaagtgatgaccgagtctaaagcctgatcttcccagacagctgaagtaagagaggacacaggttgaggaaacctgaagtcaagttatgagaaaggggtggtgttacttagatttatttaggatggccctaagatctttggaaaacaaagagccttctcattctttctctaagttctacataaagggatagcttgggcaagtgctgttttagagagtgtgggaagagtgacaggaaacaagtagcacctttaagtgctaacacacctagaatatctatagaagcatacactagaagctactaaggtcagggaagggacagtatggctgggagacagaggtggaaagaatattttttactgtacatctttttatacctttatacctttcaaattttaaactacgtgtaacaatta

SEQ ID NO: 235230 - DNA, 225 bp, Homo sapiens
cgaggaaggctgtgtcgtgggaccttcaggcattgtttaatctgtgcagggcgcagtcttgggcaggccccagccctctcctctgcccactcgcaaagcccggcctgcttgctccaccggcaactgggctggaggagaggcgaggggcagggtgggtgctaagatcctgtgcgaaaagccaggaccctcgtggtacctagggaaatgaaaatcgcgttgacagta

SEQ ID NO: 235231 - DNA, 168 bp, Homo sapiens
cagattgataaactaacagcttctcagttccttctcagcttctggctcccccatccctctaacccccatccctctaacccccatccctttactatttttttccatgagatttgaaggctcataatgtgagcagttttccaaacttatggcatctttccaacacaaatc

SEQ ID NO: 235232 - DNA, 359 bp, Homo sapiens
atagatagtatgtatagtagtcctatgtttcgcttttggaggaagcactgtcctgttttctgcagtgactgcaccattttacatgcctaccagcagtgtctgagggttggtccgctctaaagttattcttcctacacctcccaaagtggaattccaaaaccgccttgttagaccagcctgacaatttacaatattcatggaaagacacgtcctagtatgttcaaaattccaaggttaagatgcctggaagttatattaaaaaagtaaaactgctgtctttgccgcatctactgtgagaatgaagaccgttcccagcaaccaacccatggatattccagaaaaggtcaacattactctaa

SEQ ID NO: 235233 - DNA, 245 bp, Homo sapiens
tgagaaacacttgaacacaggaggtggaggctgcagtgagccatgattatgccaccacactccagcctgcgctacagagagagactctgtctcaaaataataataataaataaatttaaaaataaatgtttgctttaacaaaacttttgtattatgtgttcctaccataactttggaaaactaatagtatctattctacttacagcaagtgcagacacaaactaccaataaagcctattttgttt

SEQ ID NO: 235234 - DNA, 415 bp, Homo sapiens
aagtgaagactaaacttgacctttgttctgtttcttccttgggggattagagaaagtcactccctgtaaccagttatttttctactgacccctgtcaggcctctgagcccaagcctgcacgaatacatccagatggcctgaagcaagtgaagaatcacaaaagaagtgaaaatagctggttcctgccttaactgacattaccttgtgaaattccttttcttggctcagaagctcctccactgagcaccttatgacccccactcctgcccgcgagaaaacaaccccctttgactgtaattttccactacctacccaaatcctataaaacagccccacccctatctcccttcactgactctttctggactcagcctgcctgcacccaggtgaaataaacagctttactgctcacaca

SEQ ID NO: 235235 - DNA, 370 bp, Homo sapiens
ctgatacttaatacacaaatatatgcagttattgacctaaattatgctttaattcctatttatatcagaataataatcagaagcagtttggtttaatagtgacagaaggcagtcaaatgcctagtcagataggggcaggtccccagtgaaacctcaccttcaagccaaagacaatttaaagcctgaaagccaagctacaagtcaaatccactgatcagaccgagaacctctcttcctgtttggcacactttcctgtgattgaccctcatacttcacctattttacatgtacctactcttccctaattgtttttttttttttttactgttctgcccacctttgagtggtgtctttgttttagcttttttgc

SEQ ID NO: 235236 - DNA, 350 bp, Homo sapiens
ctgctgggttagagacaggagaggaaaaaagaatagacagcgattcctggtgtaaaagaaagagctgaactcacaatagaatagacattactctgataaattaaggcccatcataaaaacaagatatttctacaggagtttaaagcctgtagtatactcagggtaacaatagtgctaacttcaaacccagcccagtgcctaactagataaactctaacccttcagtaaaggcctaggagaagaaaagtcttgccccattttaggcataaaaactatttagtttctactgttgcacacaagaggatcagcttccaataacaacaacaacaaaaaaccatgagatgtattta
